United States Patent 8,781,750 (CELL-TYPE-SPECIFIC PATTERNS OF GENE EXPRESSION) - sequence listing, part 48

SEQ ID NO: 37974 - DNA, 69751 bp, Homo sapiens
atttcaacatccattttaagttacggaagagtcaaggctgggacctcatggcatcattttccatggattgctctccaagtttttgtgttcctggcctttggaaccccttcatcatattccgcaggtaagacacatattagtggaattcgagttataatttgtatgcttgaaattgacattgaaggccataatttgtaagtcagagaggctaaacagtaactgtaatgctttgttttgatctaacttggtggttttgtaatggttctctcaaacgctccacatctttctctttctgtgttccatagctggggtttctctccttcctgcctgaatattttgcctccctaatccaattcctttacattatctttgctctgaaatacttctttcgatgacttacatttgctctctataattttacttcaactttttactagtcctgctacaaagaccattctcacattaagaaaataataggctttttttttgttttttttgagacggggtctcgttttgtcacccaggctggagtgcaatggcgtgatcttgactcactgcaaactccacctcctgggttcaagcaattatcctgcctcagcctcccaagtagctgtgattacaggcacccgccaccacacccggctaatttttttgcatttctagtagaaacggggtttcaccatgttcgccaggctagtcttgaactcctgacctcaagtgatctgcctgcctcggcctcccaaagtgctgggattacaagcatgaaccaccatgcccggcccaataataggctttttaagaaattctcaaaccactggagaaatcatacttttctttgagataagcgtgcattatgcccatatctgctttacagatggggaaactgaggcagagaattgataggacttgttttaggtcataaagtcagtgatgatattgaaactatttctttttgtgtcctcatatttgtcaggctagtacttgaaaactgaaaacaatagtggctctggctagaatgactgattgtttttttttcctttcttaaacttttttttttttttttaagagacaggatttcggccgggcgcagtggctcatgcctgtaatccctgcactttgggaggctgaggcgggtggatcacccgaggttaggagttcgagaccagcctggtcaacatggtgaaaccccctctctactaaaaatacaaaaaattagctgggcgtggtggcaggaacctgtaatcccagctacttgggaggctgaggcacgaaaatcgcttgaacccccgggaggcggaggttgcagtgagccaagattgtgccactgtactccagcctgggcaacaagagcaaaactttgtctcaaaaaaaaaaacacaaaccaaaccaaaacaaacagagacaggatttcactctgttgcccaggctggactgcagtgatgcagtcatagcttactgcagcctcaaactcctggattcaaggaatcctcccactttagcctcccaagtagctaggactacaggcataggccaccacacccagctaattaaaaacattttttttttttttgagatggagtcttgctctgtcgcacaggctggagtgcagtggcgtgatctcagctcactgcaagctccgcctcccgggttcacaccattctcctgcctcagcctcccgagtagctgggactacaggcacccgccaccaaagcccggctaattttttgtggtttttttgtatttttagtagagacggggtttcactgtgttggccaggatggtctcgatatcctgaccttgtgatctgcctgcctcggcctcccaaagtgctgggattacaggcgtgagccaccgcgcccggccaattttttttttctttttttgtagagatgggagtctcactatgatgcccagagtggtcttgaactcttggcctcaagtcatcctcctgcctcagtctcccaaatctttgttaactttttattgatatatatggacttccataggtttttcatttgcagattttcaaaggtgtggtaaacagagaagcctagaagcctgttaaaagtagggctaaggatcttgggacattactgactttcccattccttctgaagcaccatggagggaaatgaatttccaagggcccttgtgttctaatttctgttatttcagagaagcctgtatggagcatatgttaagtggtcatccagtcatatttaagggaactgtgtgttaccttccattcctgtagcccaagttctaagtgtgggtttattcttgacttgctgcattggaatctcttggatcataggaccaaggatggggccaagtaaggttctcttctttctcctcagcaggatcaaaaattactgctgccatgaagtctgtggccctagtgttttgtttttgtttctgtttttgtttgagatggactttcactcttgttgcccaggttggaatgcaatggcgtgatcttggctcactgcaacctctgcctcctgggttcaagcgattctcctgcctcagcctcccgagtagctgggattacaggcatgcaacaccacgcccagctaattttgtatttttagtagagatggggtttctccacgttggtcaggctggtcttgaactcccaacctcaggtgatccgcccaccttggcctcccatagtgctgggattacaggcgtgaggcatggtgcctagcctggtgttttgtttttaatcttttctgtgattttataaaagaaagttgcctccagtcttaggttcacgtagtttctctatggggcacacatcttgtacatacaggaaaggctacagactgggtaaaatattgtctcttggttaattggttagtcagctcaataataattgagatgtactttgtgcagggtccagtactgagagtaataaaggaattaggaaacaagctcttactagtagtacatcttgcgaagatacacatataaaataaatttaaacacaattataggccgggcacggtggctcacgcctgtaatcctagcactttgggaggccgaagcgggcagatcacctgaggtcgggagtttgagatcagcctgaccaacatggagaaaccccatctctactaaaaatacaaaaaattagccagacatggtggcgcatgcctgtaattccagctactcaggaggctgaggcaggacaatcgcttgaacccaggaggcggaggttgcagtgagccgagattgtgccattgcactccagcctgggcaacaaaagcaaaactccatctcagaaaaaaaccagaataaaacaaaaacaacaacataattacagagtaacagtcagaacaagtacaaataaatcagcaaaagccagtacttgtgaactgatgggaaaagagagttgggtggagttagtcaatgaggactttctggaaaaggtgagtgttgaaggaagggaggggccccggtttgccgaaaaagatgaggaggtcataccagcaataatgcctgagcaatggtagagaagagaagaatgagcaagctgtaagggccaagcattaaactggttagcttgttaagactggagaatatatgttaaaggataagaaaaaacaagtctgggaaaatgataaggacagttcatggagagccttaaatggttatgaatgaaatttgctttaacagacataatgaaaataacattttgagaagctgagaaacagacgaactataataaaatacaactggagagttagggccaggcgcggtggctcacgcctgtaatcccagcactctgggaggccgaggcgggcggatcacgatgtcaggagatcgagaccatcctggctaacacggtgaaaccctgtctctactaaaaatacgaaaaattagctgggcttggtggccggtgcctgtagtcccagctactcgcgaggctgaggaaggagaatggcttgaacctgggaggcggagcttgcagtgagccgagatcgtgccactgcactccagcctgggcggcagagcgagactctgtctcaaaaacaaaacaaaacaaaacaaaactggagagtcagaacaacagggaatctgctgcaagattctcaggagagaaaaaaaaaatgcctaggtcctaactgtggctctaccaattattagtgtatgaccttaggcaagtccttgaatttctgtgtgcctgtttcctcaaatgtgaaatggggataatggtgtccacctcacagagttgttgagaataattaaatgaattaatatatgaaaagtgttggccaggcatagtggctcacacttctaatcccagcactttgggaggccgaggtgggcggatcacttgaggacaggagttcgagaccagcctggccaacatggtgaaatcccatctctactaaaaatacaaaaaaattaaccgggtgtggtggtgggcacctgtaatcccagctacttgggtggctgaggcaggagaattgcttgaacccaggaggtggaggttgcagtgagccgagctcacaccattgcactccagcctgggcaacaagagcgaaactgcatctcaaaaaaaacccaaaacaaaagaaaaaaaaacaaaatgtttagtaagcactcgataaacattcaattacagttaattaaattattattatatgggctgggcgtggtggttcatgactgtaatcccagcccttagggaggcctaggcaggtggatcacctgaggtcaggagtttgagaccagcctggccaacatggtgaaacccagtctctactaaaaatacaaaaattaaaaaaagaaaaagaaataaaaagaaaaaaagaaaaaataaacaagaaaaacaaaacaaaacaaacaaacaaataaaactaaaaatacaaaaattagccaggcatggtggcgggcacctataatcccagctacttaggaggctggggcaggagagtcgcttgaacccggggggccgaggttgcaggagccaatatcatgccattgcaatccagcctgggcaacaagagcgaaactccatctcaaaaaaaaaaaaagtgtttagtaagcactcgataaacattcaattacagttaattaagttattattatatgggctgggcacaatggttcatgtctgtaatctcagccctttgggaggcctaggtgggcagatcacctgaggtcaggagtttgagaccagcctggctaacatggtgaaactccatctgtactaaaaatacaaaaattagtcgggcatggtcgtgggcgcctgtaatcccagctactgaggaggctggggcaggagaattgcttgaacccatgaggtggaggttgcagtgagcttagatcacgccactgcactccagcctgggtgacagaggagactccagctcaaaaaaaaaaattattatatgttatttaaattattatttctctgaccagtaagtggtcatagaactacatatatataagaaaaggccccatctcacaccttagtttgaaaggattgcagattttcaatctgcctttctgaaaagtatgtaggattcagaggctaagaggccaggcccagagtccaaaattgtgctgcccagtacaagagccactaaccacacgtgactactgatcacgtgaaatgtggatagtcagaatttagatgtgctataaatgtaaaatacacgctggatttcaaagttggtgtgaagaaaataagtaaaatatctcattaattttttttttttttttgagacggagtttcgctctttttgcccaggctgaagtgcagtgctgtgatctcagctcactgcaaccgccgccttctgggttcaagtgattcttctgcctcagcctccagagtagctggctaggattacaggcatgcgccaccatgcctggctaatttttgtatttttagtagagacgggatttcaccatgttggtcaggctggtcttgaactcctgacctcaggttattcacctgccttggcctcccaaagtgctgggattacaggcgtgagccaccgtgcccggcctcattaatattttttatattgattacatgttgaaatgataatattttggatatgttgggttaaataagatgtgttttcatttgtttcccttttacttttttgtgatgtggctactgtaagatttaatactacctagtggttcacagtatgtttctgctggacagtactggtccattacaacatactacattcagttttggaaattacagggttctatctgagaaatttctataaagaaatatgaagattatggataaatctccttgcctttgacactttaaataacattttttaaattgttatttcatttttatttttttagagacagggcctcactctgtcatctggagtgcagtggcaccattacagctcactgcagcctccatccacctcctgggctcaagtgatcctcccgtctcagcctcccgagtagctgggatcataggcacacgtcaccacacctgggcccactgttttttttttttttgagacagagtctcgttgtagcccaggctggagtgtagtggcgtgatcttggctcgctgcaacctccgcctcccgggttcaagctattctcctgcctcagcctccctagtagctgggactacaggcacatgacactatgccaggctaatttttgtatttttagtagagatagggtttcaccatattggccaggctggtctcgaactcctgacctcgtgatccacctgcctcagcctcccaaagtgctgggattacaggtgtgagccaccgtacctggccctggcccccctttttaaagataatttcagttacattatatatatatatatatatatatgcatttatatatatacctcctcaatttgcaaggtatctacagaactgagagagccacagatagttcaccattaaagaggccatgattgctgaaggatcttttagtttaaaaagaaacaaagatgaaaatggggaaaaggtgaaacatcccattttattttattatttatttatttatttttttttgagacagagtctcactctgtcgcccaggctggagtgcagtggcgcaatctcggctcactgcaacctccacctcccgggttcaagcgattctcctacctcagcctcccgaatagctgggacaacaggcgcccgccaccaagcccggctattttttttttttgtatttttagtagagacggggtttcaccatattggccaggctggtgttgaactcctaaccttgtgatccgcccgcctcggcctcccaaagtgctgggattacaggcgtgagccaccgcgaccgcccgaaacatcccattttaaacattaaatcatggaaacaaaaatatagtttttgaaatcactccctcaaaagtccagatctcattggttgaagtaacctagattattaaaggtttttttttttttttttttttttgagacggagtcttgctctgtcgcccagactggagtgcagtggcgcgatttcggctcactgcaagctccgcctcccgggttcacgccattctcctgcctcagcctcctgagtagctgggactacaggcgcccgccaccacgcccggctaattttttgtacttttagtagcgacggggtttcaccatgttagccaggatggtctcgatctcctgacctcgtgatccgcccgcctcggcctcccgaagtgctgggattacaggcgtgagacaccgcgcccggctattaaaggttttataacaaaactttcaaatcatcctttgaatttgctactaacaggaactgaggccagagagcctcaagtcagggcttttcgctgacctggaggcagaatccagtttggggttttgcttgtaactggtattttatgcatgcgaccctggctgaactgaccaactgcgtaggcttcagtttcccgagggccccttatgcctttccttcctctgatcaagcccttcccggctccttccagttggaaggccgcccccagtcctgagcggcgccgacaggtgcagcgcccgcctcccgccctgcgctcgcgcgggcaaccctacgccctcccgccccgccggccgcgccctcgtcctcgccgctccgccctctgccccggcgtgcgcgcgcactccacgggggcgcgcccggccggcggggccgcgcacgcagccgccgccaccacttccccctctccatccctccttgctggccctcctccccttccctcccctccgcccccttccccgtaggcagctcgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactgcagcctttgcctcaagcccgacttgctggacttcaccttcgagggcaagctggaggccgccgcccaggtacagcgaccctcgggccccggggcaagctgcggggcgagcagttaggccgcgcccgcgggctggactcagggcccggccgggagggcgggcgggcctcgagtcggggctgggcggccgcagggcgccgggttcggcgtgctctgcctttctctgttggggctggggctggggctggggctggggctggggccggggcagggaccgtggccggagctgaggctggggctcgggctgaggccgcgctgcgggagctctggggagccggcggcccggccattgcgcccctccccggcgagcacacctgtgtggggctttcccccccgccccggacccttctgggcttgatagtgttccgggggaggctggagggtgttgggggaggacggagaggtcatgggagtccccgctctgcctaaccacctgactcagttctttctttggtttctctctacacctctcgggtgatagattggagggagtggtcatttgggactctggccgccgcgttggagcgaggaggggagcttctagaagggcgggagagggtgagaacgagaatgttaatcctaggcagcctctctgacttctccccgcctgctccagcccaggggctgggtttccaagatgatccgccccctccccctttccctcaagtgacagtgcagcagtgactttgttctctcctaacctctagagaagctgtgggaggaccccatctccgcttttccacctatcttcctagcttttcggccttcgaagctggtggatttattgctaccgtgatggttgcttagcagtaccttcctctcccaagaagctggctgggcgcagtggctcatgcctgtaatcccagcacttagggaggctgaggcgggcgcacttgaggtcaggagttcgagaccagcctgaccaacatggtgaaacccccgtctctactaaaaatacaaaaattatcggggcgtggtggcgggcccctgtaatctcagctactcgggaggctaaggcaggagaatcacttgaacccggggggcagaggttgcagagtcgagatcgcgccactgcattcctgcattccagcctgggcgacagagtgagactccgtctcaaaaaaaaaaaaaaaaaaaaggaaagaaagaagctattagttataacataccaccggtgaaaatattccattactcttcactgcagtttttggtgaatcatactcccctccctcctcccgcagcattatctgaagtattgtttgattttggagaccatcagtatagatgcccgacaaacatcctgcacaataggcatttatgatactatgtaacaggaagcctgtaataaaaatgggaactgtttgatagttatctgtaaatagaatgttagtaaatatattttgtttcatttcttttcctactgcagtctggggtcgggggaaatcagtaggctcccaccttaaagaacatggtgtatatagtaatgaaatgaagtgaagacttgtgctcgaatgaattgaatgttggtagttgtctttgaaaaccaagagggtacggtactcagattaaaaatatgtctaaaagtacagaatttaaaagtatagttatctatactttatacttatctgtgatagataactatagctgtcacatttggggcattggtgtgaaagcaagagggctctaggatttggcagcatcaaaaggcagaacttagtgaaaatcaggtgatttaaaatttttccattaagaatatgaatcagaacgaatgcatcttgggtctaaattagaatttgagaaggttatttgggaaactgtggcttaagccaagtgactagagtgtttgatatatattggcaaggggcagatgggagggattgtaaacagtagtgtgtcttgtgacttggcaaacctttgggaaagagaacctagtgatgaatgagttcgcattatgtgaaaagactaacattaaaaaaaacatttgtttctttaccccattagttgccaaaatggattcataatttttggaggcagacatattttgggaaaagtctagaaaaaagtacagatttttaaataattacttattaaagaagtgagtttgatttaagtatcgggatagaacaacaagcagtgacatgtttctccttacctcttttctactttagtggaagactggtttgtgccattgagtgagcatatggtaatatactagatattagcagggacttgttaatttgatgcaaggaaataaataaaaaataaataaattttgtaagtagcatgaacttttcaaaacactttttttccagaaattcttttcaggctagatggcaacacaaagatgacgcaatagtgaattccaacaggttttattaaaggatgattggacttttaaattgtactaattgacatgtttggaagggtaaaaaaattaacattggtaagaagtaaaaagcatatattaatgtttttgaaatccatgaattagagcaatacgtttaaattgtggcattaggtggtatcttgtgggaattttaaaatattcacaaaattctttttttttttttgagatggagtctcgctctgtcgcccaggctggagtgcagtggcacgatctcgcctcactgcaagctctctgccttccgggttcacgccattctcctgcctcagcctcccaggtagctgggactacaggtgcccgccactgcgcccagctaattttttgtatttttagtagagatggggttttactgtggcctcgacctcctgacctcgtgatctgcccgcctcggcctcccaaagagctgggattacgggcgtgagccactgtgcctggcgacaaaattcttttttttttttttttttttaaatttatttttttactgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtcttctactttctacacagacacagcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggtggccgggcagaggcgcccctcacctcccggacggggcggctggccgggcagggggacaaaattcttatctgtagaaacctatatttatgactgatattggatcagtttcctaacagttggaatcacataacacaaaatatgcaagttgcttagttgctttagttacaaaattttacgataagcccagagtatttgtacaggttacatattagaaacttagtggatttattttattttttatttttatttttttgagacggagtttcgctctttctcccaggttggagtgaagtggtgtgatctcgactcactgcagcctccaccctgtccccctgccgggttcaagtgagtctccttgcctcagcctcctgggtagctgggactacaggtgtgtgccatcacgcccaactaatttttgtatttttagtagagatggggttttgccatgttggccaggctggtctcgaactcctgacctcaggtgatccccttcccttggcctcccaaagggctgggattataggcatgagccaccatgcccggccaacttagtggatttttaacctggcctggggtgtggactgctgcagaaggtgaagaaattagtccatgttcagtgatttaaaaattagttgtcttggccgggcacggtggctcacacctgtaatcccagcactctgggaggccgaggcgggcggatcacgaggtcaggagatcgagaccatcctggctaacatggtgaaaccccatctctactaaaatacaaaaaattagctgggcgtggtggcgggagcctgtagtcccagctactcaggagcctgaggcaggagaatggcgtgaatctgggaggcggagcttgcagtgagctgagattgcgccactgcactccagcctgggcgacacagcaagactctgtctcaaaaaaaaaaaaaaaaaaaaaaaattagttgtctttcacattagtgtggtctagctggttttgaaaatttgttattatacagaagtttctctaggcccaaaatttatttcattccctgtcccctccctttacactggatacttgagagcagtggacttttgtagatatttcatattttgatcctctccgtttgtggataattaattaaaatgaattataagtttatgtgtgtgactactatttatgattatgagtgtgtagtggttggtacaataattgggtattcttttttttttttttttttttgagatggagtcttgctctgtcacccaggctggagtgcagtggtgcgatcttggctcactgcagcctctgcctcccgggttcaagcaattctcctgcctcagcctcctgagtagctgggactacaggcacgcgccgccatgcctggctgatttttttgtatttttagtggagatggggtttcaccatattagccaggatggtcttgatctcctgacctcattccatcttcctcggcctcccacagtgttgggattacaggcgtgagccaccgtgcccagctgggctttctcttatggaaatactttacctgtgccagagaaactaagtttatcattcaaggccagaaatcaggatatcctagccaacccctggcctctactaacaaaatattcatgttggagataactaaattggcactaagtgaagagttgccaatatagaagtttgtttggcatattaaaaatttggcacctgaatggttattgtcaattctgtgttacaaattttttgcccaaattctgcatattttctcttttttttttttttttttttttttgagatggagtttcgctcttgttgcccaggctggagtgcagtggcatgatctcagctcactgcagcctccacccccccaggttcaggcagttctcctgccttagcctcccaaatagctgggattacaggcatgtgccaccacgcccagctaattttttctgtttttagtagagacggggtttctccatgttggtcaggctggtctcgaactcctgacctccggtgatccacctgcctcagcctcccaaagtgctgggatgatgggcgtgagccaccgagccaccgtgcctggcttcttttttttttttttgagacggagttttgctcttgttgcccaggctggagttcaatggcgcgatctcggctcaccgcaacctctgcctcccaggctcaagcgtttctcttgccccagcctccagagtagctgggattacaggcgcgcaccaccaagcccagctaattttttgtatttttagtagagagagggtttcatcatgttggctaggctggtctcaaactcctgacctcaggtgatccacccgccttggcctctcaaaatgccgggatcacaggcatgagccaccgtgcctggccattttctgcatatcttctatgtaatcattttggccgacactgtggctcactcctgtaatcttagcactttgggaggtggaggtgggagaattgcttgagcacaggagtttgataccagtgtgggcaacatagcaagaccctgtctccagggaaaaaaaaaaaggaagaaattttcttaaaaaaaattcatatatataaaattaaattcaaaatattggtgataaggaattgaatttgttcagattttctgttttttgaaatgtatctatgaggaaagaagtataatagttttgtatgctaagctttgtctaattcatctggcaatgaattctgcagtgatttttccagataactgaagtttaccctttgaggcccttagacatttttaaaaaagtttactaggctgggtgtggtggctcacgcctgtaatcccagcactttgggaggctgaggtgggtggatcatgaggtcagaagtttgagaccagcctggacaacatgatgaaaccccatctctacaaaaaaatacaacaattagccgggcgtggtggcacatgcctgtaatcccagctactcgggaagctgagacaggagaattgcttgaactcaggaagcggaggagcggaggttgcggtgagctgagatcacgccattgcactccagcctgggtgacacagcgagaccctgtcttaaaaaaaaaaaaaagttgactaatctgaatggaaatatttctaaaatacattatctttttatgctttgcaattcctcatagtgtaggtttgtttcattgttttttttaaatactgaactttattctgaacatctcttattgaccccaaactatgtactataatttatcagtttcatgtctgtttttttttctttttttttctttttgagacggagtttcgctctgttgcccaggctggagtgcagtggcacaatctcggctcactgcaacctctgcctcccgggttcaggcagttctcctgcctcagcctccctagtagctgggattacaggcatgcaccaccacgcctggctaattttgtatttttagtagagacagggtttcaccatgttggccaggctggtcttgaactcctgacatcaggtgatctgcctgcctccgcctgccaaagtgctgggattacaagtgtgagccaccgcgccaagccatatctgttcttttttttttttttttttttttgagacagagtctcactctgttgcctaggccaggctggagtgtgcagtggtgcgatctcggctcactgcaacctccacttccctagttcaagggattctcctgcctcagcctccctagtagctgggattacaggtgcatgccaccacacctggctaatttttgtatttctgtagagaccaggtttcaccatgttagctaggctggtctcaaacacccgacctcaggtgatccgcccgcctctgcctcccaaagtgctgggattacaggcatgacccaccgcgcctagtccatatctgttctttttttttttttttttttttttgagacagagtcttgctctgtcgccaaggccggagtgcagtggcgtgatctcagctcactgcaacctccgcctcccgggtttaagcgattctcctgcctcatccaagtagctgggactacaggcacctgccatcatgccaggctaatttttgaatttttagtagagaaggggtttcaccatattggccaggctggtctcgaactcgtgaccttgtgatccacccgcctcggcctcccaaagtgctgggattacaggcctgagccaccgcacccggctagcctgtgtctgttctttaaaattgttttgttttccttactctcagattcttcttgctgcttattgtgccttgttgctgcctgttgtgcaatttcttccctcttgtattttactgaacttcatctgaagaagccttagtagccagataaacaagcttgtttgggctaaaaaatcaattgctgtgtgagagtttgttggattctcttctgagtaaagggtatgtgttttattgtacggactttgtatcacctattttggcttttcatccaggccttttttttttttctttctttttagcttcctggttctagatacaactgatactctgatacaacctgggtaaatgtggtcttgagtagtaaattatctgtgaagcttctccgaactttgccacataaatgagcctgctcttgttgtgaagtaaatcttactctaatctgtatgtgagtcagtgggaaataactgagccttcggatggcttttgttgttaactgagattagttctctagattttagtgattttgttttgaacaccatacaagtatgtggttcttggtttatttggtcacttgtaatctctttaaaattttattttaaattaggaagtattttagaaatacaagaaagtcacacactatgagattaaacagatgttaacattttgccccattttcatcagactgtgcatgctttttttgggggggaataaaatgtcacagataccactaaagcccgtttccatctcgtcccaccctgcctctagaagtaacttctttcttcaggtaggtgcgtattattcctttttattcctacgtatagtttaaaactttaattgcatattagtagccacaaacatcacataccaatattctgtgccttttgcatttttacattaatggtaattatttttgaccttctgcaaatggctcttttcagtgtttcttgttagaaaacttggctcaacttgagtttactaattatctgcttcttcttgtctttagctattatagaactgttccaccaaggcaacaattattgctattttaatggtgaaatcagttttattaggcaaattgactcaggcttcagactggcatttggaattgtcacactggagattttcttttactgaagtctcaggacattgacaatcagaaaaaaaccctcttgagtcttactatcgtacatgtaagatatgttcctgagtgactatagtaaagactcattcaggaaaatgttatctccgatttctgcctccctagctcataggaaacttccattgtaaagttgttaccaggcgtcaagctgcctctttggtacagcccttacttagtatttggctcagttgaagtgcagtctatataggaggccaagaagacttaatcctgggtttgaaacaaagcaaggatacactaacattctatcctttaataacatcaagtagaaaaattgaaaatgagcttgttatcagtgcacttttatatgccaaccttgtttcacttgtgttttaaactgggaaactgaagattttaatgctgaaatttctttgaattattacctgtttttttgatagtggaacacacagctaatatttactaatatgaaggtgtcaaaggtgagaaatcatgtactacaccatcaggtcagcactactgtttggaagagcagcatcacaaagagcagtgttatactgcgttgtagtcagcacatacacttatgtccagacagatattttaaattaccttcttggggtagtacacatatgctgatatccaaagtgccatataatacaatacatagtttttaaacttcatatcattctgatcagaagctttataaactgttaggtgaatgctgttagatgatatgagagcacaatttaacctgtgtgtgtgtatatgtatgtcttaacatctattaagtgatgactacatatgaggcactaagtgctaaaacagagactttacatagattatcccattattggtcaactttttaaataagtgcatctctaatataagacaagatgctgaccaatttttaaaatgtgaatggatttctatttttaagataagtacctttgttcctttggttcctccctcccacccttccagaaatggtagtatcctggaaaaaaaaaattagtagcaattcaagaaacagcttaattcattagtataaatagatgagtttcccctaaacacaggaggagttggaaggtacttgaaattggatgttgtgcatggtgcctttccaaaatgcacaaatactttctctcaaatggttgcagtagtaatgtgctgtgtgatttggcatgtataatgttgtacaggtatcttgacattggtggattaactgcttggctactgtgaaattcactgtagatgttgatggatgaaagtgtggttgcctaggtaatgattaagaccagtaactaaaccacagttattattttgctggcataaacttcaaactcagaaaggtttttattcattttacccattggagcataccccagtaagtgcttcatttctttgtgtttctgattttttttttttttaagatggagtcttgcttttgtcgcccaggttggagtgcaatggcgcgatttcggctcactgcaacctccacctcctgggttcaagcgattctcctgcctcagcctcccgagtagctgggattacaggtgcctgcctccacgcccagctaatctttgtatttttagtagagatggggtttcaccatgttagccaggctggtctcgaacccctgacctcgtgatccacccaccttggcctcccaaagttctgggattacaggcatgagctgccgtgcccagccatgtttctgaatttttaagtcaacttctgaataggcaaagaattctttttgtttttttgttcaactttagtgctataaatcgccagttggacacaaaggttttagtgctatttaggtatgttttggtgaaatagtgtgaaggaatattgctgcttaaaagataagccattcagtaaatgacgtctttgttttgaaacatgaagacttatgagaagcattttttttgtaagccaaagtagtttcactttatgtgttacagattttgaatagctcattatagactttgtaatttactgtctctcatttaggcaggtaattttagttgccagctaatcatgtttaaatatgtattggttattaataaatgattacccgtatacaggtctttcatgcagatatcgtactactctgatgttcttacctagttttgtggtatgttcagttgtctaagagcattgttgatctgcacacagattttgtttggtctatacagtgtttctgaaaacttgaattagttaccattaataaaaaatagagagactgcacatgaaatctgaatttgtagcttttaaaaaaaaaaattggaagatcaggccaggtgcggtggctcatgcctgtaatcccagcactttgggaggccgaggcggtcagatcacctgaggtcgggagttcgagaccagcctgaccaacatggagaaaccccgtctgtactagaaatacaaaatttaccgggcgtggtggcacatgcctgtaatcccagctactagggaggctgaggcaggaaaatcgcttgaacctgggaggcggaggttgcggtgagccgagatcacgccattgcactccagcctgggcaacaagagcaaaactccgtctcaaaaaaaaaaaaaaaaattggaagatctgtcagcactaaacctgccagtcaccatagcgataattctttggctccaagaaatggctaccacctccttcttttaaggggttgtgcacagcttccacatggcttgctacacttacctgcctcaggaagcatttctttgtgatttagggcatctgtgtttttgttattttagatttagaacattcaaatgtctggaaatgaatttgaagttttgttttaagcaaggttatgactaaattgaaaaatgcacaagaggccaggcgtggtggctcacgtctgtaatctcagcactttgggaggctgagacgggcgaatcacgaggtcaggagtttgagaccagcctgaccaacaaggtgaaaccccatctctactaaaaatacaaaaattagatgggtgtggtgttgcacacctgtaatcccagctactcaggaggctgaggcaggagaatcacttgaacctaggagatggaggttgtagtgagccaagatcgcatcattgcactccagcctgggtgagagagcgagactccatctcaaaaaaaaaaaaaaaaaagaaaaatgcacaagagtgttaaacaagcagttcacagtggaaaaacttaatggcgcgtgcacacacacacacacacacacgagaaaagatgcatagtaaccaatgttattagtaatcagggaaattctgattaaaccaatggactatcagtacaaaaatttttttttttaatttttgagacaaagttttgctcttgttgcccaggctggagtgcaatggctcaatctagctcactgcaacctccactacctgggttcaagtgattctcctgcttcagccttccaagtagctgggattacaggcacgcaccacaggcctggctaattttttttttttttttttttttttttttttagtagaaatggggtttcaccatgttggtcaggctggtgttgaactcctgacctcaagtgatccacccacctcagcctcccaaagtgctgggattacaggcgtgagccactgtgcctggccaggactatcatttaatacccattagattgtcaaaaatactaaagtttttcagaacatgctgaaagtgggatttcttcattctttgctcatgggaatgtcagttgacaccactctagaggataatttggcagttcttggtaaagttgaagatttatgtccaacaatccagaaagtccactattaggttcctttccatggaaaaattctctcatgtgtgcacaggaaaacatggaccaagatgctagtttgtttgtttatttatttatttatttatttttgagacagagtcttgctctgttgctcaggctggagcgcggtggcacaatctccgctcactgcaagctccgtctcccaggttcacatcattctcctgcctcagcctcccgagtagctgggactacaggcacctgccaccatgcccggctaattttttgtatttttagcagagacggggtttcaccatgttagccaggatggtctcgatctcctgacctcatgatccgcctgccttggcctcccaaagtgctgggattacaggcgtgagccaccgtgcccggccttaatttttgtatttttagtggagatggggtctctctactctctatgtcagccaggctggtcttgaattcctggcctcaagtgatctgcctgcctgaccctccaaaagtgctaggattacaggtgtgagccaccacactcggtggtaagagttattgtataaagttttgacataatttatagtatcagccttcttcctctatcctcacagaaggcctcatggtgagtttgatgtgcaggttaaaatatataattattgcaatatgttgtaagaaatgtttcctaattaagatttttatgaaattaaacgtatttatttatttattttgagatagagtttcactctgttaccaggctggagtgtagtggcaggatttcagcccactgcaatctctgcctcccgggtttaagcaattgtcgtgcctcagccccctgagtagctggaattacaggcctatgccaccttgcctggctgatttttgtattcttttttttttttttgagacgtaggctcactctgtcgcccaggctgcagtgcaatggtgcgatctcggcccattgcaagctcacctcctgggttcaagtgattctcctgcccctgcatcgtgagtagctgggattacaggtgtgtgccaccagacctggctaatttttagtagagatggggttacaccatgttggccaggctgatctcaaactcctgacctcaagtgatccgcctgcctcggcctcccaaggtgccaagattacaggtgtgagccgatgcccccagcctatttttattttttgagacagagtctcactctgttgttcaggccggaggtcagtgatgtaatcatagctcactgcagccttgcttgacctcctgggcttaagggatcctcctccttcagcctctcctgtagttaggactataggtgggtaccagcaccctcctaatttaaaatttttttttgtctcactgtgttgcccaagctggtcttgaatttttgacctcaagtaatcctcctgcctcagcctcccaaagtgttgggattacaggcatgagccactgtgcccagccctttaatagtttaaaatcaaagtttaagtagaaaacattattttatttggctcattggttagatgtaagtgatgtgaaatacttaaacatccattattgtttttaatataatttggaaaatatgagttgctttggattattaaaacttcatttatttgtaccattgatgcataaattctcagtctaggttttagcgaagtctggattttaaaaaattgactgtgatattagttcaagtcttacgaacatcattattattattatttgagagacacagagtcttgctcagttgcccaggatggagtgcagctgcacaatcacagtttattgcagcctcaacctcctgggctcaagcagtcctcccacttcaacctcccgagtagctgggactataggcacacatcacaactcctggccaatttttgtattttttgtagagatggggtttcgccatgttttccaggctggtctcaaactcctgggctcaagcgatcctctttgcttagcctcccaaagtgctgggattacaggtgtgtgccaacacacctggccaagttgtatatactattaatctaggctatttctgacactgttgattttccttttccccttaggtgaggcaggcgactaatcagattgtgatgaattgtgctgatattgatattattacagcttcatatgcaccagaaggagatgaaggtaagagctgttttccattttaatttgctgtctgcatgtgcatatgtggggggggtgcgtgtgtgtgtgtgtgtgagagagagagagagagacattttcaggttaagacttcagtgtttgttactttagaaatgggtaaattcagctgggtgaagtggctcacgcctataatcccagcactttgggaggctgaggcgagcagatccctgagcccatgagtttgagaccagcctgggccacatggcgaaacaaaaacaaacaaacaaacaaaaatattagctaggcatagtggtgcgtgcctgtagtcccagctatttgggaggctgaggtgggaggatctattgagcccaggtggccgaggctgcagtgagccctgactgcgccgctgcactccagcctgtgcgacagagtgagaccctgactcaaaaaaagaaaaagaaaaagggtaaaatgtttatgggaaatattgaatattataacctaacagtattgtgaaataaatgtcactattttacttttaaatttatttttatttttattttttttgagacagagtcttgctctgatgcccaggctggagtgcagtggcatcatctaagctcactgctatctctgcctcgtgagttcaagcagttctccctgcctcagcctcctgagtggctgagattacaggtgtccaccatcatacctagctaatttttgtatttttagtagagacagggttttgctatgttggccaggctggtcttgaactcctgatctcaggtgatctgcatgcctcccaaagtgctgggattacagatgtgagccaccacacccgggcaaatgtcacaattaaaattccacttccaagattaacttattttgtggtactagggaaatcatattttcataagtataaaatgaatataatacgcataataaagctgatgagttatttgaaaaattaagtactttgaacatgaaaggctcctcaaagaggcttcgtttttatgtttttcttaaagtttttttttctttttgtactatagtttaaaattgagataagtcatactcctaattcagagaaaaacatttgctttatgagacaatatgaagattagaagctaaataatggagttagttacaggggaagaacatgctaaaaagaaacatggtatagaatgtggaactcgattagtgtctataaaatgagaactgttttattttattttattttattttattttttatttttttttgagacggggtctcgctctgtcccccagcctggagtgcagtggcgcgatctcggctcactgcaagctccgcctcccgggttcacgccattctcctgcgtcaccctccggagtagctgggactacaggctcccgccaccacgcctggctaatttttttgtatttttagtagagacggggtttcaccgtgttagccaggatggtcttgatctcctgacctcgtgatccacccgcttcggcctcccaaagtgctgggattacaggcgtgagccaccgcgcccggccgagaactgttttagaccttataattttagtatgaaagtagtccattttgactggaaatcttattcccgtatgagctgatttttaaatagataccaagtttggcataaactcttacaagtacatcagtattggagctggattgctttttactttttttttttttgagagagtctcgctctgtcacccaggctggggggcagtggcatgatctcaactaccacaacctctgtctcctggtctcaagccatcctcccacctcaccctcccaagtagctgatattacaggcgtgtaccaccatgcctggctaatattcgtatttgtatttttttatagatatggggggggtcttcctatattgcccaggctggtcttgaactcctgggctcaagggatccgacctctttggcctcgcaggttgctgggattacaggcaagagccaccacacctggttgcctttttacttttgatttcacctagacattccttgtcaaaatggttattggttactctgagacttctttaataaaaaataatttaaggccgggcgcagtggctcacgcctgtaatcccagcactttgggaggcccaggtgggcggatcacaaggtcaggagatagagaccatcctggctaactcggcgaaaccccgtctctactaaaaatacaaaaaattagcctggcgtggtggcgggcgcctgtggtcccagctactcgggaggttgaggcaggagaatggcgtgaacccgggaggcggagcttgcagtgagccgagatcgcgccaccgcactccagcctgggcgacagagcgagactccgtctcaaaaaaaaaaataaaaaaataaataaaataaaataatttacacatttgatcttttaacttacattttatattttgatttcctctctcctttacattatactgaaaagaagtttcattttaaggcctcataacatttatgattttttcttaaactattttgtctatagaaagtcaaagtagtagcagttgaacatactgttccgaagaagtacttaagttcaattgattgtaaattagatcaaactgctggaagaacagattcttcaaatggacttgaatgagtgccacttttaaaaaattgtctggtaaatgaaagagtgattatttaatttctttaactgtggagaaaaatagaagtactttagccaggtatatcaaagcaacaaggctttctttgttgcaggtagagaatgtttaaattcgatgtgtggttttaaagtggtatgtagataggtagatctagtaatataaatgtgtaccttccagctggcatggtttcagctcaagtttgttttttatcttcctgtactaaaaatgtcgggatagaattcaggtgactgaaaagttctttttttttttttttgagatggagtctagctctgtcgcccaacgatctcagcttgctgcaacctccacctctggggttcaagcaattcttctgcctcagcctcctgagtagctgggattacaggcgtgtgccaccacacccggctaatttttgtatttttagtagagatggggtttcaccatgtttgttaggctggtcttgaactcctggcctcgtgatccacccgcctcagcctcccaaagtgttgggattacaggcgtgagccaccgcgcccgacctgactgaaaagttttgaatatgtgtaaccgaatgttgctaagctcataatgatctgtatctcacggaagcccagttagtgttcttactaagagagtcaggagagaaatgaaaacttaatggaaaagaagatttgaagagagattctgataaaacattaaattattttagatacataatatatattcagtgctgggtgcagtggctcacgcctgtaatcccagtactttgggaggctgtggtgggtggatcatgacgtcagaagttcaagaccagcctggcgaagatggtgaaaccccatctctactaaaaataaaaaaattagctgggtgtggtggcgggtgcctgtaatcccagctactcaggaggctgaggcagagaattgcttgaacccaggaggcagaggttgcagtgagccaggatcgtgccactgcacgccagcctgggtgacagagactctgtctcaaaaaaaaaatattttccttcagaactagctaaggtacatttctcaacacttttctaccacagcaacaggaaaaaacctgaagtcatgtgtaagcccatgtaattttagagtttaagagaatgggaagttgtatgagttgttaaagtttgaattgggggcagccaggtgtggtggctcacacctataatcctagcattttgggagggctaggtgggcggatcacctgtggtcaggagtttgagaacagcctggccaacatggtgaaacaccgtctctactaaaaacacaaaaattagctgggcgtggtggcaggcacctgtaattccagctacttgggatgctgaaggcaggagaatcgcctgaacccgggaggtggaagttgcagtgagcggagattgtgccactgcacgccagcctgggcgacagagcaagactctgtctcaaaaaaaaaaaaaaatagtttggattgggaacagggatagatttgggcttccacatgtatgtgtgtgtgtatgtgtgtgtgtgtgtgtgtgtatatatatatatatgtaataaaaaaagaagataaaagtaaaatcagaaaattacttttaaggcatgaaattgttgcttcttttaatttttttttttttttctttttgagatggagtcttcactctgtcgcccaggctggagtgcagtggcgcagtctcggctcactgcaagctctgcctcccgggttcacgccattctcctgcctcagcctccccagcagctggggctacaggcgcacgccgccacgcccagctaatttttgtatttttagtagagacgggattttaccgtattagccaggatggtctcgatctcctgaccttgtgatccgcccgcctcggcctcccaaagtgctgggattaaaggtgtgagccaccgtgcctggccaattgttgcttctttgtgtaagtttttatttgaagaaaaaggccatttttttgtgatatgtgcagtcatcctaaaagacctatgggcatgtgtctgttttttttttttttttttttttgagatggagtcttgctgtattgcccaggctggagtacagtggcgcagtatcggctcactgcaactagtagaactttttttttttttttttaaagaacttgttttaaaataatccttaataggcttttattaactctgtttggatattagttatgtacccttttctctttgcaaaaatgaaaaatcatttcaagtagaaattaaaggtttgtttctcatccctttctttagatatagtaacagttataccagatatatatatatatatgtttttttgttttttttttttgagatagagtttcactcttgttgcccaggctggagtgcaatggcatgatcttgctcactgcaacctctgcctcccaggttcaagcaattctcctgcctcagcctcccgagtagctgggatcacaggtgtgcaccaccacgcccagctaatttttgtatttttagtagagacagggtttcaccatgttggccagcctggtctcgaattcgagacctcaggtgatccacctacctcggcctcccaaagtgctgggattacaggcatgagccaccacgcccggcccagttataccagatataagcaaatttgctagtagtttagatttctggaattgtgccaactacacatcaagagactatttagctttgttacagaagtcagtatcagtttcttgttataagacgagacctggttttacagacttttctatttctcaatggaactttactctgaagatatactcttccatttaaatactagttccaaaacctacattatatggtggctgcttaataaacatttaacattttggttaatttaaatcttgttgatgtgtatacatgaataactgggctaaaagcagatacctttgattattgtgaaacttcaagtaaatattgtgtgaaaaggaccccttctgtctcacaaattctggcccctcagctcattgtctgaacagtgattcccttgcatataataaattcccttggcttatatataataataaatgaagtttattatttatttgaactttttacccctgtaaataccaaggttctttttgcctaagtggtaatttgtgtcattcaaagagtttttattaaatattattattattatttgagatagagtctcactcttattgcccaggctggagtgcagtggcactatctcggctcactacagcctccgtctcctgggttgaagcgattcttgtgcctcagcctcccaagtcgctgggattacaggtgtgtgccaccaaacctggctaatttttaaatttttgtagagatggggtttccccattttggccaggctgctctcaaactgttgacgcccaccttggcctcccaaagtgctgggattacaggtgtgaaccactgcaccagaccttaaatactctgtttaagtgatagtttgataagtgtgaacgcaagtctgaaataggtttctttgcttgtgagaaagtataacgaattgccaagacaatagtgacaaacagagggcatatttttcaaagaggaagagtttatatagtgttaacattaagacaaaagtcttaagtttctaatttctgatcttgtttgttgggatttcttttttttttttttttttttgagacaggtctttctctgtcatccaggctggaatgcagtggcacagtcatggcttactgcagcctcctgggctcaagttactctcccaccacagcctcccggagagctgggatggcaggcatgtgccaccacacctggctaattttttaatttttgtagagatggggttttgcaatgttccccaggctggtctcagactccaagactcaagcagtcctcctacctcagcttcccaaagtgctgggattacagatatgagccactgtgcctggcccttgtttggatttctatgcttatctgtgaagtatattctggtttctatgcaggatagatccattctcaaataaacaacccttaagtatcattagttcaaactggagccaaataaatgtcagcattagaaggagcaagtgatagttagccagcccctttattcctttttagtgcaaatcagagataaagaacatgaagtttgcagtgtatttgcattctttcatttttacatttgttggttttgaataatattgaggggctgtctgataaagaacctgtgtaggtttccatatggctatatacaaagtatatgagcgtagaatagttttaaattttgtcttagttatacttggtaagttttaaaacgttatttaaatagccttaaggtgatatggattgctttagtgactgctgttttaggaatttagttggcttattgctgactatagagggaacgttttatcttctttttaacctccagttcaggttaggtgcctaaccaagtgaaacatttttcataatataatgtttaatagtgataattataaaaataatgatgagtttagtgtttactctataccaggcactaagtgcattacctgttcatatagagaacaaccgtaggcacagagagggtatctactttaggtaataaaactgataaatgttagagccaggattcaaacccaggcggtttggatctagggtccatgtacttgccactctattgcttgtcattaatgtaaccacaccatattgcaattatttgtttgtgtcatgtctgtactacttttcaatggaatcttaagatccttgaggggccgggcatggtagctcatggctgtaatcccagcactttgggaggccgaggcgggcggctcacctagggtcaggagttcaagaccagcctggccaacatggtgaaacctcgtctctactaaaaaaaaaagtacaaaaattagctgggtgtggtggtaggcgcctgtaatcctagctactcgggaggctgaggtgggagaattgcttgaacctgggaggcagaggttgcagtgagccaagatcacgccattgcactccagcctgggggacaagagacttctactcaaaaaaaaaaaaaaaaagatccagtaattatgattcattctttttcatttgtggttttccctggtatctgacatatagtagggatttaataaatatacattgaatgaaacgaagaaaatctagataaatggagtaagtctgtcatacagtagttcctccttatctatggcagatgtgttctaagacccccaatggtacgcctgaaaccacagatagtagcaaaacttatatatgctatgtttttccctatacatatgtactatgataaagtttaatttttacattagaaatagtaagaaattaacaaaagctaataaaaaatagaaccattataacaatatactgtaataaaagttacatgaatgttgtgtgcatctctctctcttttcttttttttgagactttgctctgtcgcccaggctggagtgcaatggtgcgatctcagctcactgcaatctctgcctcccaggttcaagcgattctcctgcctcagcctcctgagtagctgggactacaggcgcatgccaccacacccggctaattttttgtgtttttagtagagacggggtttcaccgtgttagccagaatggtctccatcttctgacctcgtgatctgcccgcctcggcctcccaaagtgctgggattacaggtgtgagccacaatatctttttttttttttgagatgcagtttcactcttgttgcccaggctggagtgcgatggtgtgatctcggctcactgcaaccactgcctcccgggtttaagcaagtctcctgcctcagcctcccaagtagctgggattacaggcatgcgccaccacgcctggctaattttgtatttttagtagggacagggtttctccatgttggtcagcctggtctcaaactcctgacctcaggtgatcttcccccctcagcctcgtaaagtgttgggattacaggcatgagccaccgcgcccagccaatatcttctttttaaaaaaaattatttcatttatttatttttagaggcagagtctctgttgcccaggttggagtgcagtggtgccatcatatctcactgcagcctcaaactgctgggctcaagtgatcctcctgcttcagcctcccagttagctaggactataggtatgcaccaacacacccagcaaatttgtaaaaattttttgtgagtcaggtctggctttattgctgaagttggtcttgaactcctggcttcaagcgatcctcctgcctcagcctcccaaagtgccaggattacaggcatgagccactgtgcccagcctctcttatagtatcttattgtattatactcactcttcttctttgacatttccaaactgctagcatcactactcttgtgctttgaggccattattaagtacaataaaggttacttaaacacaagccttgtgatacattgacagtcaatctgataactgagatggctactatgtgactaatgggctgggtggcatatatatacagcatggataggtcggagaaagggatgattcatgttctgggcagaatggaatgggagggcacaagatttcatcacactattcagaacagtacagtttaaaacttatgaattgtttgtttctggaattttccatttaatattttcagactgtagttgactctaggcaattgaaactgtggaaagtgaaactgcagataagggggacttgtcaggtctgcatttcttcatgtgctctatcctagtaactttatgggtaacaaaattatttcgtatttgagattattttgttaccagctttaacttgtattttacttccctttgaggactaccatcaagatacttactaattgtaaagattctttacagtattttaaatattaagaaaatggagagcataaaaaactgctgtaaattatgtagtttttgcattaaatgtagagaaaacactgattgcataatgttagtaacattgtagtgtatgctgttcttttttttttttttttgagatggagtttcgctcttattgcccaggctggagtgcaatggcatgatttcggctcgccgtaacctcagcctcccgggttcaagtgattctcctgcctcagcctcctgagtagctgggattacaggcatgcaccaccacagccggctaattttgtatttttagtagagatggagtttatccatgttggtcaggctggtctcgaacctccgaccacaggtgatccgcctgcctcagcctccggcagtgctgggattacaggcacaagccgccgcgcccggccgtgtatgctgttcttaagtgtgaagctggaagagttagttgttctccaaatcaatgcttccttactttttttcaaggcattagtagaaactgatgttttcctggtacataaggaagaggaggctcacaactggagggtatcagagatctttcattgctctaggcctaccaggctggtccaagggccaagggaattattatcttgataaacctgtaatacatgtttggatctgccacagttagggaagctctgctatagtttcaagttaatagaattagaagggaagttaggtagtagtcagggctcattttatttatttgtgccttctgttttactttttttttttttttgaaatggagtcttgtgctggcgtgacctcggctcactacaacctctgcctcccgggttcaagcagttctcttgcctctgcctcccaagtagctgggactacagacgcaggccaccacgcccggctaatttttgtatttttagtagagatggggtttcccatgttggccaggctggtctcgaactcctgaccttgtgatccacctgccgtggtctcccaaagtgctgggattacaggcatgagccaccgcacccagcctgttttacttttttcttgatcccagatctttttcagttttcttgctttttttctcaaagaactaaccattgctttgtagacctcagttaactattatttccttattaacttctgcttcctttgggtttactttgcaaggtttttttttttttatttttgagacggagtcttactctgtcacgcaggctggagtgcagtggcgtgatcttggctcactgcaatccctgccttctggtttcaagtgattcttatgcctcagcctcctgatagctaggattaaaggcatgtgccaccacacccagctaatttttgtatttttagtagaggcggagttttaccatgttggtcaggctggtctcaaactcctgacctcaagtgatcggttcgccttggcctcccaaagtgctgggattacaggtgtgagccaccgctaccgtgcccggtctactttgcagatttaaaaaaacttctttaggctggtcccagtgcagtggtgtttataactcatcaatcatagccagttacagatttctttattcctccttcactcccactgcttcacttgactgcccttaaaaaaaaacaaaaaacaaacagaagtcttgagatggatgtttggcttattacttttcagtccttctttctattatattcatttaaatataaattttaatcctaaaaatgtactgcttttagctgcagcccacactttttttggtttgtttgttttgggggaaattctccaggcagtagttatggctgttgttgcttgctgctgctgctttcctatttttgttgatagctttgtgagagtacctgtaatgttgacatactataaagggtacatcttaaaatatgtaatttgataagttttctcatgaatgtaaccaggtaatgagcatattcatcaccctagaacatttcctcatgcccctttataatccttttctccccttttccttgctccttccccaggcaattatgattttattccgtgttattttttttttgtacagagtctctgtcacccaggctggggtacagtggctctgtctcaacttactgctacctccacctcccggcttaaagcaattcttgtgcctcagcctcccgagtagctgggacttcaggtgtacgccaccacacctggctcatttttgtgggtttttatttgtattaattaattaatttttatttatttatttagagatggagtctcgctctgctgcccaggctggggtgtagtggtgtgatctcggctcactgcaacctctgcctcccaggttcaagcagttctcctgcctcagcctcccaaatagctgggattacaggcttgtgccaccattcctggctaattttttctatttttagtagagatggggtttcaccatgttggccaggctggtcttgagctcctgacctcaagtgatccacatgcctcagcctccaaagtgctgggattacaggcatgagccaccacacctggcccaccccccacttttttttttgagacggagtctcgctctgtcacccatgctggagtgcagtggctagatctcggttcactgcagtctttgcctcctgggttcaagcgattctcctgtttcagcctcccaagtagctgggattacatgcgcctgccaccacgcctggctaatttttgtgtttttgtagagacggggtttcaccatgttggccaggctggtcttgaactcctgtcctcaggtgatctgcctgctttggcctcccgaagtgctggtattctaggcgtgagccaccatgcccggcctctttttttgttaagatagggtcttgcggttgggtgtggtggctgacgcttgtaatcccagcactttgggaggccgaggtgggtggatcacaaggtcaggagatcgagaccatcctggctaacatggtgaaaccctgtctctactaaaaatacaaaaaattagccgggcgtggtggcgcatgcctgtagtcccccctacctgagaggctgaggcaggagaattgcttgaacccgggaggcggacggaggttgcagtgaaccgagattgcgccattgcattccagcctggacaacagagcgagactccatctcaaaaaagagggaaaaaaaaaaaagacagggtcttgctctgtcacccaggccagagtgcagtgacaggatcgcagcttactgcaacctcaaactcctgaactcaagtgatcttcccacctcagcctcctgagtagctggaactacagatatacgctaccatggtgcctggctaattttttttagtagagatggggtcttgctttgttgcctaggctggtctcgaactcctggcttcaagggattctctcacctcagcctcccaaagtgttgggattacaggcatgagacaccgtgcctggcctgttttttcttattacatatttttgttctagaattaatttttccagatttgcttgttttctttgttttgcttgattttgggtttttttgggggttttgtttgtttgtttgtttttttaaagtaacttcgcgttacttgccaaatttttcaggattgggattttatatttttgaacatagtaagcaggtatatgaatagtttgctagtatctaggggagctttgttttgttccccgttggttactaatacttaaggttcatctttttccagtgtctgggcttcagatgttcagaagtttaatcacattccacttgtggactgcttttcttcttgttcatctttcctggtaggatatcacttttttggtttcaagcccaaaggagggggtcatttactcaagcttcttgtcttgtcttgtcttgtcttgtctcttctaatagagatagagtctcactgtgctacctagatagactatgttacttaaactcctgggcttaagcagtccttccacctcgcctcccaaaatgctgggattacagacacagtgcccacccagccacaaagcccccagtgttgatgggccctggatttccacttttgtccctggggcctatagcctcagcttccaaatctgctacatctctgctagatcagcaaatgaccccagagcaaaagtggcctagaatgcaaagcttcctctttatggaatttcatcctcttcttcatcttgatcaccttatcttgttctatgattcttttaaggagaagttttcccttccttccagcttttttagttttgtgggtgtcaagtaggagagagataattagtttgaattatatactcctctattacccaaatataaaatcctttaaaaaaaaaaaagataaactgagacctagacaaattaagtaaccgtgtaagaccacataatcaatggaaatcctggtccagaatcctgagtgattttaatgaaatagttcacagtcatttattaagagcaggggcaccctagaaggaattttttgattctgttgaaccagatttatatttggcacatgctcattctttttagactttttagatagcctaataggatagaaccatcactatgttatataaatgtgaaatccatttgaaaatatgggacctgtcagtataggtactgcttgaactgtaactatgcatatatctgattggcttttatgccctacggtgagaaggaggtcaccttgaagctttgcaaagtaagttcttggttccatttttcacttgaatcccccttggatatcctccagaatgatgtgttttctttcccattgcaacattattttcagctttgtggagaaacaaagtatgttccaagtagcaggtagtcactgtaggccttctttgaactgtgaactttatttttttgcacctgaactgctttctaaaaccacataaacaatatgatagggaagttgctatctgaataaaaaaacaaaataaaacctcacaatgtgtttgatctagtactgagctacactggtatatgtgggctatatagaattatgtggtttagattacttgtttaagtatagcagtggcttggaggaaaatacattctgagtttcaaatagataatttgtaaaggaaaatttgaagtacagttgacttggcacttctgatattgaaattttagaagattttatttctgtatctcaatgtaatgcctaggcagaatccactagatgcttgtatagatggtataagcaataatgatttcagctattttaaaaaatttcaatctttttttaatgttgcctcttgaaataccatcttgtacttctcattttccctatacctccttttatgtgattaagttttattatgtatagacataaagggggcctggcacagtggctcatgcctgcaatcccagcattttgggaggccaaggcacaaggattgcttgagcccaggagttcaagacaagcctacgcaatgcagtgagaccctgtctcaaacaaaaaaaaaaaaaaaaaaaaaaaggttggggagggtgctatgatattatgatacatatgttggttttcatccacagtttctgtcatagaacacccatagtccctgttatttcctaagtgactaaaacaatatacatatattttattgaaatatttggccttttattcttggtttttgaagtggcttcagtacagcttcagatcaataaaagtgaaagatggtcttttgtaataacgttggggcactttaaacctcagaagcaggcttcagaaaacagaatcgctctctgaccttttcttgccttgcttttacctgctcctttttctccccaagcaggcaatagaaactaaaaatatactctgatcatcccccaacattctgtcttggagctgacagcaaagaaattatctgacctaccttgtctgattggaggtcataagacccccatttcagaaggcatcctgccctgtacttgggaggaaagaagttgcacagagaggccaagaagactctgaacagagaggccttgctaggtttccccactcagtctgttagcattaggtcctactttgtccaatcatatttctacccggttgtccatgcttcagtcgtgacggtccagtgaagtcctggaccgggtacagagagcttccagatagctgaacacgtggagggtcctggagggtggtgcacccagggagggtatgagagctctgcaccccttcccacatgccttgttctgtgcacctcttcatctgcattctttgtgctattctttataataaaccagtacacgtgttttcctgagttctgggcacagctttagcaaattaatcaaacctaagaagggggtcatgggaacactgacttgaagctggttggccagaagttctggatgaggcctggccttacaactagtgtctgaagtgggggcagtcttgtgagactgagccctctctcagcctgtgggatctaatgctatctccaggtagatagcatgagaattgaattggattagaaggtgctcagctggtggtatcttctgcagaactgattgcttcttgttggtggggagaaatccccacacatttggtcacagaagtctactgtgttgatgattgtggtgtaagagcagaggaaaagcaatttgatttttctccacaaggggaagaaaatgtttcatgattcaactaatgatttacctttcattgtaaggttatcatgctcaagtattaatgtaggaaggcttttttgatgcagagtgtgtgtgtgtgtgtgtgtatatatacgtgtgtgtttgtagagggctaacattaaaaagggaaatgtaataaggaagaagaaatggtgttctaaacttaaaacccatttcatctgctaaatcgtcctagtgaaataccaactttagttaattttaaaaaaagtttagttaattgtaaaaaaaaaagaatctcttcattatattttaaaaaccatttgtgtttcctttttctgtaatttattcatatttgtccattttaaatttcagtgttattcttattcttgttattgattttttaaaacgtggtctttatatttgagtgaaattaaccttccatcatgagttggagcattttttccccaatatatacttctcttttgattttgcttatggtcattttataatgccatggttttttttgttgtttgtttgttttttttttttttttgagacggagtctcgctctctcagccaggctggagtgcagtggcgtgatctcagctcactgcaacctccacctccccgtttcaagcgattctcctgcctcagcctcccgagtagctgggattacaggcgtgcaccaccacgcctggctaatttttgtatttttagtagtaatggagtttcaccatgttggacaggctggtctcagactcctgacctcaggtgatctgcccatcttgacctcccaaagtcctgggattacaggcatgagccaccatgcccagcctggtcatggttttatacatgctatgtttataatcaaattttacttctatttaatagatgactaacacacttacacatagatgcttatacccaaatatatatgtttatagattttaaaatgctaattatatttaaaaggcctaataaggagtttcagcaaaagctgttatatatatgtatataatggaccaattgcagttggatcaataaagaactgtaaggtgtgttatgatctagaaaagtgattcttttttttttttgagatggagtcttgctctgttgcccatgctggagtgcagtggcacgatctcggctcactgcaagctccgcctcccgagttcacgccattttcctgcctcagcctcctgggtagctgggactacaggcacgtgccaccacacccagctaattttttgtatttttagtagagacggggtttcaccatgttggccaggatggtctcgatctcttgacctcgtgatccgccctccttggcctccagaagtgctggtattacaggcgtgagccactgctcccggccctgaaaagtgtttcttaacaataactaggaactgtgctgtgtgttttatataagagtatattatataattttttttttctttgagatggagtctcactctgttgcccagactgagtgcagtggtgcgatctcagctcactgcagcctctacctcccaggttcaagcgattctcctgcctcagcctcccaagtagttgggattacaggcgcacgccaccatgccctgctaatttttgtatgtttagttttaccatgttggccaggctggactcaaactcctgacctcaagtgatcctcccacctcggtctcccaaagtgctgggattacaggtgtgagccaccgtgcctggcccccaatctttaattaagaagcaggtgccaggcacaatggtatactcctataatctcagctactcaggaggctgaggtgggaggattgccagtgcttgagcccaggagtttgagaccagcctgaacaacatagtgagacccttatctcaattttaaaaagaaagaattaggtaatgatatgattttaattttataggtgtggaaacggaggcttagagaattgaataatcatatataccttataagattctctcatactccatttttaaaagttttcgatcaagtttaagttgtattgatacacgatatatagtgaagtgtctatgtacaatgcttaatttacatatatatacatttccaattatgaatatattgcaaactgtattagtgaatgaattattcatttatcatatcagtattatatattactataatatataaatatactaattatatattagtattaatgtaaacattaatttagaaatacttttttctccagtgaagcctcctcagacttctcatatgcatcttcagtatttatgggtttctaccctttaaacaatctaacagttccagagcaaatattatcttctaagaggtttgagatagatccttatttgaatcagtatattatgttgtgactggaaattttatccctagccatgtctctattcacataacattagtaaatgtgatttttcattaatatatttcatatgagtagcattaatgatctccatgacataattacttagtctgttgcttttgaagtgattcattcattctacagatacttactgaacacacactatgtgccagaaactgctagcattggaagtagagctgtgaacaaaatcaagcatcaacatttctgatatttgagaagacaggcaacaagcaaatatgtgatgtaaagtagtgataagtgctgtaaaatcacaagagggtatagaatgaggattgttcttcaagttgatagaacagatctttaaagaagtgatttgaggctgggcgtggtggcttacacctgtaatcccaacactttgggaggccgaggcgggtggatcatgaggtcaagagactgagaccatcctggccaacgtgctgaaactccgtctctactaaaaatacaaaaattagccaggcgtggtggtgcgtgcctgtagtcccagctactcgggaggctgaggcagaagtgcttgaacccgggaggcggaggttgcagtgagccaagatcatgccactgcatgccagcctgggcgacagagcaagactccatctcaaaaaaaaaaaaagatgattcgaggcttcgtgtggtggttcatgcctgtaatccctgcactttgggaggctgaggcaggaggatcgcttgagctcgggagtttgaggccagcctgggcaacatggtgaaaccccatgtctataaaaaatacaaaaattagtcgggtgtgatggtgggcgcctgtagtcccagctatttgggaggctgaggtgggaggaacacttgaacctgagaggtcaaggttgcagtgagccaagatggcagcactgtactccaggttgggcaacagagtgagaccctgtctcaaaaaaaaaaaaaaaaagtgatttgagcagaggcctgaatgacataaagtgtttagatatctggagactttgcaagcagatgcagaaaccctggggttggaaaatgcttacagtctgaatagtaaaagaggcaccaccagcatgacttctagttattgtgctacaccctgcacatttttttttctttttcgagacagggtctcactctgtcacctagatgggagtgcagtggcatgttcatggctcactccagcttcaacctcctaggcttcagcaatgctcttgcctcagcctttggagtagctgggaccacaggtttgtgtcaccacgtatgactaatttttttttatttttcctgtgttgcccaggttggttttgaactcctgggttcaggtgatcctcctgccttggcctcccaaagtgctgggattccaggcaagagccaccatgcctggccctgggcaacatttttattgtcagtcatttaatagcctagtctaatggatgtgtagtgatatgtcattgtgattttaatttgcctttccttaatggctaatgatgctgaacacttttttatgtgcttttttttttttttgccatttataaattttcctttgtgaagtttaagtcttgccatttttaaattgggttgtttacctttttattcaacagctgtaggttttttgttttttttttttttgatacagagtctcactctgtctccaggctgtagtgcagtggcacatcttggctcactgcaacctccgttcccaggttcaagtgattctcctgcctcagcctcccaagtagctgagataacaggcatgcaccaccacgcatggtccacccacctcggcctcccaaagtgctgggattacaggcgtgagccactgcgcccagcccagaaaggaacattcttaagcattgaagtgattcttgtcaaatttgatttctattcaaatttaggagctgggccaggcacggtggctcagccctgtaatcccagcacttcgggaggctgaggtgggtagattgcctgaatccaggagtttgagaccaggctggacaacatggggaaacccctgtctctactaaaaatacaaaagattagatgggcctagtggcacctcacgcctgtagtccccagctaccccggaggctgaggtgggagaatctcccgaacctgatgggaaaggtagcagtgagttgagatagtgccactgtactccagcctgggcaacaaagtgagaccctgtctcaaaaaacaaaacaaaaccaaacaaatttaggagctagcttgtgattgtagaaataattttggcaatagaagtgagggaactgagttgtagtctagctagttaacatgtgacaaaccattaactttatatgtctcattttcttcatctgtaaaatgaggaagatttgattagaggatttattaaagttcttttaaaatctgaaattacagtttcttaattggttttgtagagattttggctttataaaaatgtgtgaaccatagtgacagcagaaacatttgaaatcctatatttgggtgattcataaaagaaaggaagaattatgggcatcttgcctgtaaaatgttatgtaatctgaatcattgttacccacagcatcctgtgactgataaaggtactcatggccacctctcctcccttgtctttctgtagtactttcctttctccccacctcaataatagctttattgatgtataattcacataccatacatgtcatctattaatatttaaagcatacaattcagcggtttttagtctatttacagagttgtacagccatcatcacaatcaattttagaacactttctgaactccagaaagaaagtaccctgcctatttcccctctatcacctagccctaggcaactatgaatctactttcagcctccatagattgccctgttatggacaaatatgtggctggtttcttagtataatgttttcaaggttatttacgttgtagcatgtgtcagctatttcatttctttttattgtcaaataacattcagttgtatggatataccacattttatctattccatcagttgatggacatttgagttgttttcattttgggattattataaataatgctactatgaacatttgtatacaaacattatgtggacatgtgttttcatttctcttggacatatacttaggaatgggattgctgtatcacatgatacctctgtatttaaccttttgaggaattgccaaactgttttccaaaagtggctgcaccatttacattcccactatcaatatatgctccagtttctctacatcctaccttatactttttttttttttttctttttttgagacagagtctcgctctgtcgcccaggctggagtacagtggcacaatctcggctcactgcaacctccgcctcctgagttcaagcaattctaaattatcatgcctcagcctcccgcatagctgggattagaggcgtttgccaccatgcctggctaagttttatatttttagtaaaaatggggtttcgccatgttggccaggctgttctcgaactcttgacctcaggtgatccacacgcctcgtcctcccaaaatgctgggattataggtgtgagccaccatgtccggcctgattggccagcttttcatttggaatggggataggacatagttggaagttggtgtctttggttatttccctaacatgtccaagcatcctaaagtatcagtcaaataagcagtctcttctcattcctggcagagagtaagtcaaagccttaattcaatttgcatacctgttttcatgtaacaacaaataatttttttttttttgagacagagtttctctgttgttgtttaggctggagtgcaatgatgcgatcttggctcactgcaacctctgcctcccgggttcaagcgattctcctgccttagcctcccaagtagctgagattataggcatgcaccaccacagccggctagttttgtatttttagtagagacggggtttctccgtgttggtcaggctggtcttgaactcctgaccccaggtgacccgcctgcctcggcctcccaaagtgctgggattacaggcgtgagccaccacgcctggccacaacaaagaattttaccagaagtgggtatgatttatatcttagtttgaattgctacttacctttggggaacagacctttccttgatgtatctttaacactgaaatcttggcaagttgccaagtctcaaatgttcatgagtaagactgcaatatcacaatatcatagtcacacaggaatctgatagaaaagcatcacatttataaagccttctttcctgtacatcactgacgttttgtgaattttaaagaatttgtaattatttttaaggagcatatttaatgtagttaatgtaacctagaataggctcatttgaaatgaaactcttgctaataggaacttaattcaccaaattaagaatatttagtttttgtagagattttgctcttgaaaatgttgcagtcttgatttcgtcttgtcagtccagtcagaattgtgaagtatttttttttctcattccagaaatacatgctacaggatttaactatcagaatgaagatgaaaaagtcaccttgtctttccctagtactctgcaaacaggtaagagacatagcttttgtaaaatctcgtgatgaatatagtgacatctgacttcctccagagaaatttattgtatgccattttttccctcgttgttattagcagattaagtattaagagcttttttttttttttactttgagatggagtcttactctattgcccaggctggagagtagtggcatgatcttggctcactacaacctccaccttccaggttcgagtgattctcctgcctcggcctcccgagtagctgggattacaggtgcctaccaccacaccggctaatttttttgtatttttagtagagacaaggtttcgccatgttggccaggctggtcttgaactcctgatctcaagcgatctgcccgccctggcctcccaaagtggtaggattacaggcaggagccaccgcgcccagctgtattaagagctttttaaagaggtttgttgcaacttttgggccaccagcatttccttctgcggaagttgggctacgaaaagcagggtttccacctcctgtcactctatattctctttaaacaaacaagccaagaaaaacaggacaaaaactaaagatcattctatcctagaatgtaatgtattgttttccagttttacctttttaaaaatacctttacctaggccaggcgtggtggctcacacctgcaatcctagcgctttgggaggccaaggcgggctgatcacttgaagccaggagttagggaccagcctggccaacatggcaaaaccccatctctaccgaaaaatacaaaaattacccagtgtggtggctcatccctataatcccagctactcagaaggctgaggcaagaaaatcgccagaagtcaggaagtggaggttgcagtgaaccgagatcatgccactgcactccagcctgggtgatagagtgggactctgtctaaaacaaacgaacaaaatacttttacctagctccatcttctattaattcaatccaaatccctgaagtgaatggtcacagatgattttgatatacaaccagagatcaaataggtattgtgttattgagggcacagaaagaaagatacgttgatatgttactattgttaggtataaaagcacaaagaaatagactttctgagcttagtatatgtggaagaaattatataccaatcaattggtgaagtactaagactttgatgaatgaacaaatgaaaaggaacagataattcaaaaggaagaaaatgtaaatgactaataaacatgtgaaaagatattgagcctcctagtaatgagaaatttttgcttctcatgtgagctgaaattttaaaaattcccaatgatatggctgccttgatatcgctggggggagtataaatccatgtaatttttttgtaaagcattctggcagtatatcaagagcctaaatatgttcatgtcctttgacccagcaattctgctaataggaatatatcccaaggaaaagtcataaatacagaaaatactttatgcccagaagtgtctgagatattacttacggtagtaaaaaattataattaatatatttgttcaacactaaggaaatgatcaagccaggaatgatatatctatatagtgaaatatacttagcaattaaaagtgaggtttgcgaattcttaaccctgtaaagtgcttattataatgtaaaattgaaaagaagaatataaaattacatatttaaggtggtgaatcatgtctctaaatggcacaaataaaatgataattatgtctgggtgttgacataattggtgatttttattcttatttatatcttttgtctgattttcacaattttcctactgagaatctattgaattaatataaaattatttttagaaaaaatttaaattggagatgtttagtcttttatttcagtgctcttggaggccctttatgtgtaattattataaaaataaatgggccgggcgtagtggctcacgcctgtaatcccagcactttgggaggccgaggcgggcggatcacgaggtcaggagatcgagaccatcctgactaacacggtgaaaccctgtctctactaaaaatacaaaaaattagctgggaatggtggcaggtgcctgtagtcccagctactcgggaggctgaggcaggagaatggcgtgaacccgggaggtggagcttgcagtgagccgagatcgcaccactgcactccagcctgggtggcagagtgagactccgtcccaaaaaacaaaacaaaacaaaacaaaaaatgctttgccatgaacatgtattaaaagctattgaagaatataatttgaaaaggaaggagattctttcgctgatttcttctacttccattgtctggtgaatctgtctagaaatattcctatgtatatataaatttatgtatataatttaacccacagataggatcacaaatctcagtggcttataaccactgagatttctttcttttttacacatgggccatgaggactgctgatcatatgcagccatatcaccaactctgctggctccacttggctcccaactgtctttccaggactagtagtcagcgagcagccactctctgtatcatgcatggcagagggcagaggctcagggatggggagaaagctagaccacaaagacacatttaaaacttctgcatggccaggcgtggtgactcacacctgtaatcccagcatttttggaggctgaggcaggaggattgcttgagcccaggagttcgagaccagcctaggcaatgtagtgagaccctgtctctataaaaaataaaataaaaaataaaatttctgtgtgatggtggtatacttgatgtctactcacatttcattgaccaaagcaagtagcatgaccaagcccaaagtcactggggtagcatttaacagacatttgcgaaaagtttctaatgaaagatagggcaaaaagcaaaattataagtataatagaaataaaggaagttggaaaaagcaaagacaaatctaaagaaagttaaaaaaaaaacaaacccatagctaattactatccttagagagttaagagaaagcattgcgtgcattaaacaaggacaggacagaatgccatcagataggaagaattacagcaggaaaacttggaaattatgataggtataaaaaacccagtaaaagtgttaaagatgaagttgaggaaacttccaagcagtagaaaaaacagatagaaaacagaaaaatagatttgagaaccagtccagcagaaccaacatctatctagtaaaacagaaagcagaggaaatgggaagaggattttttaattttcatttttgcaacagaatcttgctctgtcacccaggctggagtgcagtggtgcaatctcggctcaccacagcctccacctcgtgggttccagtgattctcctgcctcagcctcctgggtagctgagattacaggcacacaccaccacgcccagctgatttttgtatttttagtagagttggggtttcaccatgttggccaggctggtctcgaactccggaccttaggtgatgtgcccacttcggcctctcaaagtgctagggattacaggcgtgtgccactgtgcccggccagaagagaaactcaaaaagacaggaacatttccttgaactgatagagcaggagccttcagtttgcaaaggtacaccattgagagagactagcttaaaaaatgtaaaaattgccacactgactgaaattttagaacttctgcgataaagtaaaactcccagaaagttcctgtctgggatagggggcaataggagggaaggcaggtggcatactacctttaaaatttaggaatcagaatagtcctagacttaccattaggaacagtggaaacttagactctaatgaagctgttcattcaaaatacaaagtgaatctgattttcaacctaagattgcatgcttagcccaactttgaatttcggagtaaaaatattttcagatttgcaaggtcatagaaaatttgattctttgtaaaagatattggagtgggggatggattagctaaagcatgactttctacagtgaagagaaaatgtctaaagttgaaaaatgaagaaataggccgtggtcgtggctcatgcctgtaatcccaacactttgggaggctgaggtgggaggattgcttgcccaggaattgaaggctgcagtgagccgtgattgtaccactgccctcgagcctgggcgacagagcaagactgtctcaaagaaaggaaaagaaaaaatagctgtgtaagcaagacatttagaagtcacagagtttgaaattgattgcttctaggggcagggtgtggggagtagggcctagtgttgagcagggcctggagcttacgtattttaaactgtgaactattactttgatagaaatttaaaaaattttagagttttaaatctatatcattacagactatatatattctgtgtttacactgtgaaaaaattagaagtcaatagaaaaagagaaatgaaaaaaatccctttttatatatttgaaaaaattatacctctgaataattgagtcaaagaagacttgttatggaaattagaaaatatttagaactgaataatgaaattaccacatatgaaacattagggataaacatgtttcatatgcagataaaatattagaatatttagttaagaagaaagactgaaaattaattagctaagcattaaactcataaaaacaaaaggtaacttggagaaagtagaagaaagttttaagagcagaaacaaatgaaataagtgaagtgaggggcagaaatattaaaaaactgatatttaaaaatagtcccaaaagatatataaacctagccagtatagaaaataaaagcgtagattgaattgttgttcagcattaggaaatatggtaaccatttttcattaaatttaaaaagttaaacattctatatttatcaaaaggaatcagtttatttgctagaattcaccagggaagagtagacagaaacttctaacatgatagaagatatgtattacacacacacacacacacacacacacacacacacacacgacataatctgtgccaagtactgttttaagtgcctcaaaaatattaatttatttagtcctttcaacaaccttttgaggtagatttgttttgtgacaaagtctctctgtcacccaggctggagtatagtggtgcagtcacggctcactgcagcctcaaactcctgggtttaagtgattctcccacttcagcctcccatgtagctaggactgcctacacatgacagtgcatctggttaatttttaaatttttttgtagagacagggtctcgttatgttgcctaggctggtctcaaatgcctggcctcaggtgatcctcctacctcagagagaggatcttgccatcctcccaaatgttgagattacaggcatgagccactacgccagccagattctgttacttctattttgtagataaactaaggcagaaaaatgatttcagtaacttaaataatttgtccaaggtaacatagctagtaagtaacatagctgggatttaaacccaagcagtttaactcaaaagtctgcacttttaaccaccacattgtgctatctttatttttcaaattaaatatttcaaaaacatagtacatttacataatgtgaaattcaaatgctatgcaatgaaattttgtttgccagtctaccctgtcttctttctcagctccattcctcaacagaatgaaatgaaattttcctttcaaaactataccctgcttttgtaagcatttatatatatactttttaagaacacagaaatcaccatgccatacataatgttctgcacctttcttcttttccccttaactgtaaatattggaggccatttattactagtatataagagatgtatcattcttgataaggtctgtttacagcagacatgctaaatggtgaagctatttcaaataataacaaacaagttagagaaggttatgaccattagtatagtatgatttaacataatttttgatatttttggccaatataacaattttgagctaatataacaactgatataaatattagaacagaaaaattatcttgcaggtgtgacaatattgaattattattattattattttttgagatggagtctcgctctgtcgtccaggctggagtgcagtggcgcgatctcagctcactgcaagctctgcctcctgggttcatgccattctcctgtctcagcctcccgagtagctgggactacaggtgcccgccaccacgcccggctaattttgtttttgtatttttagtagagatggggtttcactgtgttagccaggatggtcttgatctcctgacctcgtgatcctcccgcctcggcctcccaaagtgctggaattacaggtgtgagccatcacgcccagccgacaatattgaattattgaatatctgtttgaaaccattggctttcacattttcccaaggtttgctttaaaaatgaagttaatctttttcaagacagattgcacaagtgatctatctgataatgaagcaaatactgagcttatcttaggaggacattaataacctttgtgtttagcctcatcaaatttaacagtaatgcaagctattatacagctaagtaaaacctacttttctgaaattggcaccattctgggatagtgattaaattaccataattattgtaaggtctaacaaccttagaattagtggctgagggtcctgagggtggcatttatatggagaaacactggtagttgtcagcattttgaagagtcaaaaacaagataataaaaagtggtgacacatggcgaaaccctgtttctactaaaaacaaaaattagtcaggcctggtggcgcacgcctgtagttccagctactcaggaggctgaggcaggagaattgcttgaacccgggagccgaaggttgcagtgagccgagattgcaccactgcactttagcctgggtgacagactgagactgagactccattttccaaagaaaaaaagaggtggtgacacaaaggcaacgatctttattccctttttgtataaattaatctctttatttttatagcatttagtagactcattaaatttcttattattaaagtatttcaagatttactccaggttttacaattgttatactctcctaagctttaaacatttaaggtttttgatggaagtcccaatttttcagttgtttactttataaacgagcttgatgtatgtttcaaaaggtttacaaccccaaacataaatatttcatacattggatatgaaataaggtatctaatttgaggaagtggtgtaaattatgtgtgttgataggtataaaattagacaatttggcaatccgttcattaatatggtgtaaatttgataaatgaaatttattaaaaagtcattttttctcctacttgccctaaaattctactatatgaatagtaagtaaatactttgtaattggtatcatataatgtgacactaattaaacttattaatgatttttaaatactttaacttgtgttttgtttgaatttcaggtaataactctttccaatactttgtattttgtttagtatgccactttttggaagtggtcactgtcaatatcttgttatggtttgatggccttggagatttaaaaccgagtaaaagtgtaagcagtctttcttatttagttatgagttttaaaaccacttatgttccaactaggaaaaaatgcaagtagatttaccatgaaatatgaattatatttaaaaaacatcttaacagttgactgacttagtgaaacagactgggcaattccacttatggaattgtaacataaaattccatcatatagtttccattaaaggtagtaggtttttataatctgttagacgttctttgcaaactttattaatgtgaatacatttgcttttttaaaaaaattaagtgaacttctaaagaaaatagaaattaaaaatttttaatttaaattttgctttatagtttaattttttagtatcatttagaattatcaattattttactatatccatatatactgtcccagtaacctgtcattctctttaaagaaaaaagtattcattgtcctctttagatatttacaaatatctgatttctaaaaaataaacatcacaaatgtctattcaattaagcttcagttgagttgtttttttctcagaatgattaagaatatagcactttcattagtggtgactttgctctaaaggtctgaaattttcacttaaattactttcagaaccagtttgaggcatcaggctagagacagtttgtagtttgtcattcacttattctgtagactcgcactccccataacttttggtcctttccaaaagcaaattcaattttataagatgaagatttgactttgagatcattcaaaagagtgtcagaggggctgggcacagtggctcatgcctgtaatcccggcacttcgggaggccaaggtgggtggatcacttgaggccaggagtttaagaccagctggccaacatggcaaacccctgtctctactaaaaatgcaaaaattagccaggcgtggtggtgcccgcctgtagtcccagctactcaggaggctgaggcacaattgcttgaacccaggaggcggaggctgcagtgagccgagatcacaccactgtactccagcctgggcaacagagtgagcctctgtctcaaaaaaaaaaaagagagagagaaagagaaagtcacaacattttgaacaatgtcaaatgtcattgctctttagcgttccaaaatgacaatttgaaacattaggatataaaagtttggtatgattggttaattactttatagtcatgccctatctttgatttgttagacttcccatgctttaaatcttgatatacgtagggcctttaaaatggtcaactaaaaagtcaccattcctctacgttttttcgtgacttgatttgtaaaacacagaatgggattactgttttgccatgcatctgtatttagcggatgattactagataataattataattttttatgttataaaaaagaaagtatataaactcaaaaaagctcacttttttgtctaaattgtttttgctcttatacaatagaatacatatttaagttgtatttttatttgcatttaataatttattaattaaatgtatttctttgtcagatttcaaatgattgaggtgacttgtaagaatttgttttatgccctgttgctgatcaaatcattggtcttccctatagctccttacaaaattatgcaatcagtgttccatttggagtaaacatttagtgtcttatcttgatagagtaattggctacatttctctttctatgcatgaagttgtgtaaaaggaccaattcacatgtataattggcagagagcatgaattctggacttaacattttatcccattctcactacttactaattttatgacactggacaagttatttagcttctcagcctcagtttcctcatctgaaaaaatgaggacaatatctacttccaggtttataaatagttatatatattttaaaagcactgtgcacaatagcacatatcaggcatttaagaataaatgtttgtttcctttcctgttcttattttcacatattggtagtttgagactaagttaataactttttaggcagtcaccctaaacatgactttcaagagttattttaggattagtctgccttttactttagtaagtactgtattctctccattgccaggaggaatatttgaaaaaggaaggaatgatttgaacattgtaaatagctaactgaatatagtgtcttgaggacatatttttggtaactgtgtttaacatctccataaaagtgttttttatttatcttcaatcacaggtacgggaaccttaaagatagattttgttggagagctgaatgacaaaatgaaaggtttctatagaagtaagtatactaccccttctggagaggtgcgctatgctgctgtaacacagtttgaggtatgggttattcttctctaaaatattattattcttaaattaggcattctgacaaaggtgtgtttattatgtggggtgattatttgaggctaggtgcccttggccatgattgtattcacaattttagaatttttattttatatttagccattatctctatagaaaggagggaattaagggtatgggttggggaatgattatatacagttatacacacagacattcaaacacacgacacattttgatacctgaattgcctatatactgtgtacctttcttaaaatcattctcttagtatttgacacctatggcttttcctacagtattattagctgttttctagaattcctttccttctttgacatcttttgtttatcttactgtagtatctgtgctgtctttgattttttttctctctctctgtgtgtgtgtgtgtgtgtgtgtgtgtgtgtgtgtgtgtatacatatatatatatacacacatatatatatttgctgtcctacgtaggccaggatgatttttatttgtcaggtatttgcaaattatataaattgttttgaatctgctagtcgtatttttaagtgttaaatctaattaaatttatttctataaatttcagtatggataaagaaacaattcatgatatccattcttatgtttctgcccatatccctatattgtttgcttgtttgggataacctaaaattttttatccagtttactactaatttgttttacctgatgtatcttctctttcaataattttatgttaccttctgtttagaataatatttgccacagatatttaggtttaattctgtgtttgaatgattccaatgcctttctctacccactttgaacacttcatcctggaatggttggctgatgtatgtctctaaacaattttttttttaggagaaggtatgtgggtaatgtaattcctaaacctttgcttttctgaaaaatctttcatttgcctttatacatgaccagatttactgggtatatagatttgttgatgaaaaaaggtaaaaagagcaacttttgacatccagaggttgtctggcactcacagctagcccgcgttattctccctgttagacataatattacagaataccaactttagacaaggctacttgagaccataataaagtgagacaaaacaagggatccataattttgcctaggtacagtacatacaggatcactatgctacccgcaaaatatcaaacatctccatctctcagttaaaatgagtgactactgcttctttaccaattacggttttagatttgctctagtctggcctccgtatagataagatttattgagatacatacccatagaattgcctcataggacttcttgcagcactcaatctagagtgaatccctgtttacttagaccctcttccaaatcatgtaaaccaaatcccaaatcgtatagtgggttctttcttacattcttatggagacaccagtggttccctgtggtgtgagttctctcttgccatgagtaataggcccagctcattcaattgtaagagtagtacaatcagcttacaatttttcactttcaaaagtctgtgaatattgtttccaaagtcttctacatctcactttttcaagaggaggggtcacagactaaaatgtttcttcttcctttgtaggtaagatgttgtttcgttttgctttattttcttcctgcttgcttgttaaattatatcttgatatcgaaaattaaactgttttttaaaccaggtgttcacttttcattgatttttgcatagtacttggtgaaccctattgatttttagattcaggtaatttttcagtgtgaaagagtttttctgttatatcttcactgtgatatccattccattcccttctcagttaatactcagtttagctctagtatctgtctctcaaattatgtttaattgcttttatcactttgtcctttagatattttcaaacttaaatcttgttatctgtcattaatttcctttagtataaattcatttctctactgctgctgcttctaatttaaatgcttctgtgctgccatttctttccttatactctcccttcttttcagatgtcttttttattcattgatagaattcattatttatttaatgtttttgagaatgtagtcagccaagtttcttctacctctttggtttgtttgtttgtttgtttgttcgtttgtttgtttgttttttagtcggagccttgctctgtcgcccaggctggagtgcagtggtgcaatcttggctcactgcaacctccgcttcccaggttcgagccattctcctgcctcagcctcccgagtagctgggattacaggcatgtgtcaccatgcctggcttatttttgtatttttagtagagatggggtttcaccatgttgaccaggctggtctcgaactcctgacctcaggtgatccgcccacctcggcctcccaaagtgctggaattacaagcatgagccactgcacccagtctgttgtttctttttatgatacagtatcttgtcattggttccattttatttactaaataaatggaaaattctgtttactgaagtgtctttcctttataactgataccctgcagaacccctaagttttattttgctttcataaggttgctcttttttaaatttttaatgaaagagtaaggactcaagtaggtcaagtggcgacagttttatgtgtagcatatggaagtgccattaaatgaatgacctgtcttgaattgatagagcatctgtctttattcccattgctgccattccagataaagaacaaagcacatcaaagattgagaatatttttatttttaattcaaaaataaaagccagagaggcaacttaccatgttttcccaactttgaattcttatagcatactctttactgttctgtgctctgtgttgtgttaacattattgatttgaaggcatttgcattaaatttgaaatgttgaaatgttaaaatataaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcgtgctatcaaagcaacttttgatatctcattggttgttcctaaagacagagtagctttatcaaacatggtatgtatgtgtttataagtttatctaaaatttcaataggctttagcagatttagtttgctgattagatgggataatatgaaaccacctaccacagtgctggtatattataggaacataaataatagttttctttattttcaataagcctctttttctttcttttttttttttttctgtagagttggggtctcattatgttgcccaggctggtctcaaactcctggggtcaatctgtcttcctgcctcagcctcccaaagtgctgggattacaggcatgagccaccatgcccagccaagacctctttttcttgatagctttatttttggaggattttctccttgtcaaattccttgttaaatacatttataagattatctacttcttttaatttagagaggtaaattgacaagtttaatagatttatagtaattaaaagcaaaagtcttgggctggatatggtggcttacacctgtcatcccagcactttgggaagtcaaggtaggcagatcgcttgaggtcaggagttgaagaccagcctggccaacatggtgaaatcctgtccttactaaaaatacaaaaattatctgagtgtggttgcacacacctgtagtcccagctacttgggaggctgaggtgggaggatcacttgaacccaggaagcggaggttgtagtgagctgagatcacaccactgcactccagcctgggtgacagagccagaccctatctcagaaaaaaaaagaaaaaaaaagaaaaaggtcttgacttattaaatgtcataagaaagccaggtacagtgactcttgcttgtaatctcagtgctttgggaggctaaggcaggaggattgcttgaggccaggagtttgacaccagtctgggcaacatagtgagacctcatttctacaaaagatttaaaacttaaaagttagccaggtatggtggcaggtgtctgtaatcctaactacttgggaggctaatgtgggaggatctctcgaacttaggagtttgaggctacagggagccatgattgcgccactgtattccagcctgggtgacagaacaagaccccatctcttaaaaaaaaaaaataggccaggcatggtggctcatacctgtaatcccagcacttcaggaggctgaggcaggtggatcatttgaggccaggagttcgagaccagcctggccaacatggtgaaaccccatctctactaaaaatacaaaaattagccagatatggtggcaggcacctgtaaccccagctacttgggaggctgaggcaggagaattgcttgaacctgggaggcggaggctgcagtgagttgagatcgcgccactccgctccagcctgggtgacagagcaagactccatctcggggggaaaaaaaaaaggttgcaacagagcaagaccctgtctctatctttttaaaaagttaaaaaaattcaaaagatgtagctgcataatgaagtatatttaggtttctggctgtttgtattcttggaatgtattctcttcaccagtgttattgatctcattcatgaacagggtaagcattccccacttgaagtgtgttgtctaggactgtcttgtgtggggaacttggaaaaacctgctgcacctgaaaataactcttttatgtatttactgggggagagcatcccataaatagaatgtcattctcttcacacatattcttagaagaggaggctaatacattaagcagaaatattcattcacactttagtatgagtgaatttatcagtgtgttcttgaataagtcttccttggaaggaagaatagagagagcttgaggaaatggagcctgaataggaaaaagagggagaacaccaaaggaaattagggactccaaaggtaaagttgaaatttcttcacaaataagcttagagccaactttggtagagaatgccctcgatctagaagtttgtatcctttgaaatgggagattctacaattatattatattttttttatttatttttgagaaggagtctcgctgtgtcgcccaggctggagtgcagtggtgtgatcccagctctctgcaagctccgcctccctggttcacgccattctcctgcctcagcctcccaagtagctgggattacaggcaccccccaccatgcctggctaatgttttgtatttttagtagagacggggtttcaccatgttagccaggatggtcttgatctcctgaccttgtgattcgcccgcctaagcctcccaaagtgctgggattacaggcgtgagccaccgcgcctggcccctattttatttttattaatagtcattttctcctaaacttatgtcagttgaaaagtatgaagcccttacttaaatcatcccaatgcctggcttataataagtattcgagaaaagtccattcctcttttctctcacaggtccttggtagttttaacacttcagcctccagcttcttagtatgagtgttttatcagaccactttccttcttaaagacagcataaaagcactggatgaattggggtagagaaataagccatgctagaatagaaagggggaaagagatgcaataaagcctacagtttttggctggtatttgctctatggtattaatgtaaacctatttaaatttttcttttttttctttcttaaagaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggtaaatgtacttgaagaggattgttccagcagtccataactccaggttggggaatttacatttctggtcaattattagtacagttatttataatttaatctgaaagttgtgctacttggtttatttttaatagaatttaggaaatgccaaccttggtgtttcgttattttacaaaataataattaagagaatataagagtggaatttctctagggaatgggttggaaaatatgtagttatatttttcatatcaagttataaatggattaaagtttggccattgtattcaaagtttggagctaaggcagtcttcggaggtagggctccctgggattcatttctagtaatttaagatacattggcttgcaacaggattcctttgtgggtttcaatatgaattataataacatatttattagatggttattttgtttatacttttataggttgctgctaaaaccttgcctttttataaggactacttcaatgttccttatcctctacctaaaattgatctcattgctattgcagactttgcagctggtaaagtaaatttcattttattgctgaattgtaataactttttaaaattttgtgacttttgatgcaagagtatatatatatatatatatatatatatatatatatctcaataaatgtttatatttattttgtgaaggtgccatggagaactgggaccttgttacttataggtatgttaatgatgtattaccctgccttatcttttcaaatcactgatttcaaaagggcttccctcctaatcacagttgagtagcttctgctttacgatatggtgtaaatttttctaccttcccccacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaggtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggtatttaatatttttaagtgctcaaatatatttatcttcatcctactccacattattttggctacatagtatttcaagtttggctgcaacactgtgccaaaaaataattgagtgatagaaaagtattattttaaaaggtccactttgaaagggcttatcagaatctctgcattgaacaagggcatatggacagtctttattcaacagacacttcctaaactgttctaaaatttgtctgcaaatgggaaaagtcaagatactaatttgggtgagaggaaaagattcctcttaggtgtagatgaatgaatcatgcagtgagattccaggctaactgtagtttcttgaatcttatttgttaatctgactcacagctgaaaagtaacctgatgaataacagactgatctttaattagagagaaatgtttttaggagtcagttttttcattgcctaaaatgttaagttgaaatttaatgaaataaaagtaaacaaactgcagagtgactgcagaataaagctgtattaaaattccagctgttctgttgaaatccttataatgtttgcagtaatgatctctgtccttcagtcctgatttttcactcttactctaagtaaatactatttatgaatgccaactgtgttagagcttgggagcacaggatttaataagtgaactagatgtacctctgcaattaaataactggatattctggagccagctagattccctgacattttaggctgccaaagagcagaacctgatttgaatgtagattgagtccatacgttatataaataagaatgtaagacatttatcaactgttacgtgtctcagagagtttctacagaaagtcaacccttgaaaataaatcttttccttttattttggatgtttaaaattttacaggtgaaaaaaattctttgaaatataatttcaggccgggcacggtagctcacgccagtaatcccagcactttgggaggccgaggcgggtggatcacttgaggtcacgtgtttgagaccaccctgaccaatgttgcgaaactccatctccactaaaaaaaaaatagaaaattagctgggcgtggtggtatgcacctgtaatcctagctactctggaggttgaggcagaagaatcgcttgaacctgggaggcagaggttgcagtgagccgagatcacgccactgcactccagcctgggcaacaagagcgaaactccatctcaaaaaaaaaaaaaaaaagaaatataatttcatgtggaactatgtgttggtgcctgtattcaaatatgtgaagaaatggccttttcttctaatgcagcgagtttgctactttgtaccaaataatttttttgcttggctttgagataactttatgattttattttgaaactacaagcaataaattttagtaggggaaatgtgtacattcttattaaacaactttttactggttttatgtaactattctagttattagaactgaaattccaagggcttagggataggttggaaaataagtttcattttatgctagtttattttaggaagctactaggcaaatagccacttatcacttaatatcaaaataattttttttttaagacagagtctcactctgtcagttaaactggagtgcaatggcacaatcatggttcattacagtcttgacctctgggctcaagcaatcctcctgtctctgcctcctgagtagctgcaattacaggtgtgtggcaccatgcccagcttatttttgcactttttgtagagacaaggtttcactgtattgccttttgtagagacagggtttcactttgttgcctaaactggtctcaaactcctgggctcaagcaatcctcccacctcagcctcccaaagtgctgggattacaggcatgagctaccacacctggccttttctggggggactggttggggatggagaataggatctcactttgttacccaagccggagtgcagtggcacaatcatgggtcagtgcagcttcatcttcctgggcttatgtaatcctcttgcctcagcctcccaagtagctgggaccacaggtgtgtgtcaccatgaccagctaatttttttttactttttaatttttttagagatggagtctcactgtgttacccaggcttatctcaaactcctgggctcaagtgatcttcctgccttgacctcccagagtattggcattacaggagcaagccattgtgcctggcctgctttctttcactaataggcttaatcaactttaataaaatttagattaagatctttaaaattttttaaaaactgattttatctgtcactcatattctttgtccattccatttactatgcattcttatttaacaggtgataatttcatattccataagtgcttaaacaccattcattactgaactacatttttgtttaatttcacataatttttatataagcagtactctttctcagtttctcttgaacattcaactcattagtgagtggttttccccagtcatttccatttttctttatttggctctgatagttttctgtttttgtttttcagagataatcctttactatactaaattctacgtgattatattttccacctctatttgcctatatttatctgctgtcttttccttttccatatatgggcttattttttttttccctcttcttccttttctacctttggtatttaaaaagttacttaggactgagtgcactggcttacgtgtgtaatcccagcactttggcaggctgaggcgggaggattgcttgagccccggtgttcaaggctgcagtgagctacgatggtgcccctgccactccagcctgggcaacagaatgagaccctgtctgggtttgggggagaagttatttacaatgttttgaaaatatcctttggcccaggcatggtggctcacacctgtaatcccagcactttgggaggccgaggcaggtggatcacttgaggtcagaagtttgagaccagcctggccaacatggcaaaaccccatctctactaaaaatacaaaaattagccaggcatagtgatacatgcctgtaatcccagctactggtgaacactccagcctggtgacaaaacaagactttgtctcaaaaaaaaaaaaaaaaaaaaaagaaaggaaaagaaaatgaccctcagatataattctaatatcaccagttggcctttcttgacatctcttttagtcttctctctttttcagaaatgtgagttctttgccaaatgttttgaactgaattttaggtcattaaattgtgagttttggaatatagtggaagggacatgtgagtgttttagattagtagaatgacaatcatttcaatttctttaagtattttcatcttctgtttttaggaatggtggactcatcttcggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtgagccatactttctaaccattagcctatgactgctctcatttacaatgaaatacgtaatttgttacatagatactttggactttgaaaagaagagaaaatagcatgggtgattttactggttcatatttctagtcttgaaaagctagtaagtctaagttctaattaaacatttcttttaaaggtaggcagtaaaaaaaaattggtctggccaggcgcagtggcttacgcctgtaatcctagcattttgggaggctgaggcgggtggatcacctgaggtcgggagtttgagaccagcctgaccaacatggagaaaccccgtctttactaaaaatacaaaattagctgggcacggtggcgcatgcctgtaatcccagctactcgggaggctgaggcaggagaatcacttgaacctgggaggcagaggttgcggtgagccgagatcgtgccattgcactccagcctgggcaacaagagcaaaaaactctgccaaaaaaaagaaaaagagtagtatgggagaagtcatacctattgggtaacactatggttccattgtttatgtcaaggaaaattctggacatattttattgtcagggtctgttttgtgaatactttaattctcttgacttagcctatccctacttcagtttatatatataaattttgtatctaaagaactagagttataatcctacttcaacatatttaattaggctcccatataattgtaattcattacaattagtgcaagaaatctaatgttcttcacctccatgtcttcctcatcactcctctgcaactaccccaaaaataaacagaaccacagtggcttctttcccagcagaacaaagccaggactggaacccaagctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacaggctatctgcttcctgtcataaccctgaatcacattgtctgccaggtcagtgtgggccatccatctgaggttgatgagatatttgatgctatatcatatagcaaaggtgcatctgtcatccgaatgctgcatgactacattggggataaggtaaaaaaaaaaactttaagtatttcattctttcatggtgaaatcataagagttttgcatgaaaaaaagtctcactttatttggattaagttcccaaatagtttctggcttgtcattttttttaatgaccaaaaagaatgagaattcaattatttgaagttgactactgtggtctcttagatgagtgatgtgcaggtgtgtttgggagtggaaatgggaggctgttataaaacttaagagcaagaatagaaggcatagagtatgcattattaaataaaaggcagtaggcatcagaaggatatatgtgtttcagtgtatctgatacttgagtatttgagtaaatttgtttttgattactaatatacaaatatactataaattctgagatctgacttccctggattttaaaaattgtgttttctcaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttg

SEQ ID NO: 37975 - DNA, 14567 bp, Homo sapiens
gcgcaggcgccgagaggcgcacgggagacctcaggcccagactccactccccagctgtgaaagggtaagaattgagggtggctgaggctcggggttgttcagggcggggtgggctctggacccagcaggcccggcacccaggtcagggatccaggggaggccaggtggggcgaaggccaagaaggggccggggctggtcaggaagggctcctggtgaccagagcactttgcgtgagccagcgtgggaggaaggtgggctggatgagccagggaggcgccgggaggggccttggcagaggcgaccccctctgtcagcccccaggccactgaaccctgggtagcaagaaccggcaggggaggctgcagacggaggagtggaggctccttggctttgggggctctgagtagaagcatctagggggtccctcaagaggcccccaaatgctgccccatggtgagaagacagggagaggccctgcagggacccccccgggttacaaagggctgccactgtgagaaggcaacgctgctggcaggggctgggctttctacctcaccaagcctcttcccacccaaagggcccagagaggggcagctgcccccccagcgggcacagcacctcctccctctgtgatggggtggggcccacagtctcctttctcgcggcctgcctgggctgaccctgggtcccagctcggccatggggcttcggcatgtaaagcccttggggggcagagcctcccacccccgccagcttctggctctctgtgtcgcccccagcactggactggtgccttggagggaggctccgctctcctccacatcaacccgctgaggagttctgtcttcccagggttgtgagagaaatcagctctgcaggcctatgtccaagtctaggcgccgcctcctccagggagccttccagacctgatctgtgtggcagaggcccagaaggacctgggtgtggggatcctagagggaggcgggggacccagcgtgaggagagagggtcccagtgcttcctcctgagtgagggtcacccatctgactccggctgcacagagccactccctctaagcgctcctgctctctgccttcctgcattagcttttgcctgtacccggcccagcaaacccctgctcatctttcagacccaagttcaaggcctcctcccactccgggtggctcatcacctggcctccccaggcagagaggctaggctcctgctcactggggcgtctcccttgcccactggcgcgggactacaaggaaaggggttgacccccaccctcccccgccacgcccaggagggtgcagacacaactgggaaggtgctagaggccccggggggaggctgggccagcaccaggcattggggggcaggttcccgtctctataccccagccccaggaggacagcacgtgcccctcccgctgccccacctgtcacccacctgctggccccgggctgtctctgctcctggctcccctcccagctgcgtccccagctgcctctccagggaggagtgacagctggcctgtgccacaccctcgagcccccccccacggactaccccctccctggggcaggacccctgcctgtggcacaaccaaggggcctgctgatgggggctcatgtgagcagtgccccagctgtgggtgtgggtgctgccagctgccaccgcctttgccctggtttcccagatagaccccgacccacactccgaagctgtatcatgaatgctgtggtgggcggctggtggggagcggggttgccgtcccactaccctctggaagcctcagccatgaagggcccctgtgggcaccttttcccggcacacggtgctgtgtctctccactcttgggctctgcagtgacttgagggttcaagtctatgatcccacgggaggctgggctaatgaggggaccagagacctcagtgctgtgcagggagtcccgaaccaccctggtggaaggccctgcccaactccccagtcctcccgccagctccctgtggtgtccaggagacctgtggtcaggcctggaggagaagctcctcctcccctcgacatcctccctgcagcccttgctcttcaccagagcctcctgactccccaggaccccagagaggaccgaccctctccagccgacctctgggctcaggacagctgggtggggcagccacaggagctgcctgtagggagcagagtcaggacggggaccgagccggacacccattctggaagtgtctgcacttccaggcaggggaaggacggcaatgggtagctgggagtgctgggccgaagatgggcattgtcaggccctcagtggggactgggaggtagaggtggggaggtctgtggaggaaggagaagaagggccagtgtcccgagtcgggggtggttggcagtggacgaggccgacaggaacagacctgagcttggggagctccactcagaacgaggcatccttcagggttctgtgcatactggtgtccctggctgggggccaggccccgaagtggagcctgggactgtgagggtgggggtgtgtgctggggtgggaggtggatggagcccccccgtaaccgcctggctgcttgggctgaaccttggacttcggagccagaacagacataggaaatggcctaattgcatttgcgcaggaacaccaaatccctcgcagctgcacggggctgagccggggccacaggcagggtcggccatcccagagtcctgacagctccgtggtgcatgccaaggggcctgggccgctggccggggggcgcctttcccaggccagaggcccccaccccaccccaggagagctgcccccctttcagttcccagaacggagcccagctgtggaatagtgatgcggtgaggtcatggggagggggcccgcatgactcatatcctgggggaggggaaagggaggagacggagaaggggcccagaggcctccacgttctcagctctgctgggtcagaggccaggggctggcggggcttctccccagcactgggttttaggggagacaccaggagatgcttactctgcatccccactctgtcccccaggcccctagccagggagagctcagtcagagtgatcctccaggggcccagctctgcatggatgatgttcccagagtacacacctgggcctcgtgccagggccggcaccgccgttgtcggggccatggcaaggcaaacagtcaatgtttgcctcactaaagtgaggctgcagcaccctgaagggatccctggagggggacgtggtccccttgttcccaagcctgtctgcacatgcacgtggatgtcaagggttcccgtgtgtgagcacgtgcatatttgtatgagcatggggtgcaggcatgtgtgcctgtgtggccggagcgtgggctcgtggagaatgtgtgtgagttgggtgtgcacctgcatgtgccccaggcctagggagtcccgcgcccggccacactccatgtgttgggcatgagctgtgagcagagtgagggcctttatggggctgttggggcccggactcgttgcccttaggggtggacctaaggaaacgtgtgcacacgggcttctggggtctctgtgccaatgtgtgcttccaagccacgcccccccatggcttggtggagggggtctgtggagctggagtgagggccctggacccattggaagcccaggtccaaggaggagcttgggctccatctcatgccccaggcccaaggacacacaccccagctgagaccttgctcacatggaggggctgggacatgggaacatggggagcaacatggccaggcttctcctccgtggaacccctccacctcctcaatactctgccccagctctgcgccgccctccatttggaggggctggatcgtgagtgggagcgtgagtgagcatgagggcccctgcaccccaggctctgcctccccatgtggaacgaggcccagcagcccccagccacgcggctactactgcattcaatcagtgcccctccatctaacaaatactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctttgatgtgaccacggtggctgtccactaaggtaatcctgatgcttttcctcctctgcagactgctggccagacccccaagctagcccgccaggcctccatagagctgcccagcatggctgcgtccagtaccaagagttggtgggagacgggtgaagtacaggctcagtctgcggccaagactccatcctgcaaggtaaggtcccctccaggggcaaggctgggctgcagagccagcaccggggagtttagtagcaggccaggtttccttgttaagacaagcgtgggactgtccaggatgaatgtgggcagacagaaccctgaggtattgcagtagggttgggttcacccttgctggtgtagaaggctgtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccccaggatattgtggctggagacatgagcaagaaaagcctctgggagcagaagggaggctccaagacctcatcaacaattaaggtagagcctaaatgtggttggtgcaggcaggaaatattaactcatttcattgtcacatgaaaccagaagacataaaacagttaaaataggccaggcacagtggctcacacctgtaatcccagcactttgggaggccgaggcgggtggatcacgaggtcaggaggagaccatcctggccaacgtggtgaaactcggtctatactaaaaatacaaaaaaaaaaaaaaattagccgagcgtaggggcacatgcctgtaattccagctacttgggaggctgaggcaggagaatcacttgaaccagcaagttggaagttgcagtgagctgagctcacaccctgcactccagcctggcgacagagggagactcagtctcaaaaaacaaacacacaagcaaataaaaaaaacaaaacaacttgacacacttagaaaatgaaggtttgtgctattagttttcttttattttagaaaaacaaagcattgtttaaatatttcttacaagtacaaatataatttaaatttaataaatgttcaaaaatatctgtaattgagtttcattcagcagacatatgtctaatagagaacttgctaagtaagatataaaggatgattacatgaaaaaatcacaaaattgtcagtaagagtcttaaaagtcagtgataggacagtagttaaaagatatcaaatagttatttattcttaaacattaaacaggatattaatagttttaataatcttgaagtttgacaacactgtaaaaacattacagaccacttttatttatgaaaatacgtgcaaatagcaaacaccagttgggcttaaggctgctacttacttactcagtaagtgacaaagctggaattcaaaccaggtttgagctataccactactacccttgaaaaggtttcattacactcagctttccttaatttcttaaactctttttttttttttttttttgattgagacagaatcttgctctattgcccaggcgggagtgcagtgacatgatcgtggctcactgcaacctctgcctcccagattcaagcaattctcatgcctcagcctcccaagtagctgtgattacccgtgtgcatcaccacacctggctaatttttgtgcttttagcagaggtggtgttttgccatgtcagcgaggctgatcttgaactcctgacctcaggtgatccgatccacccgcctcagcctcccaaaatgctgatattactggtgtgagccaccacgcctggccaatttcttaaacttttgattatactaaatatggtccttctgcgtgataacactgtttttccttttataaaattaatctcttaaaatactttaaaattcaaagtacactttttagattctttaaaatactctttgccatattcatggcctttagatgtgtgatcatagcctatttgcttttcattgacttagtttcatatttctttgcctttttccccctacttttccttatagaactatttactagtaatgaaatcattttaaagaatacactttttattccacctgctaactgttaagagaatgttttataatcactctgttcatggtctgtaagtttcttttctaaactatcttttcaggatacatatttactaacttgctttcaaatgaatgtggtcatgtctatgcagcaagtttcttttctttcttcttttcttcttctcttttttctttttcttttctttcttttttaaggcaagatttcgctctgtagcccaggttgaagtgcagttgtacaaacatgactcactgtagcctcaacctctctggctcaagtgatctgcccacttcagcctcccaaccaagtagctgggactgcaggtgtgcaccaccctgctctgctaagttatttagttttttgtagacatggattctcagtgtgttgcccaggctggtcttgaactcctggactcaagccatcttcctgccttgacctcccaaagtgataagattacaggcttgagacattatgcccaacctctttttctttttctttctttcttttttttttttttttttttttttgagacagtcttgctcttgttgcccaggctggagtgcagtagtggcatgatcttggctcaccgcaacctccacttcccgggttcatgcgattctcctgcctcagcctcccgagtagctgggattacaggcatgcaccaccacacccagctgattttgtattttttagtagagacagggtttctccatgttggtcagcctggtcttgaactcccgacctcaggtgatctgcccgccttggcctcccaaagtgctgggattacaggtgtgagccaccattcctggccctctttttctttttaactgagcttatttatctcttccccagcttgagtctgggtcctactgtcttggtcagagtattttactatattgacctggacaattctgccatcatgaaccatattccaaacctaaatatgtaagaacatagaaagattattttagcaggagaattttaacacacacacacacactttattctgaaaatttagcaacaaaatgaaaggtgagttgtggtagttgatgtatcaacaaatagaaagaagaaagcctgtaatctgtttcagaatgctatttctggggctggtaacatcaaaaataatcaaattaagtgttaacttgctgactcgtaagattttctctaatttagaattggagaacatatatactcctattaccactttccatctttctcaaatatagtttttatagttttctgttggcttcatcatcgtattgaaagattattaatcacttacatatatgtagttttctgttaagtcctgttcagtatattacaaaattttgatctgtgtatgtaatatcaattaataagatggtgttagttaaatcagattacgtgttcattcattaagtcattgttaacacttcacagaatataaatcgtgttccatgagtatgaatttctctctgaattccacataattgtcttaaaattatgcaccatttatcgttaagagtgaaagattatgtgtcatttattgtagtggtagaagaaaataaaaccaaaacagaatccaatccaaaagcttaggtttttgttgctactacagtaattacatcttcatatactaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttagagaaattgttttcatgatatttcctatctccttttgtcactttgcttttgtcggtaaattttacaactaaatgaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaatcttaaaaagtgatttttaaaaagcatcagtgagcagtcaggcaacttcaaatggcctaataatatgcaggtaactggagttcccaaaggagaaaaaaaagaaagagaaaaaaatacttgaagaaacaactgctgaaaatgttctagccataagaagacctattaactcacggatccaagaaactcagcaaaccccaagcacaagaaacatgaagaaaattacactaagggataacataatcaaattgttcaaaatcaaggaaacattattaatagcaggtgtataaaaagacatgttacctatagaagaacaaagataagaacaacatcagatttcttttgagaaacaatgcaagtgagaagacagcggtacatctctaaagttctagaagaaaaaaggccaactagaattctatgcctggcaaaaatatctttcaaaaatgaaggtgaaataaagacacaccagaaacataaataatgaaataattcatcaccaggagaccttcactgcaagaaatgttaaaggatattcttcagaaacaaaatgatgtcagatgaaaatctggatcaatactaaggaataaagagcaccaaagtggtaactatatgagcaaacatcttttaaattttttattatttaaatctctaagagatacatgtttaataaaaaaacagcaaaatattacagagtttatgacatatgtaaaagtcaaatgcatggcagcaatagcacaaagtgcaggagggaggaaaagaaagtaaatgaaggaatgcttttattatagatgaagtgtacaatattacttgaaggtagacctctctaaatgtgcactataatcttaaaggaaccacaaaaataatttttaaaaataggtaaaagtaataaaaggaggcaaactggaatcataataaataatataagctgggcacggtggctcacgcctgtaatcccagcactttgggaggccgaggtaagcggatcacaaggtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgagccgagatagcgccactgcactccagcctggcaacagagcgagactctctctcaaaaaaaaaaataaataaagtaaaagaatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatggtggtgcacaactgtggtctccactattgggaggctgaggtacatcacttgagcctagcaggtcaaggctgcagtaaggtatgatcacaccactgcactctagcttgggtgacagagcaagaccccatcttggcaggtgggggatgcaagaaaaatgcaaggaacagatagagataaatagaaaacatataagaagacaatcatattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataatatataccatgcttacgctagtcaagagaaagctagagtagaaatactaatatcaggcaaagcatatttcagagttaaacacaacatttttccactatttgcagtcaaaagtatcgttaacactctctttactctgctcaaagttacagagttcttttgtataaacattagaacacttatcacagcctgcctataatggagaataattccatgttgtatactatacaacactcttactaaagtccattagacagaaatatgtagcatttaagacaccttccaattataaaactctatgcaaacaaaaattaacaacgcagatctgagactattatattatcctgtgaaggagggtctgtctgtctgcacagttggtcctaggctggcttctgaggacttgaatttcaagagggttccctaactggtaatcatggtttactgtatctagactatggaaataatgtggcttatcctgctattctttttgtgagtctggaaatttcacacatgctaggcagagtacacatatgtgaccagccaagataaaaactgtgtttcttgggaagtcacataggttgttgtattttcattaagggggaaagaaggtagtctgtgtgatcctcatggaaggcacagcacataaggaagccggtacatggatttttccagactctgtcagtgtcttttgccattgagatctttctactatatatccatactatgttacagtaataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagatcatcctagccaacatggcgaaaccccgtctctactaaaactacaaaaattagctgggcgtggtggcacacatctgtagtcccagctactcgggaggctgaggcaggagagtcgcttgaaccagggaggcagaggttgcagtaagccgagatcgcaccactgcactccagcctggtgacagagggaaacttcatctcaaaaaaaagaaaaaaactataaagggctgggtgcagtggctcacgcctataatactagcaccttggcaggcccgggtgggagaattgcttgggcccaggaattgagaccaacctggacaacagagcaagaccctgtctcttaaaaaaaaaaaaaaaaaagaaaagttggccgggtgtgatggatcacgcctgtagtcccaacactttgggaggccgaggtgggcaaatcacaaggtcaagagttcgagaccagccaggccaacatggtgaaaccccatctctatcaaaaaaagtacaaaaaattcactgggcatggtggtgggcacctgtaatcccagctacttggaaggttgaggcaggagaatcacttgaacccaggaggcagaggttgcagtgagctgagatcacgccactgcattccagcccggtgacagtgtgagactccatctcaaaaaaataaaaaagaaaagaaaagaaaagaaaagttagccaggtatggtggcatgcatttgtgatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggatacatactttaagaatttttaaaaatttacatggaaaaacaccaggattctatagaaaataaaacagtattaaataacattatttataaaatagatactagcaaattaccttacgtaaagattcaagtcagtaacttaaaggatcttacataaaagtactttccgttggttggaggagagatttttactatacactgtttttcaatttttttagacaaattacatttaaaagtttaaatttgcttatctacattcttaatgtgaattgccaccttactataggaaggctatttttgttcctgcagtctacaaaaagaacaaaaatattaaaaacgtacaactcttctcacagaactaagttggttttatacaaagacatctggcacaaaatacaatgatatttcaatatagaatcacagcaggggatgagggtggagaaggaagagattaccagttctaagaggggagacaacagaagtatttttttaatgtcttattttaagagtaaaacacctgctttttttttgagatggagttttaggcgggagtgcagtggaacgatctcggctcactgcaatctctgcctccaggattcaagtgattctcctgcctcagcctcttgagtagctgggattacaggcacacgtcaccacgccaagctaatttttgtatttttactagagagggggtttcaccacattggccaggctggtttcaaactcctgacctcagcgtcagcctcccaaagtgctaggattacaggcgtgagccaccatgcccagccaacactgaacattttgttcagaactagttaagaaaacagaaatatacgttgggggtttatggattacttatttttggggtgcaatactgggaatagaagagaaaggagcttcctttccctctccttctttcattcattcattcattttgagaagaagtcctgctctgttgcccaggatggagtgcagtggtgaaaactcagctcactgcaacctccacctcctgggttcaagcaattctcctgcctcagcctcccaagtagctgagattacaggcacgcaccaccacacacggttaatttttatatttttttagtagagacagggttttgccattttggctaggctggtctccaactcctgacctcaggtgatccacccgcctcagcctcccaaagtgctgggattacaggcatgagccaccgcacctggccaagaaaggagctttagataaataaaatgattaaacatttgtagcatgtagaatgaaactattcccttagtaatactcaaattatccagatttccaagatgttggtagcaccccgagagcttcaaaagggaaattaaaagaaaaacgacgttacccttcctgaaacacagattcactgtttgccatattcttttctctagtaaaagatgaataaagtttcctctggaaaaactaaaaacaatctgaggtatatttcagagaaaacaaaattgcttgataaaaatgccatgttaacaactgaggaaattattttacatatattaattttaacacaggaataatatgtcaaaccaggatttctcaacctcagcactatcgacattttaagctgtatagtttttggtgtgggaggctgtcctgtatattgtagaatgtttagtggcagccctggcctctacccaagaggccagtaggacccacctcctcattcaagctaatgcactaaatttttcccttcattgacaaatcccattaatgcatgtatttatcccattagtgactctcttgtgttccaggtactttgttaggcaccagagaaaatatgataaagcaaaacagctattttcctcactctcatggtgcttacagccatggtgggaaaaatccataggaaaagactcacatacacaaatgcaggcagaataaaaaaactcacacaaacaaacgttgcagatgttgttaagttacataaaggagatatgcatggctgtgcatggtggctcgtgcctgtaatcttagcacttggggaggccaaggcaggtggatcacttgaggccaggagctcaagaccagcctggccaacatggcgaaaccctgtctctactaaaaatacaaaaattagccaggcatggtggtccatgcctatgatctcagctacttgggagactgaggtgggaggatcacttgggcccaggaggcagagggtacagtga

SEQ ID NO: 37976 - DNA, 6289 bp, Homo sapiens; identical to SEQ ID NO: 37823

SEQ ID NO: 37977 - DNA, 44002 bp, Homo sapiens
gccagctggagcgttttcggggctgtaaagggagaatggcgcatgcgcatattcagggcggaaggcgcgctaagagcaggtacggagggggcgtggtgcggcgcggagggggtgtggtaagggcgtgcggtccagaccccgccccgggcgcccagttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaaggtagtatagagcactgttttctccagcccttgctactaatccatattactctccgctaatatctttccaaaattaggaactatggcgtttcataattcttaggttgggtccctacctacaaccagccctgcacccgatagccttttaaaacatttttgtgtgaaaatcgtttgcaatgtgcaatatctgaaactactgccttggagtcattagaccctctgctcagtgacaataaacataaaatttccaattgtaataaacagtggaacttttaattttttgaggatttggagtcattttaagcaaaaagaacagtgataagtggacagtaaagagatgagaggggagtgggtcatgggtagtgaaatgagtgagaagcactggaagtgaaacgatttctaaacccagacattttcaaactgtagtcctgggtcttttcaaaaggtcttcccctctttttctcaacccctcaaccccaccccaagcagaggagagtgaagtggttgcctccctgcatatgtggacggtgttagtccattttcatactgctataaagaaatacccaaaactgggtaatttataaagaaaaagaggtttaatggtctcacagttccaaatggctacggaggcctcacaatcatggcagaaggtgaaggaggagcaaaggcatgtcttacatggtggcaggcaagagagcgtgtgcaggggaactgccctttataaaaccatcagatctcatgagacttactatcattagaacagcatgggaaaaatcccctccccatgattcagttacttcccactgggtccctctcaccacatgtggggattatgggagctataattcaagatgagatttggatgaggacacagccaaactgttctgcccctggcccctcccaaatatcatatcctcacatttcaaaaccaatcatgccttcccaacagtcccccaaagtcttaactcatttcagcattaactcgaaagtccacagtccagagtttcatctgagacaaggcaagtcccttccgcctatgagcctgtaaaatcaaaagcaagctagtggctgggcgcagtggctcacacctgtaatcccagcactttgggaggccgaggcgggcggatcatgaggtcaagagatggagaccatcctggtcaacacggtgaaaccctatctctactaaaaatacaaaaaattaggcgggcatggtggcaggcgcctgtaatcccagctactcaggaggctgaggcaggagaatggtgtgaacccgggaggcagagcttgcagtgagctgagattgggccactgcactccagcctgggggacagatcgagactccgtctcaaaaaaaataataaaattaaatttaaaaataaataaataaaagcaagatagttacttcctagatacaatgggtgcacgggagtgaggtaaatatacccgttccaaatgggagaaattggtcaagacaaaggggctaaagcccccatgcaagttcaaaatctggcagggcagtcaaatattaaagctccaaaatgatctttggatcattttgacttcgtatctcacagccagatcatgctgatgcaagaggtgggctcccacagccttgggcagctctgcccttgtggttttacaggctacaaccccctctcccagctgctttcacaggctaatattgagtgtgtgcagcttttctaggcacatggtgcaagtggtcagtagatctaccattctggggtctggaggacggtggccctcttctcacagttccaccagcagtgccccaggagggactctgtatgggggctcccaccccacatttcccttccacactgccctagcagaggttctctatgagggctctacccctgcaacaagcttctgcctggacatccaggcatttccatacatcctctgaaatctaggcagaggttcccaaacctcaatttttgacttctgtgcacctgcaggctcaacaccatgtggaagctgccaaggcttcaggcttgcactgtctgaagccaggcctgagctgtacattggccctttttagccatggctggcatggctgggatgcaggacaccaagtccctaggctgcaaacagcagggggaccctggacctgacccatgaaaccatttttcctcctaggtttctgggcctgtgatgggagggcctgttgtgaaggtctctgacatgccctggagacattttccccattgtcttggtgattaatagttagcttcttattacctatgcaaatttctgctgccagcttgaatttctccctagaaaatgggtttttattttctactgcatcgtcagtctgcagatttttcaaatttgtatgctctgcttcctctggaacactttgccatttagaaatttcttctgccagataccctaaatcatctctctcaagttcaaagttccacagatctctaggacaggggcaaaatgccactagtctctttgcatagcaagagtgacctttactccaactctgaataagttcctcatctccatcagaaaccacttcagcctgaattttattgtccatatcactatcagcattttggtcaaagccattcaataagtctctaggaggttccaaactttcccacattttcctgtcttctgagccctccaagtctctaggaagttccagactttcccacattttcctatcttcttctgagccctccaaactgttccaacttctgccagttacccagttccaaagttatttccacagtttcggctgtctttacagtagtgccccactctctgcattaccaattttctgtgttagtcccttttcatactgctatgaagaaatactcaaaactgggtaatttataaagaaaaagaggtttaatagattcacagttccacatggctggagagacgtcacaatcatggtggaagatgaaggaggagcaaaggcacgtcttacatggcgacaggcaagagagtgtgtgcagggaaactcccatttataaaaccatcacagcttgagacttatttgctatcacaagaacagcatgggaaaaaccctccccaatgattcagttacctcccaccaggtaccgctcatgatatgtagggattatgggagctataattcaagatgagatttgagtggggacataaccaaaccatatcagggacccatctcagagggtgacttctttcaagtctcagagtgtatctaaaaagaaaatgcagattttgtattatactctagaatgtatccatattttaattttaaaatgacatttattgagatataataaagatacaattcaatgtccagattttaaatgttagatgagttttgacagttatatatatatatatctatgaaatcaccacccaaaataaaaatgacattttaaactgcttacctgtcaagtaaaattgacattccagaaagatgtgaaacgggctgggcacaatggctcatgcctgtaatcccagcactttgggaggccgaggtgggcagatcatctgaggtcaggagttcgaggccagcctggccaatgtggtgaaaccccatctctgctaaaatacaaaaattatccaggtgtggtggcacatgcctgtaatcccagctattcgggagactgaggtgggagaatcgtgtgagccagggaggtagatgttgcagtaaaccaagattgcaccactgtactctagcctgggtgacagagcgagaccctgtctcaaaaaaaaaaaaaaaaaaaaaaaagatgtgaaatcatctttgcactttgagtagtccttgacacaatgcctcctgtccttgttgaagaagtacagacttccccttccatcatgtattatttatatcagtaccttttgtgacagtctctgcccctgttgcattagagtcacttggaaagctttttccaaatagttacttgggccctaccccagatctcctgaatcagcatcttaggacaagtcaggcacctgtattttttaaaagctgctacctgattttgctttgcagcccagagttgagaaccctagctctgttttcatgccagaagcatgagttactaattaaacatatgattgcctgtcaccaaagtaatactgttgattaatttggattgacaggttcaagactgatttgacattgacagaacaagctgtatcgatggtagtcagttcactgggcctacttctgtgtcaaaagaaacagtgacagaaccactcagtatgaagtgcaatgaaaactgaactctgaattggaacaaataactggaattcagttaactggttttgcaaaaggataaatactcaactggttgttttctgccatttaacaaagagaaaaatcattgggattgtttaaacttgctttcacctttgcacctttcagttcaggatgcagtgttcaattgttaacttgggcttgatgattcagcagaaagaaatgatttgagttctggctcactggattaacagggccaaggagcaagtcctttgcaatccaattgtaattacagccagcttgtccaacccttggcccaggatggctttgaatgcggcccaacacaaattcataaactttcttaaaacattatgagatttatgcaccgacccttttttttgttgttgtttttggtttttttttttttttttagctcatcagctatcatttgtgttagtgtattttatgtatggcccaagacaattcttctttttccagtgtggcccagggaagccaaaagattggatacccctgacaggattccaggattcttttgtaatttctcagaggccctctgtgcatactccgtaaggactatccacattctttattactttcattggcaataggtataaaattttatttgttggatattttactgaaatgttacttgtttttgcttatttactgattggtgggaggaagtcaaaggatgaataaatctaacctttttaaaagaaaaggctaaaatactcataacatgctctccaaagagcagagctagtcatcaaagaatctgcataccaattactctatttgtaggttctggatttgagattatgaaaaagagcaaattggtggttttcttctctctgggccagggagatatccaggcaaccaggtaatttagtaagaattgcaaatatagtgcctggagacaatttattctctaaagactgcagcttctacaggcagtaactcttaaagcccccaaattgggatagtgcattttaatttccgtatactaacaaggacactaaaaatccttgtgattattttaaagcataacactagctgaacttgtgattaagtattctcacaaatgtattatcaaaatgtgaaatgtttacttatcaaatgaggaaatgaatcaaggtcatttgtgatacattatagaagctaaaaatgaaattgcctgacataagataaaactgatactgaatatcttaaaaataaaaaggcggaaacaacaaaaaaaggagtctatgtagaacactattttttatagcaatgcaaaaactgtacagccggaaatgtgttgtaggaaatatgtcaacataggaagtaaaataatgtaatgaaaaggttctttgaataaagtgggttaaattgattttctttgcttctcattaaatctgtggacttcagagtaccaaagctcagcaacaggcttgaaacaaacccagtgaaaagcaactttattattgagctgaggattgatatcagtaataactcattaataaaaaagcttgataataaaaactcccagtgcctgatgccagctgacagacactgggagttttcccaggtaccctgtgacctagagaaagcttggattcctgcctttggcttgggctggcaagccctgtgcctttactctacattttaatgccagggagacctggaactggagaagggagtgctgtgggaagaaaacagaaggaatgttgttcccttgttttagctttgtgttcatccattatgggttttgggtttttttgttttttgtgtttttttaagaacatttgagatagtttgacagcagcagtcattacatcactgacgaggacgtttacttgtgtaaaatgcaccaggaaatagtgacaactgtatgttgtgctatgaggatgtaagagatttatctcaaatggcttagaaatcaaaatataggtcagtgcggtggctcacacctgtaatcccaacactttgggaggccaaggcaggcggatcacgaggtcagtagattgacaccatcctggccaacatggtgaaaccccgtctctactaaaaatacaaaaattagctgggcatggtgatgtgcgcctgtaatcccagctaccggggaggctgaggcaggagaaccacttgaacccaggagttggaggttgcagtgagccgagattgcgcccctgcactccagcctggcgacagagcgagactccgtctcaaaaaaaaaaaaaaaaagaaatcatagtatttctccgtatgatggaattccatactcgggggagtgtcccacagggtaggcaagcagctatcacccatgtaatatggtactagtgttgaaatattttctgttttcacttgcttcttctgccattagcattcattacagccctttcctttaactttttaatttgtactttattgctttgttttgataataatctattctccatgtcagcaaaacaaagatttatctctagggaagaatctctgagtgattcccagggtttgggggttgaactggggacatcttcatgatgaacttaagcccttaaacttctttttacatcataacgtttgagttcttctttggagcttagctgtgatttattcttttcacttcaaaaaaaatacatttaacatttatgacatctttcagacacatgaataggatcagagattaatatacacccatgtacccagcccctggcttaagaaatacatcacaaatataatgaaacccccgtgtgtcctttccccattacacctcctttcctgtcctacagaggtaaccactatcttgaatttggtgtttgtagttcccacattatccattctttagatgatcgatatttggtcatttttagtttttttggaaacagtgtgctctgaaattcttgcatgtttccttcttgtgcacatgtgtgagagtttctacatatatatcaaggtggaggtcatcatcatttgatctccaaagtattgtaccaatttatactcccaacatttgtgtatgagagctaccctttctccatagtctcaactgtggagctttaaaaatttttaaatgtgaaatggcttctcagttccatttctctgactacaaatgaggttaagttatatttgtatatatatattggccatgcgtgtttctttttctgtgaattacgtgtttacatctgttgcacatttccttattggattatcttttgctttttgatttgtagatgtcctttatgtattctgaatgctaattatttgtcttttaactttgttaatagtgattttagaggtataaagggtttttttatagtcacatttgacaactggtcttccttattttttttttaatttttttatttttttggtaacttgctaaagaaaactttttgtaacctgaggttatgaagatttttttctatatcaaaaagtgtaaagttttatttttcatatttaagtcactacctggaattgatttttgtttgttgagaagtaagaatccatataatatgtcaattagatttgctgtgtaattaaccaccccaaaacttagtggcttaaaagaaccaccatttatttaacatatattcctatgaggctggtctcaactgggctcacccatgtatctgttagtcagttgccagtgaactgagtcactcagcccctggaggttagctggttgtccactgggatagcgggcatattgccagtgagccacatagctctaccactcagcaggctagctggacttcttcattggatggcagcaggttgcaaaagggaatgagcctcattgtgcaagcctctatgtgcggtgtttgctaacatctcattagccaaagcaagttatgtggctgggctcagactctaagttaaaggcattcgagttacatgataatggaacatggatacagagaggggagaaattgctggccttttttatagtcaatttaccataacatccagttgtccaagcaccattcataatatagttcattctcatcccagtgatacataatttcccctctgtggaatgtcaagctcgcatatttatgggagtatttctgtactctctgttcttttcctatcctaacaccaatcccacactatcttaatttctgtgtttttaaaataagtcttgatgttggtaggacaagtagtccctggacttcattcttttgaagccatcttgtttattatattaattttaagcaactagaggggatggaagaggaacctttagattaaaagagatttaaaagatagggtattttttaatggacaagactaaactacagtgtctagggatgcacattgggtgataaagctattttaaaaaacaaagaagtgatgagtataaaagtcagggtcatggttacttgatccctcatgggtaatgttgtcagatttagaaaaaaaaaaaaaaacaggactccaaaactcccagttgaatttgaactttagatgaacaatgcataattttttttagcgtaagtatgttccaacatatttatctgaaagttaaatttaactgggccacctgtattttacctggaaaaatcctgattttattcaaggtgataatgcagtttacattgcccagccttccttgtagctaggagtggtcacgcgtccacacatgggccaaagcaatttaaataggagtcactgggcagggcttttaggaaagctgatgaaactggcaagtaccctctgtactcttcctctgtacaacatgataattggagttgtagaagtcattttggaaccacaagatgactctgaaaatggaagctacatgccaagaagttaggcccagaaagagagggatcctgggtcctacatgactcttgcctttgtcaggttttattatcagatttttatcacttcataagaaaaaaatgccttcttttactatattctcacacacattgagtagcattaggattattttttcctttatagttagaaagaattcttctagaaactatttgggcctgttttgagggtggagaatgggagggaatgattgtttgataactatttcttctatgattgttggcatggtttagttttttcttttatccgaagttttggtaaaaatatatttttcagtcccagctactctggaggctgaggcacaaggattgcttgaatccaggaggcagaggttgcaatgagctgagattgcaccactgcactccaacctgggtgatggcgtgagacagtctcaaaaaaaaaaaagaaaaaacaaataatgtattttttttctaggaaactactcgtctaaattttctagcttatcaatataggattgaatgaggtgattattcttttttaaaaaaaattcttctgcatttatagatttctctttgttttgtatatttgtttctcttttttttcttaattaggctagccgatcatttgtctttacctttttttttctctaaacaacaactccttggacatacttattcattctgtcatttttctgttttctaatttaatttccactcttatttttatttccttccttttgctttcttgagcatgccattactcttttcctcactgttaccaccttttgttagttttacaatttctacattgccagagttaataacatttgcactgtgttctataaatataatcctcatgtttattttacattcaaggctcttgccagtttttccattcacctcttaattggccgaagattaccctctatgcattttttcaaagaaggctgatgagactgatgagaataatagtccctgagttcttatattttcatacctattatctggtttttttctttacttcaaccataggttggcataatatataatttctggcttatattttattttctggaaggattctataggcttttactggcattgatgttattgtagtaaagtctgaggacagcctgattattttgcccctaataaatacccttgatctttttatttagcttcccaaatgattcttactttatctttgaagatcaagaattttgctaggctatctgccgatgttgatgttctgttcctttctttcttgagttttgctatctcttttcaagctataaattgaaatatgcttttatttctggtgagttttcttcaattacatctttaattttttttttttttgcttcattatatgttgtctattgttgtataaaaatttaccctacgacctattcagcagcttaaaacaagacccatttattatctcaaagtctctatgtgtcaggagtctgagcatagttttactggatcctctggtcagcatctcacaaggctacagtgaagttgtcagctgacctcatggtctcatctgaggctgagttttcttccaaattcaactgatcgttgaaagaatgaatttccttgcagttgtagtattcatggtggcttgcttcttcaaggtcagccggggagagagtgtgtctgaaatcttggagcaccccagttctttttttaaagacctgattaattcagacccaccagggtaatctcttttgattaactagattaactggcttgggattttaactacatatgtgaaagcccttcacctttgtcatattctattggctagtaacagagtacaatttccacctgcactcaagaaaagaggattatacaaggagtcaccttagggtgtgtccaccacacattatttttttcttttatgcattttccaattatgcatatgatggatctcgttcactgttctccctgtctatcattttctgtggactccttttcaattctgtatttccattcatgttgcttatttatttacagcatcatctgatttcttttgctgcttctatctttgccataatttcttgatgttttaattttttcttctgcttctttcctgagccctgccagataatatttcatctgtctcccagctttctattccccactcccttctcccttctctcttcttccctcttccccctccttaccttctcctcttctcctcctttcctccccttctcccctttttccctttcatcttttaattctcttggtctattttgtgcttttatttaatataagcagttttttttcactcgtggcagaatgttttgtcacagtttttatttgtgttgtggcaattttctggggtataacctttgttttcgtatagtatctttcaaaagatcttgagctttttatttactcatttttgagtgagtttttcctctactgtaggaggtttatgtgtgaacaaggccattctggttcacagttattttttcttagcacatttaagattttgttttcttacttctattgttactcttgaaaagtctgctgttttcaaatcaccatatctttgaaggcaatctctcttccctctggttgcgtctaagatttttttcttcttcaaatatttcgtgttctggtttctttatgttgtgtatagatttctttttggttgtcttgaatctatggatttctgtattttattattaaaattctcacctattataccttcaaacatgtgtaatgtgtcatgtgtcattttatgtattttctccctctttctttctttcttttttttttttttttaagtcaaggtcttgctctgtcgcccaagctggagtacagtggcacagccgtagcccactgcagccttaaactcctgggctcaagcaatcctaccacctcagcctcttgagatgctgggaccgcaggtgtacaccaccatgcccagctaatacttttttactttttgtagagattatattgcccaggctggtcttgaattcctggcctcaagtgatcctctcatcttgacctccaaagtgttgggattacaggcatgagccattgcacccagcctctattttctccttctgaaattccaattagaaatatcatggaacatcatatatgtcttccatgtctcatcttctttttttcccttttgtcatctctgtggtacattctaaacaaattttttaatgattctaacggccatgccacaaaatgtctccatttggttttatttgacaatatctttttctttttttttttttttttgacacagagtctctctctattacccaggctagagtgtagtggtgtgatcttagctcactgccacctccgcctctgagctcaagcaatcgccctaccttagccacccaagtagctgggactacaggcatgcaccaccacacacagctaatttttgtattttttgtagagatggggttttgccatgttgcccatgctggcctccaactcctgggctcaagttatcttcctgccttggccttccaaagtgctgggattacaggcatgagccaccactcccagccaacaatatcttattcttttacctgttttagagtcctctgagtacttctttaatcaacttcagtgtacttatttgaaaattttcactagtaatccttccatctgaagttgttgggggcctgattttgctgtattctttaactttcttgcataatatttgcttccttgtgtgttttgtaattttgaattttgagctcttgtttaccttgttcttcaacccaggacactcagtcttcaagaagagagtatgtggataggcttttccaggcatcttaggactgataacatctcaaaatcactttgtgctcatttcttggcatagagttacctgggtcatgtatgttgtgagtttttgaatcatgaacccacataaggaaaacctttgattatgttggttatgactttcaaggagtactattttcccctgctcagagcccaagatgagatgtacaagtttctacgtcagatagttactttggcaggcaggcagatatttgtttttgtccatcctttcaataaaggaatcattccttaaggttcctagctatatgcacagatctcactccaacctccacatcttgtctttctgtccttcatggtctttaaaatctaaaccccttggatatcaagattgggacatgttccagtatcacctcaccactccagttttcagttacttgattttagtttttattttttaaatgctttttttaaaagagaagttttatgctcacaataaaattgagcagaaagtacagaaagtttacatatactccctgtcctgatacatgcatagccttccctgttatcaatatcccagactagaatggtatgtttgttataatcagtgaacctgcattgacacattattataacatgaagtccatagtttacattaggattcacttctttctcccttaacacttggcaaccactgatcattttaccatctctgcaattttgctttttccaccactggaaatgttacatattggaatcatacagtatgtagcctttacagattggtttctttcctttagtaatatacatctaaggttcctccatatcttttcatggcttgatagctcatttctttttagcactgaataatattccattgtctgaatgtatcacactttattaatccattcacctactgaagaatatcttgattgcttccaagttttggtaactatgaaaaaaactgctataaacactcctgtgcagtttttttggagacataagttttctactcctttgggtaaatacaaagaatacgattgctgaatcatatgataagagtatgcttcattttgtaagaaaatgccaagctgtcttccaaagtggttggatcattttgtgttcccatcagcaatgaatcagacttcctgttgctctatattctcaacagcatttggtctttttaaaaattgttttgggccgggcgcggtggctcacacctgtaatcccggcaattttgggaggccgaggtgggtggatcacctgaggtcaggagtttgagacaagcctgaccaaaatagagaaaccctgtctctactaaaaatacaaaaattagccggtcgtggtggcaggcgcctgtaatcccagctactcgggtggctgaggcaggagaatttcttgaacctgggaggtggaggttgcagtgagccaagatcgcaccattgtactccagcataggggacaagagcgagacttcatcttcaaaaaaaaaaagttttgtttttttcctttcaccaaactaagcatttagtcttgtcagtgttttggattttgactattctaataggtgcatagtggtatctaatttttaatttgcaattcccttgtgacatatgatgctgaacatcttttcataagtttattgctatttgtgtatcttccttggtgagatgtctgttcagatcttttgcttattttattttatttatgtatttttttttcgagtctcactctgtcacccaggctggagtgcagtggtgcaatctcggctcactgcaacctccgcctcctgggttaaagcaattctcctgcctcagcctcccgagtagctgggactacaggcacgagccaccacacccagctaattttttgtatttttagtagagacgggggtttcactatgttggctaggatggtcttaacctcttgacctcgtgatctgcctgccttggcctcccaaagtgctgggattataggcatgagccaccatgcccggccttttgcctattttttaatcaagttgtttactttcttattgttgagttttaacagttctttgatattttggataacattcctttatctgataaatcttttgcaaatattttctctcagtctgtagcttatcttcttctgttcttgatagtttcatttgcagatcaaaagttttacatttagtgaagtgcagtgtatcaattctttcttttttgtccaacacaagatcatctagctattctcctatgttatcttttaagagttttatagttttgtactttatatttagatctatgatctgttttgagttacttcttgtgaagggtataagatctttatctagatttgttttttacatgtgggtgtccatttgttccagcaccatttgttgaaaagactgtctttgctccatcacattgcctttgctcctttgtcaaagatgagttaactatagcctggtgtgcagtggtacacacttgtagtcccagctgctcagtagagttcaatagttttctttaggaggctgaggtagaagaattgcttgagcctaggaatttgagtccagcctaggcaacatagcgagacctcatttgtaaaataaataaataaataagaccagttgactgtatttatgtgggtctatttctggattctctattctgttccatctatttgtctgttctttggccaattgataaaatatcatgttgtcttgattactacagttttataatgtcttgaagttggtagtgtgagttttctgacttcattcttcttcaatattgtattggccattcttggtcttttacctctccatgtacaatttatttttatgtatttatctagagacaggtctcgctctgtcatccaggctggaatgcagtggcgtgatcatagctcactataaccttgaactcctgggatcaagtgatcttcccacttccatctgctgaatagccaggactataggcacacaccgccttgcccagctaacttaattttatttttaattttgtagagaatggggtctctctattttgcccaggctggtggtctcaaactcctggcctcaaatgatcctcctgccttggcctcttaaagtgctgagcttacaggcataagccactgctccatatgcagtttagaatcagtttgttgatacctacaaaataacttgttgggatttcagttgggattgtgttgaatctatagatcaagttgttcgcaagaactgacatcttaacgatattgagtctctgcatttatttagtgctgctttgatttctttcaacagagttttgtagttttttcatgcagaccttaaacatttttaaaagatttatacctaaatatttcatatgtagggtacgaatataaatagtattatggtttttaaaatttttttcttttttatttttttgagtctcactctgtcacccaggctagagtgcagtggtgcgatctcggctcactgcaagctccacctcccgggttcacgccattctcctgcctcagcctcccgagtagctgggactacagacgcctgccaccacacctggctaatgttttgtatttttcatagagatggggtttcaccatgttagccaggatggtctcaatctcctgacctcgtgatccacctgcctcagcctcccaaagtgctgggattacaggcgtgagccactgtgcccagccaatagtattatgttttaaatttaaaagtccactgttttttgctgatatatgagaaataaattgatgtttgcatatgaaccttgtatcctacaacattggtataataacttattagttccagatattttttattaattcattccaattttctacatcgatgacaatttcatctgtgaacaaaggcggttttatttcttctttcccagtttgtgtatcttttctttgctttttgcattagctaggacttacggtatgatgttgaaaagcagtggtgagaagggacatcattaccttgctcccgatctttgtataaagtctctagtttctcaccactaactgtgatgttagctgtaggtggttttttaaatcaagttgagcaagttcccctctattcgtagtttactgagagttattatcattccaaatgggtattgtacttcgtcaaatacatctatttgacatctatttttctgtgtctattgatataatcatgtgatttttcttttctttttttgagacagggtatcactctgtcacaccagctggagtgcagtggtacaaacacagctcactgcagcctccacctcctaggccatgtgatctttcttatttagcctgttaatgtgatagattacataaattgattttcaaatattgaaccaacctttcatacctgagataaatctcacttagtcatggtgtataatttcttctatggattgttagattcaatttgctaatatttgttggtgtaaaagtcattgtggtttttgccattgaaagtaatggcaaatgacttttgcaccaacctaaggattttgctaaggattattgcatctatatttatgagagatattgctctgtagttgtattagtctgaattctctagggagatactgggagaacccacccccaatatttcaacgtaagttctattttccataagtgtcagctggctgagaaataaagagagacagtacaaagagaggaattttacagctgggccgccaggggtgacatcacatatcagcaggaccatgatgcctgcctgagtctcagaccagcaagtttttattaagggtttcaaaaggggagggagtgtaagaacagagagtagatacaaagatcacatgcttcaaagggcaaaaagcagaaccactgataagggtctaacaaagatcacatgcttctgagggaacagggcaaagggcaaaagcagaaccactgataagggtccaacaaagatcacagggcaaagggcaaaagcagaaccactgataatggtctatgttcagcggtgcacatattgtcttgataaacatcttaaacaacagaaaacagggttcaagagcagagaaccagtctgaccacggatttaccagggctgagttttcccaaccctagcaagcctgagggttctgcaggagactaggacttatctcaatccttacctcaactgcacaagacagacattcccagaacggccgtttatagacctccccccaggagcgcattcctttcccagggtattaatattaatattccttgctaggaaaagaatttagcgatatgtttcctacttgcacatccatttataggctctctgcaagaagaaaaatgtggctcttttagcccaaccccacaggcagtcagaccttatggttgtcttcccttgttccataaaaatcgctattattctgttctttttcaaggtgcactgatttcatatttttcaactacacatgttttacaatcaatttgtacagttagcacaattatcacagtggtcctgaggtgacatacatcttcagcctacgaagataacaggattaagagattaaagacaggcataagaaattataaaagtgttatttgagaactgataaatgtccatattaagatgaaatcttcacaatttatgttcctctgccgcagctccagctggtccctccattcagggtccctgacttcccataacagggagacagtgccaatgggatatatatagagagatatacgaaagagatttattagaggaattggctcacacaattatggaggctgaaaagtccaataacaggccatctgcaagctggagaccctggaatgtcaatggcataactcagtccaaggccgaaggcctgagaacccagggggctgctggtgcaagtcctggagtccacaggccagggagttctaacacgcaagggcaggagaggaagggtatatcccagctcctgcagataaatcaacacacttgctttttctgttttcgttctctcttgtctcttggcttattagatggtgcctgcccacattgtgagggtggctcatctttacctagtgcacttagactcacacactcatctcctcatgctgatcacaagcacatccaaaagtaacattttaccaggtttctacagtgttccttaatccattcaagttgacacctaaaattaatcctcacagtagttttcttttcttgtaatgtctttgtctgtttcagtattggggtaatgctgccctcatggaatgagttaagaagtattccctctgtttctgtcttctggaagacatagtagagaattggtataatttatttctgaatgtttggtagaattcaccaatgaacccacctggactgggtgatctctgttttaaaatattttgaattattgattcaatttctctaatacatataggcctcttcagattgtctgtttttcttgtgtgagttttagtaaattctgtcttttaagaaattggttatcattttcttttttttttcctttgagatggagtttcgctcttgttgcccaggctggagtgcaatggtgcgatcttggctcactgcaacctctgcctccctggttcaagcaattctcctgcctcagcctcctgagtagctggaattacaggtgcccaccaccacgcctggctaatttttgtatttttagtagagatggggtttcaccatgttggccaggctggtctcaaactcctgacctcaggtgatccacctgtctcagcctcccaaagtgctgggattacaggcgtgagtcactgtgcccggacatcagtttcttaaattgacatctaggttatcaaattttggggcataaagttgtttataatattcctttattattctttcggtgtccatgggatctgtagttatgtgccctctttcattgctcatgtcagtaatatgtgtcttctctatttttttttcttagcctggctagaggcttattgatttttcttgatcttttcaaagaaccagaatttagtttcatttttctctattgatctcctgctttacatttcattgatttctattctagtgtttattatttctgtcattcttcttactttggaattaagttgctcttctttttctagtttcttgaagtaaaactttagactactgatcttatatcttaattcttttgtacatttctcttgagatttcttttctgacccatttgttatttaaaactgtgcagttttatttccaagtattttgggtatttcttgctaaatttatgttattgatttttagtttaattctactgtggtctgagagcagatattgtattatttctactcttttaaatctgttaagttgtgttttatggctcacagtgtgttttgtcatggtaaatgttccatgtgagcttgagaagagtctgtactttgctgttattagatgaagtagtctatagatgtcccttgtatacagttgattgatggtgctactgaattcaactatgtccttactgattttctgcattctggattttatccattactgatagaggggtgttgaagtttacagttataatagtggatacatctgtttctctttgcagttctgtccatttttgcctcatgtattttgatgttccattgttggcacaatgcacattaaggatttttatttcttgttgaattaacccctttatcattttgtgacccactttttaatcctgataactttccttggtctaaagtcagctctgtctgaaatttatgtagctattcttgctttctcttaatgactatgttagtctgttttcatgctgttaataaagacatacctgagactgggtaatttataaaggaaagaggtttaatggactcacagttccacatggctggggaggcttcacaatcatggcagaaggcaaatgaggagcaaaggcatgtcttacatggtagcagacaagagtttgtgcagaggagcttccatttataaaaccatcagatttcatgagacttattcactaccatgagaacagtatgtgggaaaccactcccatgattcaattatctccacctggctccacctttgatacatggggattactacaattcaaggtgaaatttgggtggagacacagccaaaccatatcagttactattaggatggtatgtccatccatttactacacaatctacatgtgtctttataaagtgggtttcttgtagacaacatatagttgagtcatgttttttatctactgtaatgatctcttgtttcgaattgatatatttataccattgacttttaaagtgattattgatatagttggattattatctatcatatttgttacttttttctacttgctgcctttgttcgtagttcctgtttttgtcttccagtctttttctgagttttggtgttttaattgaacattttatgtgattttgtcacatgattttgtctgaaagtatcttatttctctgcttttgaaggttaattttgtaggatgtttatatggtttggctctgtgttcccacccaaatctcatgttgagttgtgtggcctggtgggaggtgattggatcatgtggatggtttctaacagtttagcaccatccctctagtgttgtgtcatgatagagttctcatgagatctggttgtttaaaagcgtgtagcacttcccacttagctctctccatcttctgccaccatgtgaagatgtgcttgcttcccctttgcccttctgccgtgattctaagtttcctgaggcttcccagccatgcttcttgtacagcctgtggaactgtgagtcagttaaaccccttttcttcataaattacccagcttcaggtagttctttatagcagtgtgagaatggactaatacagacgcacaatgctaggctggtacttttttcctctcaacactttaaatatttcacatcactgtcttattgtttacatgatttctgagaagtcagatatctttcttatctttgctcctctatagataagatgttttttccctctggcttctttcaggattttttctttatctttgcttttctgtaatttgaatatgatttgcctacatgtagatttttttattttttattttcgtttttggcagttaacctgattggtgttctctgagcttcctgggtctgtggtttagtgtctgatattaatctggggaaattctcagtcattattgcctcagatattgcttctattctttctccttctggtattcccattgtacatatttataacttttgtagtccactgtttgttgatttttttctttttttcagtcttttttctctttgcttttcagttttgggcatttctattgtcatattctcaagctcagggattccttcctcagccatgtccaatctactaatgaatccattaaagtgattcttcatttctgttagtgttttttaatctcaggcatttctttttttattctttcttagaatttccatctccctgcttagattacccatctgttcttgcatgttggctgttgttttttttttcagtagagcctgtggcatattcatcatatttattttaaattgctagtctgataattacaacatccctgccatatctgactctggttcttctgggaggttttttgagacaaagtctccctctgtcacctccctctgtcactgctggagtgcagtggtgtgataacagctcactgcaacctccgcctcctgggttccagcatttctcgtgcctcagcctcccaagtagctgggactataggcgtgtgccaccaagcctggccaatttttgtatttttagtaaagacagggttttgccatgttggccaggctggtcttgaactcctggccttaagctccttagcctccctaagtgctgggattacagccatgagccaccgcacctggcctaactctggttctgatgcctgctctgttttcaaactcaattttttaccttttagtataccttgtaattttttgttggaagttggactcgatgtactaagtaaaggaacagcagtaaaaaggcatttaattgaaatgtggtgggagggaatgtgttctattgtctttagggatctttagggagcctgtgtttatggactgtgaactttacaagtgcttctcagcccccaaccccactcaggcgggacagaatggggctagagttgggtatttcccttcccccaggtcagttaagctttgataaaaccccaataggtaaaaatagtttctctggaggagaggcctgctaaagaccagaatgctttgtttcctttccctcttcctctggcagaagcatgggaggatttttttctccagtcttcattgtgagaacctggtagaactcctagaggtaaaacctacaaaagtgcgggtgcctccatctaagactgggtccctctggagttgttttttgtttgtttgtttgttttgttttgttttttctgtttgttttgagacggagtctcactctcatgccaggctggagtgcagtggtgcgatctcggctcactgcaatctccacctcccgggttcaagcaattctcctgtctcggcctcccaagtagctgggactacaggcacccgccccctcgcccagctaattttttgtatttttagtagagatggggtttcaccgtgttagccaggatggtctcgatctcttgacctcgtgatctgcctgcctcggcctcccaaagtgctgggattacaggcgtgagccaccacgcctggcccagttttaattttttattttgcatataagttcaaagccttccaaagtgtttgtttatgatttattttcttgttaaaatctgttcttgttcattgcctgtttataagtgttgtcttgatgtttattttttgcatgtacattttaatttgtcaatctgtttcttcttttatttcaactgttccaaattttagaaagttgtttcaagtatctgatacctaattctaatttatgctagcttttctaacatttgatattcaacttctgattttgagtttatttttgtgtatggcctaagatgctattattcctgttgttattcatccatcccagtatcatattcaatcaacctcccccaccaccaccactattttgagtgtggttgcattaaaaagcatgtgggcttttggtcagaatagatttgggtgaaatcctggctatgggtagcagtctccttctactttaagagtaacttcttcacaaaaggagctagatgatcctctgctttgcctctaatgctgaggaatgttgcacctacaactatcatggaagacgctgaaacctccattacccaatcctgtactcccagcaccctcagggagccccacctctggaggactcagacactcatgccaggtaaagctgtaggacagaggccaggcatggtggctcacagctgtaatcccagcactttaggtgagaggattgcttcaggcctggagtcgagactagcctgagtcacatagcaagaccccatctctacaaaaaattaaaaaattagtcacacatggtagcatgcacctgtagtcccagctacttgagaggctgttggggagggatcacttgagcctaggagtttgaggctgctgtgagctatgtatgatcatgccactgtactccagcctgggcaacagagcaagaccctgtctcaaaaaaaaaaaaaaagaaaagaaaagaaaaagaagctataggacataggggagctagtcatatgtctgtcctactgagactctagatggcacaaggcaatggcacttgtgttagaaccagaatgcagctatggctgacttggaaccgtctgtcagaggaaaaaaggcatgcaaatagttactcatttgaccaaagcagaagaaaaccaaaatgtccaatgcctccaggaagaaaggcaaagatagagatactaatcatttctctacacatctgccatgccatgggtgaagaagacagccaagttggtgaacagatctggaaaggttaccatcattcttgattgagctctgccctccaaccgaacacccctgagcagccacggcatgccggctcaccgtgcttcccaccacgcatggatcaagagcacctccacaggttctcagaagctacggcaccaggacccatttgcctgctttttgctgttcctcttaagacagggtcctgcaatcacagctcaccgcaacccctgcctcccaggctcaagtgatgctcccatctcatccttccgagtagctaggactacaagtgcatgccaccatgcccagctaattaaaaaaatttttttttggtagagacagtgtttctccatgttgcccaggctagtttcaacctcctgggctcaagcaatcctcctgcctcaccctcccaaagtgttgggattacaggcattagttactgtgcctggcctctcttggtaattttgactatgccactcctaaatatatgcctcttggcctctgcatgagagaaggtggcctttgatgtgttatttccagcactgtggtttactttagctttttaaattgtttctttcataatttctactatcatccagcgtcagtgtttctagcctatcctattaagggttattcttttgttttgttttgttttgttttttgagatggagtttcgctcttattgcccaggctggagtgcaatggcacgatctcggctcactgcaatctctgcctccgaggttcaagctattctcttgcttcagcctcccaagtagctgggattacagtgcctgccaccacgcctggctaattttttgtgcttttagtagagttggggtttcaccatgttggctaggctggtcttgaactcctgacctcaggtgatctacccaccttggcctcccaaagtgctgggattacaggcatgagccaccatgcccagccccaagggttattcttttgatttggggaacagggttccttggccctattacccaccacattgttctccactctttgcatcctgagcatctccatctgcatttttcactcctgagtactggcagagatgagcacaagggtaatgggacttgatgtagtgacattgtatccaccacatgcttagagaggttacatccaccacaagcttagagattctgtatccaccacaggcttagagaggttgtatccatcatacagttatgttgcatccaccatacatctagagatgttgtgtgcactatacaatcagcaatattgtgtccatcatacatttaataatcacaaagccattacatggcccacatttctgagcacatcttccctgaaaattttgacacgtagttctaggacatcacattttccatgcactggttctttttcttctggatgtcaagccctcaggtccacattatctagaaggtgttctttaaggtagtccaagaaggaaatgggtaagaaatttcccaaaggcttttaaaagcaataccttgctgacactcattgaaactcatttcagagaatttgacgatggtttttggaagccataagcattccagaagaacagagtagctagaagtgcccccaccattcatgtgtcccaggactgactgacagtggaaaagctttatgtgtgtgtattttccttgctgcctggtcaaggtctccaatcaatagtttaagactttttcacagttcattttcgaccaccgaagatttcctttaactttcctgcaaactcaaatatgcatttaaaaataatctgtttcatttttgcaggatatggttgaaacatttttcagattatctagtctaccatattgccccccacctttttttaaatcaggaattttatttaagtaaaaaccaataacaacctggttcttcaatggtattcctgccatagctaagacaagcactgagtcctttaactgacctgcatcaaattgtttaggggagatttttccttctagtttgagtgtttaatgctttctttgctgcttattttcattaaatatggtagaaatactttgaaatctgcccagattccatcagccctattggagaggcacctgagaaatgaagatgatgtttctgactcataactttctttgacataagggaacaataggagtcagaatataggatatacattcctctatcttctactcaattggttctccaagtgtgactcagaccaggagcatcagcatcaccttggaatttgccataaaatgcagattctcagaccctattccatacctactcaatcaaaacttccaggcatgggctccagagatctgtgtgttcaagccttcaggtgactctgatggcgtgcttacatttgagaccctctgctctggtctgatcacccagaatctcccttgggagagctaccttgaaatttctgcttatttcccctgcagcgtattgaagactccacggtggttgttttgttttgttttgagatggaatctcactctgtcacccaggctggagtgcaatggtgcgatttgggctcactgcaacctccgccgcccgagttcaagcgattctcctgcctcagcctcccggagtagctgggattacagacacgtgccaccatgcccggcaaactttttgtatttttagtacagacagggtttcacctccgcagtggtcattaaagcttgaccactaaattgccctggttcttcaacatgcactaggcaggctggaccagaagccaggagacctggctcccagtctcattatcattactaaccagtcctggagttttccctcaccatgaagatggaatttttaccatctgctttctctgctttgtgtggcaggaagataaaaaaataataataatggatattcaaacggtttatattgcatgtaaaatgcaatgtggcattgattgtagatcccttaattcagacagatttccccacgcagacgctgtgtgtcacagggggaatgggcagcgtcactttttacatccagtcatattgtatgaaattgcaacaaattcaaaaagatgccatcgtgggagtgtggtgagtaaaaaacagctttcatgaaactcaaatcttgaaagtcagatgctttctgggtcttgtttaactgtaaaagagatagatgaagtattagaaatggagaaggaaaggggggaaaagccatccatttactgcttaagaatggctctgctattgcgatacctaaggtcacatgcgtagccacttgggttaatgatactcagtttgtccacggagtggcagtagcaactgtctgagaatcagtctcagccggggttccttctgtctatagaaagtgaaagacagactgttattcaaattccatgtgcaaaaaagccttcttacattaaatacctgggcatttcaggaagaagttttatttgacttaaactgtgaaggcagtttctcatttgaggaaaagaaagatataacgtgtttcagttgaaatgtcaagatcctttgattgcacatttggtttcctaggataaattattctagccaatggagcagaaactggctaatcaaaggcacagtgcacagttacacttctgtatatcattctctttttttaaaataatagctggaattttttttgaaagtgaaattacaatttaccacctcaactcagaggacatattagcttgataacttattcacagttgctggtgagttcaggcttaaatcatcagctgtcactcacaagtgtttacccttgaactttccgaatgagacatcaaacgtcttggtagtgggtgggtttaaacaaagctgcccacgcgagaaccattgtggagcttcttgttccaggggccggtcacggacaagctcatgaccagcacactcagatgtgacaatcagataacaagaggcaagagaagactttctgggaaataaaagatcatttttgtgatttctttaaattcagatcatataaattaggtgaagatagacattatttctcctgtttatgtaaaagaatttagacaatgaagtcacgaaattcatgagaataatttaaagactgttggaacttcccaatgtttttcttggcattcagtcactacacatagaaatgtatactatgccggttcctaatgacttagcagttccctcaggctttgttccacaggatgtgacatctcctctgccaacttttcctgcctcctttcctaatcataggattgctattctccctgacaagtaaagaatgacaagatattttattaaaaagatgttttatttatcttttaaagattttttaatgtatgtatctgcctctgaaattattaagaatgccttaataataatccctctcattttatttcagaagacactattgtaatagcatggctaggaaggaaacacagctaattattaagatgaatcatttagcaaggtggggaaaaatcccttgtgtgtaaaaatatctagtgattgacatattaccaaatttacatgaaatagatttccatgtaattgagactgatttttcctattagatggaaagaaccttcctgatcaggactggtgttgggggaatgttttccttatgaaatcagaagcagagcttctgtagggccgtccaagatcaggatgcttacttcaagatgccactctgcatctctccccacctgccaagtgtttcctgtctcccagatgctttctattggcttattgtaaggactttgacttctgcgctacgtgaactggggagtcactggaagagtttcagaggtgcaccttggtagactcaggctttctctggatctcactggctgctcttatgagtccagaatggaagaggatgaggacaaatgcagggggatgttaggagaccactaagcaggtccctgtcatttctctctctgtgattccttttgctgccactttctccttgtccccttggctccagccccctgctgtccttgctgtttcttgcacccgcccgtgaggcatgctcctgcctcaggctctctgcctgccgtgctctcacctcgcagacccacgtgatttcctcccgaacccccttcaggcctcggtccaaacatcaccctctcatcgaggtcttccttgaccacactgcttaaaattgtccccctcgcctcaccttaccaccttcactgcctcatttctcctttgtgcttaatcaccatctcacacagttatccagagcacgagccccacgaggaagggtctgtcttgtccactgttggacccctgacacctaacccctggggctggcccacagttgggaattgcatggctgtctgaagccagcaccttcctggttctgctgttccctggaagtggggttcagtacaccccacgagccaaggccctcatctcagagggcgtgcacatggttgcctcaattgtgctttcacactggacccttcctgcagtttactctcctatgtcagatgcccttcaatgaaagcaagtacattgccaccttgtcacacctctagttaccattttctttatggtccaggtcctgaccagctctaaagatgggtcagctgctgtatttccaagaaccccatgacttccagggccccttgttcccaggaaggccccgcaccccagtcgtcccgtgcataacctcacgggccagcacctggtagctgctggaaggcttctgggggatgcctgggcccctccagccctacctctagtcctgccactttacaactgagcacctcccgctgctgcctgctgaacccttcagagtccttgccacaggccctatttactttttcctgagaaggtatgtgtgatgccaaagagagaaaagcagcatttgctaatttgggtaaaatgtttctttgggaagggcaaattgatgtacagttgtccctcagtatctgttgggactggttccaggaccccgtggataccgaaaccctcagatgctcaagtcccttatatcaaatggtgtagaatttacatgtaacctaaacacttcctcctgtacactttaaatcatctctagatcccttacactacctaatacaaactaaatgctatataaataattgttatactgtattttttaaattgctattattttttattgttgtgctattatttttattgggctccctcctccccctcccaccccagtaatttcaatccaaggttggtggaatccatggatgcagaaacaatggatactgagggccggctgactagacctatttttattgtaattactcattctcttctacctcattaagcttggttctttcaagcatgaatacctggttgaatctgcataacctcttattatcgacctacctttgttcacacacaaatgattgccacttagagctctcctaccgggctccttttgtaaaataaattttatcttctccagatagaaagaaatgtgataccttgcggattttgcggtttccttgttttgctggattgcaagtcctttagacataaacaaatgttctgtaccccgacatcggtggtacccagctctcagttgagaaagagatgtaatgtgaatgccactcttggccccaggcactcctcacttgcccccactggggactggttcataccctcctctcctggcctcagtttccatacctcttagtgaggcctttgcgttatacttcagaaatattgtcagtatgactttgaagatgaaagtttgcccccaaaatcactctctgttatcattgtgaaaccagagatggaatggaaaaatgggtttctgagacattttaaattattccttgcttgtctttagaggcaaaattcagataagaaagcttatcaattatacttttgtttctactcaaaaactcatgactgctcactcaaagactccttgttcttatcttaaaacattgtttacagtgtcccagatgaatggcaacaaatcctggggtttggtgtttggatggtacatttccctggggaaagaaataacagtttgagatggaaccgggttggggtgggagaatacttctcattctgaggaatatttaattttgccaagatgagcatttctagttcttagtctgttgacgaaaagagctatggtttgtttctggaacttttgataaaaaataaagaaatttgtagcctggggagtttggttttaaaatgcaaacacaggagttatgagttgagacttggacagggtgtcattttctttttaaagggcagcaatatgattctttgatttgtctttgttatcttgacttttaatccggattcctgggcagttgttcagccccaggacatctccatgggcaggtggcctggccttggcacactacccagtaaatctctgcctgagaggacgctttagctgggaggccaggctgatttttaaaggcagaattggactatttactctaaaacagtaatgcacactgtttagaaagaaacattcctattctgggaggaaggaggagacacacagaagtatcatttatttctagtcttttctggtagaagctatgaagctgagtttactctctggaaatttgtagtttattttctagaaaattgcattttatcactgcaaaaaggattttatttccaaatgagtaggcttttgagcaagagttttggagtcacagagatggggttaagaaagtgataatgtgcaatggcgattctcaagttcaaggagaaaaaataacatgcttttattgggatactttgcttgtctataaaagaaagtagctattggcatttatgtagaagtcagcagtttcttggcaccaaataaataattttgtgctgaataaagggagagttatccatagtatttattactaaccaaagaaatgcagggagaattgtaattcattaggttttgatggccaggaaagccaagctgtgttattagggtcatgacaatcacagacattacggatggctgacctgtagtatggatagagggcagagggtagagtgtgaaatatatcacagaattatgtcaaataatctggatagttactactgcttaaaatctaagtgcacagctagaaaagtgggtagtgacgcactacagtcttgctgaacactgggtaagaaaatcatagcaaacgttgagtctgttttggaaatgttctaaaaccagactattaacacagtgagccattttaaatgtggcttgctacgtgtttggagagaaacacatactcttttattaggaacatgaaacaaactctttgagccgcagtatcactgcgagtgagtttaattgctgggattaataaatcacagctgcaaacgttaaattcttggcaggattctttattcagctgttttccccttgccccattacattccagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccctctgaaaaagcatccaggtagttaacctgagttgagttagtcagttgaattaggagccttacccctcagagagtggtccgtggaccggcatcccctgggagcttgttagaaatacaaaatcttgggcggcaccccagacctactgaatcagaatgtgcattgcagcaggatccccaggtgatgctttcacatggcaagtatgagaagcccaggactagatccccagttctcaagtgtggttgtacataagaatcacgaggtaagtggtaaacactatggctgcccgggtcctggagagtccgttgtaattggtgtggaaggggtgtggactggcactgggattgttttaaggctccccagtgcagtctaatgtgcagaaaaatttgaagatgactgggcgtgatgacctctctgagtcattcgaagcttcactgaagtagtaagcatctgcaagaatgccgtttgctcccttcagactgtttgaggctcgtttccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgccccaaacagtccctgccttagagcagggtggtcgggatggcctggacagccacagcaattaaaaaattgcaacattttaaaattttagtctataatatatatacaaaggctatgtgtatggggtgggggggtgtttgggggcagggggtgtgtatgtgtgtataacatgatgttgaaagggaacttgaagacttggtccagcttcttttttttcaaccaagacaacttttgcaagggtgacacttttctttagtcccaacctgacatacggtttctccttgaacaccttcagtggctcagactcacaggtccgtttgttccaatggtgggaacttctgaacaggtcttcctttcaatgagcagcagtcagcctccccgtaactgccaccacgattctatcgtcagagctaaagggagcaggaccgtgtcccttatcacggcatgccatcttctccacctttgaggacagctgtcatgatccccctggcatctgtcccccaggctgtatcctcagtcccttccacagttccttaggagactcagtttccaaaccttctactgaagacttccatgttttctctgtgctcagaactgtatgcagctatcccgattctgtctaataagggcagggtagagaactctcacctgtcgcattctagatgttgtccccagaaaactgctggcagccacatgtctcattatgggtgtataaggcacttgctgtcaactaaaacaccttttcacatgagcagacacacatgctgccattgccatcctgtacttataaattataaaggtgattgatttaagctgagggcaagacttcacatttatgctgttaaatttcatcattccagcctgttgggctatttagggatctttactgacatcccaagtatcagttacctttacgtcattcacacatatgatacacacctcatttatgtctatgctgaagtcagtgtaaaaaaaccccaggctgtgccctcagacctcctgatgacactgatctcctagagggcaggcattctcttgatagagatgtttgcctgcatggcactgagtccagcacctgaaatgtcatctgcctcttgcttccctcccctatccaccggaccattctgagacatttggcaaatgacacactgaaacccagactgtggctgtagaattctcctgcattcacctttcaataatctgcccccagaggaaacacttaacacggttttgttgaaaccacgccagctgcacagcatcactccgtctctatttgttttccaggggccaggattaagctgttgatatgatcacttttagaatttacagatatctcagctcccatacgtggttatatgttttttgtttgtttgttttccagcagcacttttatttttccttacacgatgacatgttgctggggcctattgttctcacataacagtagaaaaccaaaatttgttgtcatctcttcaaagaatcgagaattgcatacagaaaaaccttacataaattaaaaggatgaatacatttacaggtgtaaatgcaaaccactttcaactcagacaagtaacagcccatggtgttctggcagaaaacatcagctaagaaaggaaactgggtcctaagtcttggactttccaacccttacagaccggcagaacagaaacaactggttcaggagcccttgccagcctccagagaaatcccagaacacgcagccctgacgtattaataccctgcacagatcagagactgctggccacgcagactcaccaagccacagacttgtcttccacaagcactttcttatcttagccacaaagtgaccaagccacatgtactaagggttgaaatcaaagatatgtacagggtattaagcaaatctggttatatgttttaaaacaacttctaagacaaattgatggcaagtttgtgtgaaagttttatatcaaagttgttataagaggttcctgagcaaaccaattgaaatacagtcatgcattgcttaatgacagggatatgttctgaaaggatgcatcattaggccattgtgtcattgtgcatgcatcatagcatgtacttacacaaacctacatggtacggcctactatgcgcctaggctatatggtatggcccattgttcctaggctataaacctttacagcatattactgtactgaacactgtaggcagttgtaacaagtggtaagcatttgtatatgtaaacatagaaaaggtacaataaaaattcagtattataatcttatgggaccaccatcacatatgtggtctgtcattgaccaaaatgtcatcatgcagtgcatgactatatttctgtctcagtaggggcattcataggggaaaaacggagtctagtttcaagatgattaggctgggcagtcacttgggattgtaaccttcattcctcagaaggaaggggttcttgatctcattgagatctaccagaaaattgctgaagccatttatcaagaatgcaacttacttcctagataggattactcatcacatcagacccaaaattttgcccagctcaggtttggttcctctcctcattcctggttgataataatctagtatgtatacataatttaaatgttattctccatgaaaaaccaaagttttgtttttaataaagaaaaatgtctatccaaatataattttcaaaaatctgaaaagatgactcatacaaatatagaatgaataaagcttttatttaattcattaattaaggaaccagtaagatggtaaagctggttcaaaggaaaattcaaggaatggaaatgtgtatatcagtcagtccagtgattgttgaaatgaatttcctaatagatgcaaaactgggtaatgtcctatagggcaaaacattgtaatctttgaggtgatcttttaaatagcaaagtcaaacggtggtacattctccagctaattaaagaataattgagtgagcctattaaacagtaccctagtataatttggaaaggctgcatctccatcttgccttatttttaggtttgagataatttttctttacatggtcattgctaagtgtgcaatgagatgatactgtactggaaggaacatacattggtatagtatttctggaaagcagtttggcagtgtgtgttaagaacttaaaagtttaatttttaggccaggtgctgtggctcatgcctgtaatcccagcattttgggggtccaaagcgggcggatcacttgaggtcaggagtttgagaccagcctgatggtgaaaccccatctccactaaaaatacaaaatttagccaggtgtggtggcgcatgtctgtaatcccagctactcaggaggctgaggcacgagaattacttgaacccaggaggcggagattgcagtgagccgagatcacaacactgcactccagcctgggcgacagaccaagactctctctcaaaaaacaaaacaaaacttaaaactctaatttttataccctttgatccagtaatttcacttgtaagactttattccaaagaaataatcaaaagatgcaatcaaagatttgtgtgaagtgtataattatgcaataagtgttttgagcacactatgcagatggtcaccacagttttctttttattacaaaaagttgggaacacttcaaattccaataatagaggataaattatggcgtcctcttaaatatgatgtggccccattacaaatggatttttgaaagttttttttttttccttttttttttgtggtggagtttcactttgtcacccaggctggagtgcaatggtgcgatctcagctcaccgcaacctctgcctcccgggttccagtgattctccagcctcagcctcctgagtagctgggattgcaggtgcccgctaccatgcctggctaatttttgtatttttagtagagacggggtttcatcatgttgggcaggctggtcttgaactcctgagctcaggtgatctgcccacctgggcctcctgaagtgctgggattacaggcgtgaactgccatgcttggccgtattttttaaagttcttaatgagggaagtcaagatgtaaaaccatatatttattattatctccattatatacacacatacatgtatacagagagaaaaagtaatgaaaataaccaaaatattaacaataagtatctgtgttatagaattatgattgttttttcccgttttccaaattttctacagtaaaacttttgaagcttttataaccaggaaaaaaatttaaaagtttgcaatgcattccagaaataagtgtctcaaactttgctaatttgaattgttcatgccttctctgcctgccttctccaccttcctccctggggctggtgttcccggcttgacattttaaaccctgtaagtggagagcagtggaagaatgatgccccagccctgagagctgagggcggccctgtttgtattttcttaggttgctgtagatgtcacagggagttccgggccatcacagccagggaacacaggatgttgccaggtgtgggaaaaggcctttagggtggtcagagtcccgaagggagcctcctaattcccagttggggaatggagatttcaagcgagttcttgtttccaggctgagatgagcacacttgcctcttacccactggcccagtggatcctaaccttggctacaaatgagaatcacccgggggacctttaaacaaacactgttgccactatcccacccacagtcaatcaaatcagactttgtaggggtggtcccggcatcagtggtttttcagaagttcctcaactgatttaaatgcacaatggaagttgacaaccaccagactgaagataccacgtgtgttaatgggcccaatgtattcaaggcccagtagttggccccatctcccctggtatcctaagaactctaaatcctttctagctattcgcttgtcaaactcctgagcttactttcaatggagcttacacattccctccttccctcacatgaccccaggcacagttaatggttgttcctagaggactttgtctttgttccttggggatcaggtggagtgagacagtatccccaagactaagatctctgaggagagtaaagacaccatctctgtgcctctggttcctgctacagagtaacttcctgatggttgccaaaagaatgaacagaagaatgaatgaatgcagcggttcttcctgccatctgataacagactattctttgatgttttcattttcaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcattttaaatttttgctattatatttttgtaaacatgttcaagtttttctgtaaaataaaatttttagaaatgaaatccctcaggccaggtgtggtggctcacacctgtaatcccagctacttgggaggctgaggcaggagaatcacttgaacctgggaggcaggagttgcggtgagaaagatcgcgccactgcattccagcctggacaacaggagcaaaactctgcctcaaaaaaaaaaaaaaaaataaaataaaataaagaaatggaatccctcaaaggatatgtacattttaaattatattaaagagtaccaaatttcccgcttaaaaaactttgatttcactttacagccccagtcatacagtatgagtgcctctttttccatcctttggtcaatgcaagatagaataatcttttgagcctgggcacagtgcttcacatctgtaatcccagcattctgggaggccaaggctggtggatagcttgagctcatgagttcaagaccagcctggccaacatggtgaaacctcgtctctacaataaatacaaaaattagctgggtgtggtggtgcatgcctgtagtcccagccactcagaaggctgagataggaggatggcttgagcctgggaggcggaagttgcagtgagccaagattgtgccactgcactccagcctgggcgacagagccagaccctgcctcaaaaaaaaaagaaaaagaagaatcttttgaatttttgccagtcttatgaaggtgagaaatgatagctatttcattgttgtaatttgcacttctctctcactaatgagattgagcatcttttgagatgtttgtgggtcacttttctttgtccttctgtgaatcacctgtttatatcctttgcacattttcagtagtggttgcttttttcttattgatttatgatagctgtttattatggataaatataagtacttttatatttaaaaattgtgagagccaagtacaatggtgcacacctgtagtcccagcttcttaggaggctgagacgagaggattgcttgaggccaggagtttgagtccagcctgggcaatgtaacaagaccctgtctctgaaaaaaaaaaaaaagaaaagaaagaaaaaaaaaagaagaggaagcaaaaggaaggattttaaaaactcatttatttaatttatttatttatttatttatttatttatttatttatttatttattttgagacggagtcttgctctgtcgcccaggctggagtgcagtggcgcgatctcggctcactgcaagctccgcctactgggttcacgccattctcctgcctcagcctcccgagtagctgggactacaggcatccaccaccacgcccggctaattttttgtatttttagttgagatggggtttcaccgtgttagccagggtggtctcaatctcctgacctcatgatccacccgcctcagcctcccacagtgctgggattacaggcaaaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatcc

SEQ ID NO: 37978 - DNA, 4512 bp, Homo sapiens; identical to SEQ ID NO: 35751

SEQ ID NO: 37979 - DNA, 22152 bp, Homo sapiens; identical to SEQ ID NO: 36316

SEQ ID NO: 37980 - DNA, 93609 bp, Homo sapiens
cggctcggggctgtgagcggctcggggccgggggtgggcggcggtgcggcgggcggccgacgctcctcttcggcggcggcggcggcggccatgcgtgggcggcgcggctggggcggccgggccggagttgcctcccgggggcccgcggctgagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtgagtggggccgccgaggccggggcgggcaggtcgggccggctggggcagcttccggccgccggcggatcagtctgcgagccgtggacctcgggcgagtaccctccccgccccccgcgcccggattcgcctcgcggcccggtctctgcctgccgtgctggctgggaggtgtggtccctgcccggtccccagctctgggtcagccttcgtgccgccctcgctgccccgccgcgatagacccagattcaccccatcccatcctcctcactgcctccttagcccttctccctagaagagtcagtcacccttacaactttttttccttgctgcacgaagtttttttgacgctttctatgtgtgtcactctagggccctcgattttgaatatctcgaaattcacgttttagactgaacttgcaaaccctttgctgtggttttgatgctccagtagaggccacgctctgtgcttacccttttacaaaaaaaaaaaaaaaaaaaaaaaaaacgagagagaaagaaggggaggttataagggcaccaaatgttcgtggcagcctccaactcttgggacgtagatttggagcatatgcttagattctaagcatatttttagtgaatgaatcgccaggtagcagacctttttagtttcaatacctttttggtttttgcattgggtgtgttgggagtttggactgactctgtacttctgggccactctcctacttttgagtatcttgaagggaaacaagaacttagtcttgggtcggtttgtggttccatttacttgcttagctttgttgtttggggaattaatttgaaaaattgctggggtcttatgttaggactttgtggattctggaaatgaccccttagaggaagatctgacaggaacgaccccccaaaaaggaagtccttggtacctagacgtttgcattcttttgttattatggcagtatctttatttcatctgaaggtggtgcttctgagtgtttgaggggaaaaattattctctattgcatccattatttgtcagtattctatttttttttaagtaataagactttgttgaggtgtgttgagattgactcagtgtagaaatggaattactgaaagcagactctttagacattacatgtacggatttgcagtttttagccaaagaagaatgctctttttatgaagtcgtgctcattcttaatccttcttagtctagctgagttagctgaatgtagtttagctgaattaaaactctacttggggtagtacttggaacacaagactaagatttaggaaaaataatacaagacgactcatatcacattaattttagaaatattaacgtattatgcatggttttgtaaaggctttttggttaaaagcacttatatagcttgtgactttgtttacatgggtaaacaaagtcagaggtgtaggtaggagacagaagacaaccagggactgacattgaattcctgccatatacctgcccctacatgctttatacacataatttcttctaattttctcggggcccagtgaggtaggtggcattatgcctattgtagagatgaggaaagtggggttttaaagtaacttgctcaaggtcacacagttaatttttttttagacggagtctcgctcttgtcacccaggctggagtgcagtggcgtgatctcggctcactgcaatctctgcttcctgggttcaggtgattcacctgcctcagcctcccaagtagcgaccacttctggctattttttgtatttttagtagagacagggtttcaccatgttggtcaggctggtcttgaactcctgagctcgtgatctgcccgcctcggcctcccaaagtgctgggattacaggtgtgagccaccgcacctggcctagttcatatttttgaaaaaaatgaaacagtgttgacataggctgcaaagttttatcgaatgaaatgaagattttgtctgtagaagtttgattatgtcatggtggaaaataaatcattgctaattagcacttgagttatatatttgttaccttattcaaaggttggcctggaactaattttcttagcagtatttgcagcagaggaagctcctgtttgatgagcatccaatttatgcccagaaatgctgttgctgggagggtaggaagcattgtttcaattaactcccttgtctatccccgggggcgagagagacttctagtagtattttctctagtgcaaatagggttgacctgttacagaggatctctagtcactccatcctgccagattcaggttcgttgtttccatcccttcccatctccctcatacattctacctttaaaataattccttggctcctccaggtagggaagagccaagtgggtaggactgagatgtgtactgagatgtgtacaaggcactccgaattctcagaatgcagtctctcacagaagctgttatggtacttaaggcttcttggaatagtagctttgcaccgtattttagaatcactacagattttgtgccttctgaacgctggcataggaaacgaaccattattttataatatttttaagacagtttagagttccaagtaagaaacttataaatgaagttgatagtgacaactttataaattgaactaattacccttgatatgagaataaattgttttaatccagttaatatatgcatatagttttaagagaaccaaaaggcttttttttttttttgagacggagtttcgctcttgttgcccaggctggagtccaatggtatgatcttagctcaccgcaacctctgcctccaaggttcaagcgattctcctgcctcagcctccccagtagttgggattacaggcacgcattaccatgcccagctaattttgtatttttagtagagacgaggtttctccatgttggtcaggctgttctcaaacccccaacctcaggtgatcacccacctcagcctcccaaagtgctgggattacaggtgtgagccaccgcatccggcttaaaagacttttgacaaacacagcaggctcttgcttttgtcttttttatccctcaggctctactttccaggggtagctactacctcagctaggtctgtttattttttcttcctctttttttactttcgtcattctaaatcaatgtagaataagtctttgactttctagtatcataactgagctctttctcatttctctcttaaatcctccaatgtagttacgtaacttttttgtaaaaatagcagtatttacattattgtgtacacaggtattgctaaatagtgacttatgattttttttatacatttttgtttttcccacagcaaataattgcattttatcaaaattgcgttttgattcgttacctatttatctttggctgtgttccctcaactactccaagaagtatgttaaatgccttttgattttttttttttccaggtagcacattaaatcatctatcagtgccacttggtttcctcttagagacttcttggtctggagcattccatcctcttgctccaatctagatagtacgattattttttctgggacttcctgttacttctttcctgtcttggaacctctgttttttagatctcctgtcttcctttttcttggtttgcttcattttgctactatgtatgtatcctcagtagcttcttaggaaggaatgatgggagataaattacttgaggccttgaatgtctgaatgtatctatcctgtcctcatactttatagatggtttggctgaatttaaaatattaagtagaaatacattttttcataattttgatggcatattcacagttttctgtcttaagggtttttgatgaaaagtccaaagccattctgatgcctctttttttctgtttttttgaagctcaggttctttttctctggcattctgaagttttataagtttttgtgtggttggttggttggttctttccttcctttcttccttttctttcttgtattaccttagtgggtcctttcaatctagagactctttttagttttcagaaatgctttttttttttttaataattcccaccctttattttctctctctctgtgtgtgtgtgtgtgtgtgtgtgtgtgtgtgtgtgtgtgtatttctttctgagatgtctgttggtttggttgttgaacccactacaaatgatctttaaattttcttaactaatctcatgtcttacgtatttctttgtactggaaggagtgggagggggggaatggttctcaattttaatgatcatgtttttaaattttagaatctttttctgtttccatttcattgcatcttattttatggatgtattatctttacttatctctgatgtgtgtatttttattttttctttgtgtttaatatatttttaatatttcttctgtttcctccagtgtggttattcatttcagggatcttttctttgtttgtttaagtcataaatatctggtgatccttgactgtctataatgaagaaaaagatcctgaggagctgattgcagaggagagaacatgtgtgtattggtggtctagtgacttgtgagttcaggtggacttttcattgggagtctgccccgaatatcaacacctttacatctcgtttggggccagtgttcacaatgaagaaatcatcatctcctgcctctggtatgcttggtgatatgccagctgccagggtttgggttacctggctgagggagggatggaggctgtagccttcgacttctggctacagttctcctgtcactgtgattcagtttcttcagaaaaaactttgggtttcctgctggaactggggatccaaaagctttgaacacctctttcggtggctccccccttgtctaggctaagcctcacatcagcctttggcatctccttggtgcctcaagacctgagcctcttggaggtcctgaggggcagtgaccattccttcaagtactttgccatcttgcaaaagtttgtttaaaaaagcatgttgtctttccttttctgtttgtccttatggtttgatgtctttgtgattttttttttttaaactatcattttagaggaattttggaaggaaatggaggtaagggattatggtcattccacaatgtgtaaatggcagttagggtttgggtttaactattgaagatgacgtgtggcagtctttttatatgaacaatattacgagtagttaatggtggttgtagtagtagttgacacttttaaaagtgctgtcttttgtctgtgtggggcatagaggtcatccctgtgttatgtactgtcatttccattttatagatgagtgttagtctgctcaggctgctgtaacaaagtaccataaattgggtggattgtaaacaacagagatttatttctcacagttttggaggctgggaagtccaggatcaaggctttggtagatttgatatctgctgagagccctcttcctggtttatggatactgctttctccctgtgttctcacatggtggaaggggcaaacgagctcccctgggtctttttataagggctctaatcccattcatgaggactgctcttatgagctaatcacctcccaaagggccctacctgctaataccatcccttagtggttaggatttcaacatagaaattttggggtgacacagagaaatgagaaaacaataatcttagagtaggtatgtattaatgactagcctggttttttggtagtagtagggcacacggtcctgatggaagtgtataagttctgaaacaccgaaagcttcagaagcttttaaactctggttggccttcctgtgttcctgggccctggttcatcgcttgcatttacaagcctgttacttgcataacaggctgcaatgtaggcattcatttctgcattttactgatgaggaccctgattcagggccttttggacagtgagtagaaggccaggtcttgactcagtcctgcctgagacctgaattcatactgtctctttatcagctctggaggagtgcaattaaccaaaaactcaaagagtagaaccgcaagcctcctgccacaggtgcttgtttgtggtctttattattatgctaattattcttgcatcctcccatgttctttaattgataattttcattgtactgagctctgtggaattccggagcctgtgaaggtggcatatggctgggcagtgccagaagcttgggaagaacatgctggtgggtgggtggggaatggtataaactggttatgccaacagtggtggtggtgataggggtcagggggacttttgggaagaggccccatctcccaccagttagaaattaactttggataacttgcttctcctcttaaaataaatatcttctggaaaagtcaagaatgttcacattttatttaaaatcaagtcaatactagttgaaatcactgtgtcccaaatcagtccagaaaatttttttgaagctaaaccaagtaccatatattgtggtagaaaatgacaattcaaaattattacactcctttccctgaagatctcagaattttgtaggggagacttgcatttatgactgtaacagagataagagttatattgctggttgacataagttattgtaggagcacttacttttgactgtggaaagggcggaggggagacaggcttagagagtttaggaaacttgtcccagggaaaaaaaagacatttgagcctcatcttgaaggatgaatttgataggcagaaaagagcagttcataccaggctgagaaagtagtgtgaacaaagacatagagggtggaagcagctgtgtgaaattgtggggtaggaaaaatctaatgtggctgaggtgaaaaattagcaaagccatggagcgccacaggataaagctggaaggtaggctgaggttagagtaggaatttgaactcttacaggtgaattcttcagtgagctgctaaagaatgcagactaggagagtgcgcagtcaggtctgggttatagggaagataactttggccccagtgaaaaggatggctttggagaatgaaatgctggatctgggaaatgagatagagccaaccttgtgatgataagagggatcaactaaggcagttgaaggggtgggatggatttgtgaggaatttggtgagtttggagaagacttagtagaagagactttagggctaaagaaaggggaggagtcacagaggaatctagggtttcagatttgggcaactgaaccaaaggaccctttccttttgggagaagtggttggtcaagggaaagaaaaaggagatgaaccatgtattcctctcctcccagcacccctctctcctaaatctcagagcccatgcttggtggggaggaggggtggagggttgaaggtgtcctctgcccatgagtctggcataacctgccagagggcccagatcctgggtgggtttttgggaggttagcactctgcagcaaatccttaaccctaggcgttttggtggagttggtatttatttgaatccatgtgttcttcattgggagacaggcagagacattgtgcaattgtgggtttgagggttgttttttttcctcatgctacacatgtgagagaactctatccaattatggctaaacctgtcccctgtgagtcacatcctgagttgactggtcaattccaaaggtgctgcctaaaatgctgtttggattttaagaatcacttttgggacaaatcaaacatgtgagtatttattcaggcacctgagttgagaagttccatagcattacttttggtgttttgatgcagttacgccaatgttctgaaaaatcttgccagctacacatcctaaagcaaaacaaaaacttgtacatgaaacagaaccattagctactctaaaattatgtcacacttaaaggtatacatttttgtgcgttgttgatgtaaatcaagtgcaatattttctaataaaaattttattaaacagcattcatttgtgaaggtcctcttaaaatgtgccaaaataaacgtgtgtgtattgctcagttacataataaacagttgttgaatgattctttttgtgtgttcagcagtgataatgctgagtggatttcataggtctcattcttatcttttttttttttttgagacggagttttgctcttgtcacccaggctggagtgtaatggcatgatctcggctcactgcaacctctgcctcctgggttcaagcaattctcctgcctcagcctcctgagtagctgggatcacaggcgtccaccaccattcccagctaatttttgtatttttggtagagatgggatttcagcatgttggccagtccaatcttgaactcctgacctcaggtgatccacccaccttggcctcctttcaaagtgctgggattacaggcgtgagccaccttgcccggcctcattctcattcttatataaattttaagctggaatagacagcacacaagtctctagttagggatcacctgtaatttagggaggaggaggaagagcgtatcttgctgtatgccaggtactttacatatgttctcttttatcaaccataggaagtcggtggcattgactgttttttgtttgtttgtttttaaacagataaagctgagatgctgaggttgtgggcaattaacagaatttgctgtaggtcacagagatgtgtggggctatgtgactccaaagtgcgtgctttctctactgtgctgcctttgaaggttgacagttgacttagtctttaaccaaaatcatctgagaagctttaacaaactacagattccttgacctaccctgagcaatttgttgaattgatctgagatggggctcaggtaaattaacgttttgaatgccatgtttaattaattacaggaggtacaggttttccacatttgaacgtctctgaaatcagaaccatgttataatcagtggggagagtcatcagttaatagcttttttctttcttagtggcacaaaaaataaggatgtactttagattaaatgaaatatgatattataaaaaggtgatactgtaaagggaacttaaatacatagtttgtcacctttctttttttttttttgagatagagtcttgctctttctctcaggctggagtacagtggtgcaatctcagctcactgcagtctctgtctcccagcttcaagcgattgtcgtgcctaaggctcctgagtagcttgggactacaggcgtgcaccaccacgcgtggctaatttttgtatctttttttttttttttttggtagagatggcgtttcaccatgttggccagactggtctcgaactcctgacttcaagtgatttccctcccccaccaaccctgtctgggcttcccaaagtgctgggattacaggtgtgagccaccataccaggcctccaccttttttatgtgcatatgcatgtgtttgtcacaactttcagaattgtaaaattcactggtggtatttattatttgcttacagcaatagctgtgtagtaatgcccttgcagggaaatcataaaatgaatgagatattgtcattagattaagagcaatagcaaggttacttttcagccaagaagctgcaggcaaggagaaatgtcagtggttctcagcctttttttgtgaaagccttaggccctttccctagaaaaaggcatgaatgtccacacatactaaaatttgtatactgtgctaggacctctagacttttggggcctttgagggactcctgatgaaaagcttaatgggtacacctgagtgtcacaaaaactggtatatgtcatattctgttttacatcctaagatctgacctcctacatgaatttttttgaaaatttgcatatattaagattcactctgttgaaaagttatgtaggtttcgacaaatgcatagtgtcctatatccactacagtatcatagacagtagtttgcacctttaaaaagtcccctgtgaatggggcatttgtatttataaatactccctcccttatattttaaataaggtgctttaaaaatgtatttattatggaacatttcaaaaattcaaaataaggcataataatataatgaatctctgtatacccgtcatccagcttcagcagttctcaactcatagccaattctgtttcatctctaccaccttacccctactccactcatttgccctcactctccttatcctctacttagattattttgaagcaaatctagacataatttcataaaaatattccaatatgtatatctgaaagaaattcttaaaaaatctaaaataaccattattgcacattattaagaaattaagaatttataaatatcaaatatctaagctgttgagcttttcctgatttataaatatgtaaatgtatatgtagagactcttcttgcctacgacctggatccactcttatccctgcccctccctgcaccactcagttcccttggtgccagactccttctcaccctggagtctacattagatggcacctctgccttgcgttctttccccaaatctttacatggctggtactttctagatctcaacttaaaatgtcaattccccagagaggctcatcttcctagggttgatccccagtgcctctctgtgctatcacactgttttaagcatctgatacttttttggttgtttccatctcctttagtgaaagttctgtttgaatagacactttttaggttgttccactttctatttttagcacctaaaacagtatctgacatgtagtaggttttcattaaaagtggaacaaatgagtaaacaagtgaatcatacttacaaaaaaattcactatcctgtgccttactggagtcatcattctgttgatcatttcccatggcctgcttagttattatccaaaagggaaattagactgaagctatacttactaatggaagtttacatatgttaattttttatagctgcttttcttttcttttttttccccctttttgagacagggtctctctttgttgcccaggctggagtgtagtgatgcagttacggctcactgcagctttgatctcccagactcaagtgatccttctgtctcagcctctaaatagctgggactacaggtgtgagctaccataccccactaatataaaaatttttttttgtatagatgaggtctccctgtgctgcccaggatggtctgaaacttctgggctcaagggatcctcccaccttggcctcccaaagtgctgggtttacaggtgtgagccactatgcctggtcttgataacttattttctttggagttgcctaatttgcctctcccattcccttgctgtctctgggtaaggcgcctcccatgtcgacttccatagctccataccctgcataagcagacctgtatcactgcacccatcatattttgtctctcccctactgcaccgaggctaccttatggcttggcacagagcagtctctcaatagactgttggcccacgctacaattggaggatgtgaagtattcaagagagattccggcaaaagcctttatcagtaatgaaaagctaggaaatacaatttctaattttttttccccaaaatgcataacctgctgtcctatccagtctattttccatcttatatacagtatagttttcagccctagcaatttgacttgggtctttttgtattttccatgattctacttaactttttgaccatgtggagtacaggtataatagttgtttcagtgtccttgcttgtattctaacatttgtgcctgttctgtgttgattttgacgacatatcatgtttacttcctgaagtggcacagttaggaaaagttagtgcctgcagattcctggcttttccttgggaggaacaggagattcccttccatgtcttcttgaagctgatttctaaaccacctatcaggaccaaaagggtaggcttacctgcttttctttaggcagaaagaaggcagtctgaaggacggaggggaagaaggggtatatttatgttgtctgctgttgttggtcatgcatacgttctttctctggaaagctctctctaatcctcctttctgtgtatgaacatacactctcaagacagttctatcaagacacttagggttgcaggacaaatatatgaggaaatgctgaagaatgtggcagagaattacacgaaaaatcatatttaatccacagattattgcttgaacagctatgggattgaagatttacatgcttattcaactatggggaaaggatgcccctgttctacagtctaatattttaattccttgtcttataatgtagttaaacattaggtctcagctaattttctaggcataatatgaccacagctagatttattacattctgatgaacaaactgttattttatcgatttcagcttgttactttccataacctaagagcatttgaaataagagctccttgtttactttccttttagcattcattaaaatgtattcagtggtttaatacatgttaagtgatattggttttttctctgattaatggctcatattaccactgtcctcagaatctagaagattatcttgactaaatgaatttttacttaaggtttaaatggcatatggaaactgtggatgatataataaaataatagtgttttggctgacactaggaaaccatggatgatatcatagagtaatagaattttgcggctgaggagagggacattaacatcatctggtttaacttttttgttttgtagttgagaaaattgttgtctagagagggcggttaagtaattggttgccaaaggtcattcagctacctactggtgaagccaggggaagggaagtaagaactgtgaactctgctttagttctctttctatgacatcacttttgtttttttgccttaactaatggttcttgacattttctttaaagtatcattttctttaaaacccattttctttaaaacccatctttgatgtagttgacttttatcgacagccagccattcatgcatctaatatttaagtagttacaagtaaactaagaccccagccttgtttgtgagatgtgcaaggtaataggaagatggacatttgaaacaactccctgaaatatgttttgttaagtgctataaaggtggcttttaaaataaagagagatggtttgctgatttagcacgaatgaaccatatgtacagctttgagaaaccaatagtcaacttttaaaatcatttggaaaaaatttttgaactgttgaattattagaacttgagttaggccagttcatgtggatcacagaccttgaaataaatttgaacttaaaatcgtctagggaaaaatgaattttttttgataagccttaagagttttgcaagaataactttggttttttagctttgaatttgagttgtttaaaaataaaattttgaaaaaatgccatgctttctaacaagagagcaacatttttcctttgctggaattggcaatgggaaatttaagtctggttaatgtaactgaacagctgaagtattttcatcctaaatcagaatttaaaaattctgtgcattctaatgacaaaatgctacctctttagttcgtggctgtccattcttgttcttgtctgctttccagcacagcccccttgtctcttggcatccttgtcaaaaattaatcagcccaaaatatgtaactttctttctggactctcagttctcttctgttggtctacatgtctgtcatgccagtactacactgttttgattaaagtagcttcgtggtgatctttgaaaccaggaagtgtgagtcctccaactatgttctttttaaaaattgttttggctattttggcctgctcacaatttcatattaatttgaggatctgcttttactcttgtgcaaaaatgggagtcagaagtttgatagggattttagtgaatctgtagctcacttgggtagtattgttatattaacagtgttaagtcttccagtccatgaacatgggtgtttttccatttatttaggtctttaattctttcagcaatgtttgtagttttcagtgtacagttattcctaagtattttattcttttggatgctattgtaaatggaattgttttctaatttcctttttggattgttcattgagggaccagctcttattatgcattatacctctcctttcctacttggattgttttgcccactacagtgtctcagcattctcttttcttttgatttctatgatctttacttacataacctttgactcattaggattgttggagtcaccagacctctacaaaatgatactcagtgactttatttccctgactctaattttcatttattccctccctttatcccaaagggatattagaacctaccctgattttttttttcctttgaccatgcgggtgtcccagttcccagttttcttttttttcccaaataaggcactcattggaatgaccaccttagaagtgatctgtctcagcccttggaatttcctaactatagcacacctaccttccttctcagtcactcccttctattggaaccaggctctgtttcctagtctcataaagagttaccctgctcctggcttgccacagaactggttccttaaagcattactgaatagattgtttccctcactgcctctctaatcatttctcactactcacttaacctctgtgatgcttaacactccctgacagtaataacccctgctgtccactgtccctgctttcagactgcatttgattgctgttgtcgtatttgaaacactaataattaatagtaattagaaacaactaggttatctagcccctgtctttatgtgtcttttgcttttctcttttaatttttttcaagcgtatgatggggaaggaaagaaaaaggagttaaaattgagagataaagtatgatattctctatagatttcatctttttctaaaagtaaatttgtttaaaattcttttatttcattaattttatttcctgattattagggtaaaatatactcatttatagactatttggaaaatatacaagaaaagatatagactggaaaatatacaggaaaagatatagactagaaaatatactcattatagactatttggaaaatatttgtaaagaagaaaaatgccatatattaaccatgcattgacaatttttgatgaatgtattttcaattttttttcatgttcttgttttttctttatgtagttgaaaccatttgtgatggttaagaatataggtaactctttgagatagatggtacttaaaaatgtgtatgttcagttttgcctcactccctgccttcttaccattgcccggtggtcatattgtggcctatacattttttcctttaagaaattgattatgcttttccttatagctgatcacattttgtaaatatcttacagatgatttgaagtaagtcacatttcctatagagtaccatcttgatagatgtattaattatggctgtacctataaactatatcttttatatgctaatatcagtcatagactgatagttttgtaccatggtcatacttatatttggttctcttcatatttctactattttggtttttaaaattctttatagtttgatacagaacagtgatgattcatgattattataccttcatcctgaagcatagctcttctcagtataaaacagttctctatcccctattaaaaacaaaagttttattaatctctcagtatgttttagagaaactttttgggaagaatacataattgcggtgtttcctgaggccttctgagtactatttttgcatatgatgagagtttgtctagaaatagaattccttgcctgcttcctcttctcctgaaaattaaagctttgttccattccctgtcatcttcagggttttccatgttattctcattcagatagcatgggtaacccaataattttatttcagtcccattgtcaaatgttgcatgtggaaattttttccaagttttggtcttctcttttggtctttctcttcagtttatagtactttgccaaattttgctctttggtttaactgggtattttaagggaaagttggaggaaagtgttttaatcattaataatttatcattactggtgttaacattaatataccaaagataatgtcgttacaaatgtgattttctaaattgaattttatttttgagggccttttctgtatctcttatcaaccttcatgggttattttagacagtagttggttgtatttttgtattaatgagttgtcgcagctgtatgcatatttctttaaacatgtttttgaacacttttattgtttttccagcttaactttcatagaaaatttaagagaagaaaaagaataaaagcatataataaaaatcatccataatccactatttatattcaaccactgttaacatattttgctattttccctttttttaaagtggaacacaacatgcatatgaatatatatttaactttgattcaccggatgtttattgaatacctgttacatgcatgaactattctaggtgccagacattgttagaaatttgctgtatacagtttgtatgttgtaatttgcatttactgttatattctaagcaaaactcattttactacagtatttataacagttttgttcatggcttcatagtcttttttcagtgttttttagtcacttatttggtcattaaaacctgtcttcaaagaagcctaatatgttagagagatgaacagggagcagtttagttgagaggatatcatgacttgaggtatcacctctctcctccaaagaaagataaactgttgaaaactgttgttctatcttctggatgtattacagtttattaattattgctctgttgctggtagtttatattgttacttttcttcagttttaatttttattaatatatttgtacataaaaatttgtgtctgtctttcgtttccttaagatggattttagtaatggaattattgggtcaaagagtataaatatttataaaactttgtatagagtcacaaattacgtgtcataacctgtgtaacagtcagtattatttttaaataatataaacatttctgttataacatcaaatgtattccataaaaacccttcaagtttacctattcactaaaaataacaggatttatgagaaaaataaggttaagggccagccactcaagatttctgcaattaaagcagagcaccaacaaaagcataattggtaccttgtgagatcacttgggcagcccagtcaaaccatttagcatggcttatgttgcctcagaagagagtgagagatattaacatatagggtgtggtcttgagacagtacagatgaaagtcattttcttagccaatgtggttgccataaaggtgggcaccagagtaagtgcagcttgctgtgcaaaggatgggaatgctcctttgagcagggagtcctgggtacaggtgctcattttaaatattcttgaaatagagctgagaggactcctgcttggcagcagctgagctaaatgaggatctttttctttctcactgaaagttataattctattcctgctattccagatccccttgcctaggaaaattaatatgtgaacccacttgttatactggaatgatcttacttaccacttaaaagctgtgttacagaaacatgtctcacaatataacagactgtatttgctaatttgatgcgtgaaaatttgaacagaattttattggtttctttcaagccttttcaaactggaaataactaccttagctaataaagaatggagtatctgtttcaaaacaagtgttttcaaaacctatagtcagaaaacagcaactgtgtttaatgattatattgcaatttaaacacctcagtctatggtagtgaattttaaatttacaatttattttggtggtcattaggtgttcataggcatttggatcacagggctttaaattgtcagcagcttataaatatttatttgttgagggtacaagcatcatcttgtagtgagtcatttgtggcaatggcttaatccaggattatgcagcattcaattatagcaccagagaggacaggaagtagaggagtgagttcaagattgggtgtttttttctgagctgatggtgtatgtctgatgtaggctgtggtgggtgaaagtggaaacctccactggtaagaaagtaattgaagtaattgaggttgaggcctgtaagaagaaactgaggaaatgattggtacaatagaatgggagaaacaagaggattatagatactggagacagaatgaccctgggagcagctgttgttaattgtaaagagctgaagaactactagctgttgagatactatagttcaagattttagaggcagagtaattcgcatattgctgctgtccatgagaaatgagtttctttggtatggatgaagattgttggagttgaggaataaaagagacattgaagggcagattgaaagtgggttagtctcagggacattgggagtctgccctaatgagacatagaagaggggtgcatagaacttgtataaactggtcccagaatcctcagtgaatgaggtaactgagatactgagaaggatagagggtggcatagtttgatggcatgattgtaaagaaacagaactttgggtaagggtgctcaagcagtcatctgaagtggccatggcgatccagggcagtgtccactgagggtaagagaatgggccctttgggctccacagggccaggggaaagttgtacttccgaaggataaggaggttggtggaagtcagaggggtattagtgggtgacagtatagaagtagatcattgaagggggataaggggtggacggccagggtgctaagctactagcacaagttgaagtccaactaggttttagaagcctgagaaagttggctgactgcagtctttgccctgtcttcagttgaaatgttgtgaagttgctctgttatgttcaaaaagaatattccctacttaggaggcatggtttctgttgaagttggtagtttctgtttgggctggtaaaactagagagaccttgagcaatttggggagaacagatgttcccaggaggctgggaaggaattggctatatccacccgtctccttgacagataagataaaatttctagtagaacaaaaccacgaattatcaaatgactgcatgtatgacttgaggacgtgcctgcattttcttcttttttttttttttttggtcttgtctggctgcttacaggtactttttatctagcttaacatggagttgaatttacagaactcctagatgctcttgatactttgaactgtgtctggaaaacttacttacatattattttttgttattattaccagtaataacaataaattgttattaggaacagagttctttattttcctgggaaaggtgttttgaagtttaaatatggaagttggtgatcacttaagattaattttttctaaaactttttatgttagtacaaatactatgctatgattttgcaagcttcttgagataagcagagaggtaaaaaccattgagtgttaattccttttttccatcttttaaaaaaattagttaaactacgtataatgaaatacacagattttaaatgttctcttggttgagttttgaaaaatgcatacacctatgtaaccaccactccaaccaagatataggacatttccatcaccccagaaattccctgatgcctctttgtaataaattcaacagtttcccttccactcccctttccagggtcaccactgacctgatttctatcaccataaattacttttgcctattctataactttatataagtggaaatattagtatatactctcttgtgtagtttctttcactcatacagtctatgaaattcatccctattgttacaaagtctcttattttcattgctgattagcattccatttatatatatgccacagttggttatccgttcatctgttgatggacatttgtgttgtttccagttttggctattgtggataaaagggctgtgaacatggccaggcatggtggctcacgcttgtaatcccagtactttgggaggccgaggcggatggatcacttgaggtcaggagaccagtctggccaacatagtgaaaccgcgtttctactaaaaatacaaaaattagccgggcgtggtggcaggtgcccataatcccagctacttaggaggctgaagcaggagaatcgcttgtacctgggaggcagaggttgcagtgagctgagatcctgcctgggcaacatagtgagactctgtctcaaaaataaaaacgttcgggggagggatatgaatatttgtgcataagtctttttgtggacatatgttttcttttcttttggataattactcagaaatggaattcttggatcatagaataggtgtatgtttaactttataagaaactgtgttttccaaagtagttgaacattttttacactcttagcaatgtgtaagagttgtataatagttactccacctccttgccaacgttcaatgttattctcttgggtgctaatggctctcactgtggtgttcatttgtagttctctgatgactaaggatgtttagcacctcttcatatgcttattgggtatgtatataattatgaaatgtctgctgacatcttttgtccattttatttaatttggttaaaaaatttttggttctttatatattctagaaacaaatcattaaaaaaaattaaccaacatctctcccttcccccagctaagttctttcttagatagatgtgactgttttctcctagtttgtgactttaatttcattttcttaatgttttttgagggacagaagtttttaattttgatgaacttcagtttttaattttgatgatttttaaattttgataaggttttaaatttttgataattttcagttttttctggttgctttatgttctgtgtcacctgtccaggaaatctttgcttaccccaggttgtgaagattttctatcctacgttttttttttttttttttccagcccaaaggagagcaagggagagagggaaggagagacagaaggggttgggggaaagagaaagagagagagagagagagagagaaggcagtagagagagtgcgaggcggagggggaagaagaaaaagagagagggcgagggagccagagagcaagagcgacagagccccagagagggagcgctccgctctggcagacagggcctcttctatcctacgttttcttttagaagctttatagttttggcttttacatttaggtttatatctcagattgggttttgtttgatatgtaagataggggtcaaggtttatttatttttttacttgtaaccctaggaagagttttttaaacatttattttttaaatttttatttattttttatttacacattattattgtacatatttatagagtacagtttggtgttttgatacatatctctgctgtataatgatccagtcagggtagtgtattcatcacgtgatacatttatcatttctttgtgataataaccttgaaaagcctctcttctagctattttgtgatatacagtgttttactgttaactagtgactctactgtgtgttagaacatcagaatttattcctcttatctaactgtaagtttgtacccactgactaacctttccccatcctccactttcccctccccgcctcagtctctagtaataattgctgtgctctattcctatgatatcaactttttttttcttttttttaaagattccacatatgagtgatgtcatgcggtatttgtctttctgtgtctggcttatttcacttaacatgatgtcttccaggttcattcatgttgtagcaaatgacagaatgtccatttttttaaaagttgaataatactacattgtgtacatttaccatattttctttatgcattcattccttgttggacagttaggttgatctcatatcttggctattgtaaatagtgctacagtaaacatgggaatgcagatacctcttcgacatactaatttcattttctttggatatatacccagtagtgcgattgctgggtcatatggtagttatttttttttccccctacacacagagtcttgttctatcttccaggctggagtgcagtgacacgatcatagctcactgccgcctcgaactcctgggctcaagccagcctcccatctcagccacccaagtagtgaggactacaggcatacaccaccatgcttggctaattgtaaacattttttgtagagatagtgtcttgctaatgttgcccagactggtctcatacttctgggcctaagtgatcctctggtcccggcctcccacacactgggattattggcatgagccactgtacctggccttaacttttaattttttaaagaacctccaaagtcaggccaggcacggtggctcacgcctgtaatcccaacagtttgggaggccgaggcaggcggatcacgaggtcaggagatcgagactatcctggctaacatggtgaaaccctgtctctactaaaaatacaaaaacaaaattagctgggcatggtggcaggcacctgtagtcccagctacttgggaggctgaggcgggagaatggcgtgaacccgggaggcagagcttgcagtgagctgagattgcgccactgcactccagcctcggcgacagagcaagactcatcttaaaaaaaaataaaaaaagaacctccaaagtctttttcataatggtgtactagtttataatcctaccagcagtataatagctgtcctaacaggaatgaggtggtatctcattgtggttttaattttcattttaaggttttttttttctctgtatatttatgcatctagttgctttacatcgcttgttgaaaatactaaagttgaattgccttgttcctcttccaaggcattttcattttcaagatcgttgttggcatgtaaatttcacgattaatttattttttcaaaaaaatctattgagattttgattaagattactttgaatctgcagatcaatatgagagacttgacatgttaacagtattcaggcttatctaaggagaatggtacagtatgtctctccactttttaaggtcttctctaatttttcttagccatgttttatagttttcagtgtagagatcttacatagctttagagttattcctaggtccctggtgttttttaatgttatagtattgattttttaagttttattttctagttgttgctaatatagaaatacaattgatgttaaagtattggctttgtattctgagaccttgctaaattcactagttggttttagtagtattttagtagatttcacagtgttttctatacatatgattatgtcatctgtgaacaatgacagttttacttcatccttgtgctttttatgtcttaatacattggctaggacctccggtacaaggttgaatggaagttgtggaagtggacatctttgccttgtttctgatcttaggaataaggatttaataatttaccattgagtatgatattagctgtagggtttttttaatgttctttaccaaactaagaaagtttctgtctattcctagtttgttgacagtttttatcattaataggttttgaattttgtcaaatgctttttctgtatcgagatgatacgggtttttattttgttaatatggtaaattatactgatttttaaaaggttaacctttcatatatagttggtcatgatgtgttaatccttttatgtattcttgtattgaatttgctaatattttgtggagaatgaatctatgttcataagggatgttgttctgtaattttcttttctcattatgttttagtaagttttttgtatcaatatgatgctgctggcctcatcagatgagttaggaagtattctcttcaactattttctgatagagtttatgtaagattggtgttgtgtcttccctaaatgtttgatagaattcactaatgaagccatttggacctggagctttcttttgggataggtttttaattgaaatttttatttcttttagtttggtaaattatgtttttaaagggtgcttctgtttcatctaatttgttgattttattgtcaaagttgtttataataatctttttatctttttaacatctataggatttgtagtaatgtttcattttcattcctagtattggtaatttgtgtttggtgttttttctcttttttccttgatcagccttgtgaagggtttaactgttttattaatcttttcaaataatactcttttggcttcatccttatagttaatatctttatcatatggtatttgatcagggaaggtagcctgtatgattttggtttgaatctgtttttatattttaaaaaaattttaaatgcatgtggtctaattcatgattaatcccccctcactttttcatgtcccataattatatgttcaaatcatctatgtccacactcaatttggtgacctttgatcttttttttttttgatctttttattttttaaagagagagggtcttgtgttacatagacgggagtacagtggtgtgatcatagctcatggtaacctcaaattcctgagctcaagccatcctcatgcctcatcctcctgagtagttagtactacaggtgtgtaccaccactcccagctaatttaaaaaaagttttttatagagatgggttgttgctgtgttgcccaggctggtcttgaactcctagcctcaatggatcctctcgtttcagcctcccaaagagctgggattacaggtgtaacaccatgcccaactgttttgatcttttgatttctgagaggatgttagtttccaattgtgattgtggatttgtgtgtttctttttgcctttttgtccgttggtttttgctttctatatttgaagcccttttttttttcagttgtactactgtatcttcttgtgttttttattaatatgaactcattagtaaattttatattaatacatttagtatgaaatcctttcaacttgagtcctagtttgtctcatgtcagtactgcctcatgtaattttcttctttttatttatctgacatatatttctaagtaaacagcacctatctagactagactaagacccagacgtaagaaaaaaggcaaatttaaattatttacaatttttcctctaacccctttctccagcaccaccaatcctccattcctggatatttgctaacactcctgccagcagggagaggcttttgcagaagggtctgcatttctgtctctgctttcagtatcttttttaggataaataaaagcagtgctacccagctagtgctgtggatggcaagccacccaggtgccggggcaagagactgaaggcacaagctgttccagtataataaagaaaatatatagaacaagaatagttatactagaaatagaatatagatatgattatatatgaatatgattaatcattagtttgtagcattactctttattccaatattataataatctctgttctacaattacaacctagaaaaaaccaggccatacagagataggagctgaagggacatggtgagaagtgaccagaagacaagagtgtgagccctctgtcaagcccggatagggccactagagggctccttggtctagcggtaacgccagtgcctgggaaggcacccgttacttagcagaccttggtctagtggtagcgccagtgcctgggaaggcacctgttacttagcagaccaggaaagggactctccctttccccgggggagttagagaagactctgctccaccacctcttgtggaaggcctgacatgagtcaggcccgcccgcagccatctggaggcctaaacgtctccctgcgatgctatgctttagcaatcacgttcctggtccactttcatgttccatcctgtacacctggctctgccttctaggtagcagtagcagaattaaagtattaaaatctttgatctctccgagaaatgcatagaagaaataatgacataagctgccccctctctctctccacctcagctaccaaatagggaagggctggccccctgtccgtcggacacgtgacttatgtgaccttacctatcattggagatgactcacactccttaccctgcccccttgccttgtatacaataaataacagcacagccaggcattcagggccactaccggtctccacatcttggtggtagtggtcccccaggcccagctgccttttttctatttctttgtcttttgtctttatttctacgatctctgggctccgcacacaaggagaaaaacccacaggccctgtagggttggaccctacaagttcagcagctttcccctatgtggcgtgccttaaatttcatttctgcattaatgattttattacacctagttcagaaacgagaaaactaattttacaggataaatacctgtaggagagtgatttgtttctaggtctatattcttaggaggtatgagatctccatcttgacctctctgcatactgtgaggtttcagaccccatagtgccggctcagtaaatgtgaaatttgcattttggctgttctcctcagtatctttccccctctaacttgtggaatatatatgtcatgtattactagagggacacctggatagaactttaaataacagtaaatcaattcaagagaaagttactccctgctcttagtctttcagttccttggatgatcatggagaaatcctctgtgtgatttttttttttttttttacatttctcaaacacttgattatacctccctcctccctttttataaacaatgagctaggctcaagttcactgccttcttggtaggcaccagaattgagctagaatttagtacatttgtttttcttttgtttttttgataactctttttttaacagtaactgttgatttgccactgaaaagtagtgattaaattttgccttaaaaatttttattttaacaaattaaataagttttaaagaaaaatattaaatacaggcaggataaaagggtgtgacaaaattgagatcctgatacgtatggaagattgtatgtgccctggctgagaaggtggtatgggagtgagtgaaacttcggagtcacttctccggcattccaggcttttcatttatttttgttttgtctatagtactaacctcttggttaacaagcatttatgttttgtgcagagagctgtgtcctgcagataccatgaaaaacatagtgttcttccctttgtagtcttggtagggaagacagcatgtgcctgcaaaacacctggtgcaagtgtgtaccatggtaaatgctatcagaacagcaaggaccttgtgttgtcagaggaggtggaggtcatctctggctggaggcttgaggcttggctcaggcttatgttttatccgaggggcctttctccctttcattttgaatctcccttcctaagtctacgtaaattttttggggaaggggcatttctttgtagctgttcctctaagaagcactgtgtccagaagaaagagcatcacactggccctcagaagacagagtggctcccagagttctatctagttctagcacacctgttttcagctggataactgcttaattgtttcaagtctcaatttcttcatctttcttggtgatgataaaaccccgtgtcttttttgcttcataaggcagcccatgttagggccatttgtgatgttcatttgcttatcaatattatcttcactctatttgtatttgaaatactgatagggatgattttgagaatattttaagtgtttaattatttttttcctatttttttctaggtcttgatgcagaactttattatgtgagaaatgaccttattagtcactacgctctatcctttagtctgttagtacccagtgagacaaatttcctgcacttcacctggcatgcgaagtccaaggtaagagagtggctaaccacagacatcatgacagggtcacccagccacagaggcaagggctgtgtttgaggactgggctgctgtctgtactgaagggtccgctggtgatgtgatataatagtactgagtcttttcagatttatatttcaaatatttggcctattcctctaaaatttcttgaatcctttaaaacgaaggtggctatcatttaattgattagcacatgacacaacacttaacatccttttaggctcttcaaacagagatccagacctagcttgaaaagggtacagttggacccaataatgcctgtgctgctgtggtgaaaggagatgggtgtaggggtggagattggtaagataggctttttagacatgttggacagaatggatacagttctcccactcatggagaaacggtgtaagaaaggtacagcagatgcagcccccatgtgtcctgtggtgaggcttctttacccataagggctaaacccaatcacttaagaatctcttgcctgggctacttgttgctgaattcttcacattgcctctgactgcctgggtccctcaaacatggtaagttttctcctaagtcaaagagtcggaggctgagcatggaggtgcctcctgtacccaaccaacttcagtttcttttatcagctttatataggcttttgaataggattttattcaggaaataaaaatagtcttgctactataaataagaatacctattgtagagtttttaaaaaaagtattatagagtagtgtctgtcataatatttgctccaagttatttaaattggccactttaatatagatttttaaaaatcttcatttttttctacttagaaaacaacagtgattattgggaaaatttaaatattacagaaatgttttaagaactgtaagactaggcctggcgtggtagctcacacctgtaatcccagcactttgggagattgagacaggtggatcacaaggtcaggagatcgagaccatcttggccaacatggtgaaaccccatctctactaaaaatacgaaaattagcgaggtgtggtggcacacacctgtattcccagctactcaggaggctgaggcaggagaatcacttgaacccgggaggcggaggttgcagtgagccgagatcgcaccactgcactccatcctgggagacagagtgagactctgtctcaaaaaaaaaaaaaaaaaaaaaaaaaagaaaaagaactgttaagactttgtagttctatactcagaagtaattgtttatagtttggtataacttcttcaaagtccccttttttccctttttaaacaaaaaagggatttttagacatgtatgttgaacagtactttttcccctacagaataacttatctaggcatctttctttttctctcactcattctctttagtggttttataatatgagattgtatggatgtatgctatattgctatctgtgaagtacctcgttgatgggacacatggatttttaatagcattttattatttcaaacaatgcttcccttcaccattacacagtttccctcatttcattttataggcaaaatccaggtaatgggatgatgaaaacaattggtagttcatcttttattgatgtttctacctttgctatttcttttatttaaaaatttttcaatctttgcttttgatgaatatagaaacacagaaaaaaatgtgtgttaatgtgtatccctgtgtgtgtatatgtacatatatatgtgtgtgtatgtatataaatatgttaagaacatctttgttcagaagtttttgtgcacttgtggccttatttctgaatagtaaattactgctgagaagtcaagtggctaggccaatgtgtgtgtctttaaaactttgaaagatactgccagatgtaccagtgaataagtgcttatttttgaccttcattttctaataccaacattttaagtatacttgtttgccttccagtctccctctccctccccctccccatacgtcagtgagtattttctaagaaaaagggcattctttatacaaccaaaatacaatgatcaaaaccagaaaatttgacattattatgttattatctaatccacagtagtcacattttatcaattatcacaacaatgttcttcatagctaattttttactagttgatgtctcttagttccctatcagtctggaacagttccgtagcctttctttgtgttttttgaccttaacatttttgaaacttacaggccagtaattttgtagaatgcccctcagtttgtgttgtctgaggtttcttcatgattagattcaggaatatctctttggcagtgataccacaaaggtgctgtccttcccagtgcacaaggtgccaatttgtcccatgactggtggtggtaactccgaacactcttgtcaccagatttctcccctgtcaagttttttactttatatatagttagtaagtaatttgtggggagataatttgaaactatcttttaaaaaaatctcattcctcatcatcctttcaaccactactttttgcatctgtttttggaactagtttcgtatttcagcctgtggtgtggtgagggtagtgtgtttcctctcactggaagaggtcagacctacactggataaccattcaataaggctgttatagaaggaattcaagtatttgtggagtggttgttactgaattttaagttcccttgcaactctgaggtccagtgtttctatgaacatctttcaggcagagaagcttcttatattctccaaaaagttgatagctaattctttgttgttattcttacctttgatgttgatacatataaaaacaaataataaatgtatttcaaaatggtgaaaggtttattagagaattctgttctaggtacttctattgactttgaacagagtgtgaatatttctgggcacacttaggaaaaaagaatgctgatatgagaaggtttcctgggcaagtgtatgggtagtgatttgtgagtacaaaggcaatgtgggaagtggcagtcaggactgaacaaaataaaaccttcttttactgattcctttaaaacagttaaaatacaccgtttgttatttggaatgagctcagggccctgatgttgctggtaatgggtgtctgagtcttaggagcctgttacagggggaagttggagtgggagagagcaggtaggaggggctcgggtgaatatatatgtttgaaggggaagcagtgttagcatggtacattttgggttaggagaagccttggtatagctgtaactgtactcccatatcattcacattattttatagagcataatttctaagttacctctttggcaggtataaatattattagtgcacatttgggctgccactgctggtatgatattctttgtgaggcagaagtttcctgattttttttggagggtatgactattttcatgtctaggccagaaatgtagaagggatcctagtttccttctcctatactttctaaatctagttgattctctctaataattacatcttaaatttgtttcctacctctcttgtgacccaatgcctcacacttagtttgggccttcattgtttcttgctggattcggaagtggtcttctaactggtctcctttcctctggactgacctcttgttgcaccctccacaaagccaccttaggcttctctgttgctactggaataaagctcttgatttcgtaggaggcctttatgatctggtctcggcctttcttttctgcctcctatctagccagtcatttagtgtcatttttgtctgtcttggaatttcatgaatgccctgtgacctgtcacagtgctgctgtttgccacaaatgccgttttttcattctttacctgaataactcctgtttacctcataaagctgtgacctgttgtcacctcttctccagctgtgtcaggtgcccttttctgtctgcacagtgcccttctctctcatagccctagttatactttaagaatattgtaatagttgattttcttttctttctccctcctacttgctgagcaccttaaagggtatcctctgtgcttggtatagcacgtggtactaactgcagaagagatgtgcaggtagaagccacagggcccagctcaacaaatggggagcttctgagcagttagggcttttcagagttgggatgtgcggctttaggagtggtgacttttctatttctggaagtgtgaaaacatataggctgggtacactcgacagtagttgcacaaatgggatttttcagatattttactcataatagagtgaggttataagtttggaaaaatgagtgggttgaatataaacctaaactgatttcacaagttcatctgtaacaggtataaaatttagaggaaagtaaccgtcttacgatgtttttttagtaaaaaactaaggaaatatgtctgtgttaatctagtttcaggcttcagccactattgcagttcccaattctaggtaataatctctggtgattttagcacagttgattacgtttatttattttaaaaattaatcttatgagtagataatatatgcacatagtaaaaatttaaaaagcataaagggtatacagtgaaaaataagtcccttgcaccttctagtaccatccctgagcaatccagccacttagttccccttgcctgagtcagccactgttgcctgattattgtctttcctttggaaatagttcgtgtgtatataagcttccatgcatatatgtatatatacatctttcaacagctaacataccacctacttttctgcagtttgcagagcactgaacaatatcctggtcaaggatctctgtcacttgatacagagttgtactttttcccccttcaaatggctgtattacttattattatatagttgtactttggttattgatcagttcctgtgaggaaattaagacccagatttggaaagggatttgcttaaggtaggagaagtagggttagaggaagcagaaggtagagatgacctgaaatgggaaagtcacacgtgagggcaggggaggcttgatgaagggtttgtcacctgatcatttaaccctgaggtgtaatcatgaactttcagaaggagggccgtggctctcaagctctaatactttatcagaaaccctcggttcttgctttttaaggtttgccagaagatgaaatatttgcttccagagatctgcaggctccctgatatgtgtcggttcaacatcgtagatactttaacattagtttcacatatcacagcttctggtaatactgtttctcagtgttttcgccattttgtcttgccacacagattgtggtctcttcagaggcttgaagctgtcttactcttagcgcataggtcacacatgccttagtgagtggtcaggaaagaccattgtgttaattgcattttgagttgggagtagaactctggtattgcttctttttcacaagaccacacacttaaaagcaggctactgagaggctttaacagatagtttcttctgtattccagaacattccccaatatccaggagaaacatgtaactgtgtctgttaagtgtcagtagctttttttttttttttttttttttttttttgagacagagtctcactctgtcgcccaggctggagtgcagtggcgctttctctgctcactgcaacctccacctcctgggttcacaccattctcctgcctcagcctcctgaatagctgggtcaacaggcgcccgctaccatgcccagctaagttttttgtatttttagtagagacagggtttcactgtgttagccaggatggtctcaatttcctcacatcgtgatccacccgcctcagcctcccaaagtgctggcattacaggcatgagccaccgcgcctggccgtcagtagctattttagatatctgaaaagcgaaaatttgccagaatgtagcagaatattcccactacccacccttaccccatggctgttctgtgctttcaggaattcgtcatcattttctaggagttgcagggaacttgtccagagttccagcaggcactgctggaggccagcagctgtgtcctttgcagagtgaggtttctatgagaaaggcattacttctagtaagttcagagaaattaaaaggctatttggctgtagacaagtgtattcactttaaatctgtactctctgtgttccagaaggaaatggctttacttaccagcttcctatttgtaattgccatttgtttccaagtaagggaacataagcaaaaatgtttatttttcagtttattcaaatgttgatatttttggtaatttgtttctttttttttcctttccttttattttctttttctttttctttttttttttgagactgagtctcactctgtcacccacactggcgtgcagtggtgcgatcttggctcactacatcctccgccccccaggttcaagtgattctcctgccttagcctccgagtagccgagtagcatgtgcccaccaccatgcccacctaatttttgtatttttagtagagacggggttttaccgtgttggccaggctggtcttgaactcctggcctcaagtgatccacctgcattgacctcccagaatgctgggattacaggtgtgagccaccacgcctagcctgtagtttcttttctgaagtattttggctcactctacattctgataaacaactgctgttcaaatttctttgtcccagtagactgtacatttaacttttgagcagatctgtttctttaaaggatgattggcaagtgagagtccttacagatcgatacatgccaaactagagaaaattggacttcaataattggcaatttcttctctaatcccagaaactgcagttttaaaatttatatcttaaagactgcagagggaaaagagaactaccttgtgaatgcctcccatttttagacagttcctcaaaaaaggagccagcaaggaggcttccacagtttcatgcttcatattcctctaagctgctgataggaccaaaggggctgccttctcaaatctcctcctcagccctttgcacctctccctgtgccctcattggccagctacactcacagcctcatttccttcccttctctcctccttttcaccttgccacactgagatgctcaggcgccagtcttagctgcttttttaactgcagttatggccctggacccctttgccaggccctctctgcttactttggggttctggtctctggtctgctccttctctccttgtgataactgagacctagaataaaggagacagcaagtttctggggaaatagtaagtgtggctttgaatttgttaagttggaaggctgtaggataattagatagaattgcctagtaggtaattggacacttgagagggattgaaggtaaaagagagtgagagaaattgacgattaagatatcccatcagtggtgaaatgggctagaaccctagtgtactaggattgaaggatttacatttggagaggaaaatggacctttccttgggactagaatgaaaagaatagatgctctaatagatctgccggggtgttgaaaagaaaggcagaaatggggttcctctgtactagtggaaagggacaaaaacattgagtgtgaggaggtggggaaggcctgtaaggttggaataagacgagggaaaagagggtcagtgaggaagggattgctgagtagaactaagggcctcccctgagactggaggtcattgttgtgtaagagctccttttctgtaggatggatttccttcagcagtgctgagcagcaggagtagagtaagaaggggtggtcaggatgctagagctgccctttgagggtttggaaggagtcaaccagctgaaggtgccaatatgactgtcagtaatgttgccttctttagggcttgggctgtggagaacatgaaactaggtgttcacggctatactggagagaagggaagtggctttaactggctgctgcatcctgctatgaacacagcacctggctcataaatgtgcctcataaatgttggctgacttggagtgatggaatcagagaactagttttgtaggaatcagaggtggtgatgggatctttgatagaatggcatttttgcatttgttttggtagtgaagtaattctttagcgtgtcaggatattgaatactgaatattgaagccagggagaacatggcaggagaccaaggcctctgcaagtcctgtgtggcttattggtgttgatggcatgagaagtagccattatgagtagaagctgtgagcttcggccgggcgcggtggctcacacctgtaatctcagcaatgtgggaggccaagacaggtggatcacttggggccaggagttcgagaccatcctggccaacatggtgaaatctcgtctctactaaaaatacaaaaattagctgggcatagtggcgtgtgcctgtagtcccaccagctactcgggaggctgaggcaggagaatcgcttgaacccaggaggtggaggttgcagcgagccgatatcacgccactgcactccagcctgggtgacagagtgagactcggtctcaaaaaaagaagttataaacttcaaagtagaggggatttgcatgagggcatgaggaagggatgtctgggaaggacctagtgatcctaaagagtgccgaccctactgtctaggccctgagggtcaggtgttgtaggaactgaatgataggaaggggaacagatgacttctgaggaaagccaggttgtgggagaaggtgggaagacatttgtgaagaggcagagagtgtaggaggctgttctgaatagggaggttctcagaatggggaaaaaacagaaggcctgcaacagtgttcttgacagacccaggagggtttgtgtcagaatccctggggccagcagtgggctgatgattatggagaagtgcagcatggcaataaggtagctgttctggaatgactgctgatgctgctgatgtcagaggagacttgtgccaggctaacagtatgtattgcattaatgatcttatttgatcctcataacatgtattacccttattttacaaaatatggaaactcagagaagttacaaatttacctaagagtcacatggtctcatggttccaaacccagttcttgctggcggtgctgatttcttttgtgcacctacccttcatgtatggtcctgttcagagatagcatcggtgtagggatgtataatgcattctttgatgtattgctggagagcttgctcattccctgcccaaacttgcttggctgtggctctctagcaccccctggtggcagcaatggtattgtgatatgctaaggtgaatgtgaacacttcctagccaaggtacctcgaagtcactgatgtgctgcagcaagaacatttcctttgttgggaatgtggcacttatcaaacacagcctttaacagttgtttacgtacctatcttaactgcaaaggaagagtttaatgtttgcatacccctacagtgtttagctaagacactttaaatagagtgtgaaaggagaaaccccaaggggaatcaaattctggactgagcccttcttattcatgggtaacaacgccttccaccttagcccaagcgtaagggccatcccttcccttatatctgggatgatactctttccctcttttctttcatctttattatgtaccatttcgttagcttttttcactagcatatatacatatttgaatatctcatctaaaaacaaagaaaagctttggaacaccccccacttcaccatctgtctcccattcttctagttaagtttcttgaagaatggtttatcgaacatctttcttctcactcttttcccaacctgctgcctcgtggctctgcaaatctcagtctgccaccaatgataccttttgtgaccactgaatgagagagggataccatagttatcaagaacctgtgggcagggcagagagtgatgtgaactgtagggcttcattgaaagtcttgatgctggcagccattctgaatttcagctattgctttgcagtttgagctgcttctttcatgaactctccatagcaacagagccttaattattgatgctgattggttctgttaagccacattgggtaggccaagtattgatagataacattggtgttttagagacatctcatgggttgcctgtcttcccttctggattctgaatcacttaagaagtagatccagaggtcaaatggggatctaaacatgaactttctttttggtgagagcaagactagaggatgtgacttagatattctatgagaaatctaccttggaatctgcttattgtgtgagtgggtctgcagagcagaccttcctccaccagccacaaggaggccctccgagcttggctttcatttatcaaccagagaaggcattggtagctatttatggtctgtcagttacatatctcaccgctttggttcttcatatctggctctccatggcctctctgtcagtgctgcatagttctcagcaggatttctgaccctagatggcaggttttatggaagagtggtggtcctgttgtggacttaaaatagagggtggcttacttggttgaatttttatccaattgaaaattcttaggactgtttctgacaatttgcatttttttatagctagattatttgtacatatgaaaggctcatccattgattaatgagccaattaatgaagtcaagctgatagtatccttcttgttatcacaggtccattttgtttatttttgtctattttacaggttgaatataagctgggattccaagtggacaatgttttggcaatggatatgccccaggtcaacatttctgttcagggggaagttccacgcactttatcaggtaagtaagagtcttcaaagacagagttaacatactttttcaactgcatcccctatggccccaaaacagaagtttactgatgtgtagtgtgtattacttgataggcataagatgtatgagtactgtgaaaagtaatttttgtaaatatttgcactgtgttcttaaaccattctctcttttctgtccttctggaactctctgtgctccgccctccctgtctctttttctgcattgctggtacttacctccacatgagtccctgtgcctgatcttgtttccctttgattaggcaccacatttcaccctgtggcccagatgatctttgcacggtcatgtttgaccctgtgacgtgaagcccatcagtgctctccactcccatcaactgaacattccagactcaccaccttgtgtcctggatcctttaccatctgcccctgcctgcctgtctagccttgttgctgcacttgccccagagttgtagcagttccagactacatgcagttctgatcttcaagcctttgcatgtgctggtctcagtatttgggatcatcttttcctctttctgctcgtgaactcctttctattcatcctactcattctgcaagactcaagatctgcactgtcttttttctgccaccttctcttctttcatttgttaacttctattcttcctaccccttagaaccttatatttaactgtttttgcactgattacatatctagcaattcccttgatgcatagcatagagtatggtgcaggataggcactcagtacagtctgagtaaatgaataagtgtattatttacaccaatttaactgcttttgagctaacttcttaggctcttgaagttgtggtatttgtaagaaatggatatttttaaaaattgaaagtatcagccacaatagtgttgtgaaactttttctggcagtcatattcactgttatcagtgacatacattaagcttaaataaagcacaggagggctgcttaaatttttatgggcagtaaaggaatttagaaatgcccatatctttaatgcagtcatacagatggtagaatgataggttttaaatttgtaggaaaagaatcttaaagattggggaaaaaaattatatgcactgaagtctgttatcccattgttacaattatggattaaaatcaatttctgttgagaaaggtgatagctgacaatttatcagattcatttacaggtttatatttaatctttttattaagagcagacatacttgcattttggtagtgagttgtctttccatttgatcatgtaatttctgttgttactattgctgatgtgtctgttaaggtttgccttatgatccttcagttttagtgtactggaatagcaggacttatgagacaaagtggtgtattaaaaacaatgagcagaagttgaaaacaattatctcttcattgatgtcttggtttgttctttaatactaacttttatatccataatgaattaaatgcttaatgtctagaggtgtggtagtctgaagatctctaaaaacttttgtttagttactttatttaaatgtattacttttagttttcttgcagcaaaaataagtaattctaaaatgtttaaaagaatcattttggggcattaatgttgatttttagaaaatgtaaaatatttttcttatcttttttaaacagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaagtaaggaatttatttaccaaaatatgttttacatgtatgtgagaaggtgaaaaatagagtttgttgttttttcacagatttaagtatgtccaactcatgattatagttgcaagtgagaaaagagcactggcaggtgaagttttgagataatcccagatggttggtagccaagaatctcactcaggcctcattcagtccatgctttctcaaatcttttgtcagaattgctaagatgttttccattaggaatagtgctaaaatggttgaagaggtaaagaaataagaaaaatctgttgggacttctgagtaactatgttaactgtgtttcccttatcaagttacttttatgcagaagcattgctctcgggtgagatagacctgggttggaatggcagctctgctcttttcaggatattgatacaagttacttaacctctctgaggcttagttttttcatctgtaaaatgggcataatacctgtttcagaggtttgttgttttttacggttcattaaatctagcctaaaacttagaataccgtatgtgggtacttagcaaagttagttctttttggttttgaattatctgttactgaagaaatcgagtggatatgaaagagttccagcatgctaggtcataaatcaaagaattttagagttctccttacaagtttagtccaacccactcactgtaagttccacaaagctacagtgacccaaatttacaaggtcacgtaggtagaattggttagtatctaagatgggggggggaaatatactttaaaaaaacctcgcaaaccctcagtgcttactgtgttctaagtgcttgataggtattacacctgtttaatccctacagcaaccctaggcaatgggttctctcattgtcttcattttcagaaaaggaagctgagcttcagagaatctagcttgtcaagatcagatagctaagtggtgcagctaggatgcagacctgttctctcagcctctttgttaaactttcttttaataaatttcccaattgaaatcagtgctgagtgttatgaaaacacctaaggccaacaagtgagttgaattggctaatgtctgggtacatgccaataaaaaagctgcactacatttgaatagacattttaagaaagaagagttagcatctttcagctttagtgttttggtacaattttcagttctactatattcagttatataccaacttccatgtaatgttaaagacaaaggagatttcagagactctctactccaatgtagtcattatatatttgatataaggagattggacccttggccacctaggctaccacagctagccagtgaggagtgtaaaacattcagttccttatcctcagagagatgggcatgactgtaccatggtgcttcatctgttactcttaagtaaggcagaatgataaccagacatggtgtggcctctggatcccaccagtgctaatatctgctaaggttaatgatcagctgatactcaaaatggtcacatactttctccattttctttaatatgtgtgtgaaattaacattaaaattctgtgttggagtaattttctattctgttttagacttaagtttttctctggccctctgtatttgttggtcatggttttggccaccctagtcatccagttcaggctcatgactcttactttattatgtgatcctaatgtatttatttatctggttttccagcctactatatttcaaaaactgtctgcaacagaaaacatctgtactatatggaatgttagtaggtgttactagcaagaaaagtttcttttatcatatgaggatgggaattatgggttagacaagttttgtgaccccataactcctttcagtctttatattctaatgttcactgtgaagctccaaagagacactatagtatgtggcttttcccaaacttcttgatcataggaacattttcactgagcatctagaagtaacaccctttggctaacagtggtatagactattgattggtgactgtagtggtgattatcagaatagtaacatagctttcattatctcgcaacacatacctgttgctgagttccagcaatgttctgataattatagtaattaaggattttcatggaaaagagaatttctaaagcatcatttttctcctttaaattcagaacttgaagaagtaaaaacttcagccttggacaaaaacactagcagaactatttgtaagtgttactgtattatctttatccattattagaaatgaaaaatggttgactgcatataaacatgattgcatgaagcttggaggcctcatggtatcaaatgataatgacaccatgctgttattttgctggtgctttgtagactggtggataggtcatgaaactgttagaatattgaatattttgagaactaaaatttatacgtattttgtaacgagtaagctaaaaagttttacaagcaagaatatcatatatttttgagtagtcataattaaagtatgaccatgaaatatgtgtaagatgtttattagcagagggttagaaaatctggcttgcagtctggacctaatcttaagctaatttcatccaggtgaaggtgtaagcttaaagatattatgttacttaaacctacagagcaggtatgcaaagtagatttttattttttggtatcggttgtgtttagatattattacaaacttcttttttttttctgacatgaagacatcgttgggtcttactcttcttgcggtagtgttaatagcagtatcttaaaaggatactagattctcttcatgcaagtagactttaaaaaattggttttgaaaacttcaagtatataaaagttcagagtacgctttgatgaactcccatgtgcccatcccccagcctcagtaatgatcaacactttgccattgttcttccattgattccctccttttgtggttggttaggggtggaggagagtattttcaggcacatcccaggcatcagattatttcacccataaatatttcagtgtagatctcctttaaaagggcctttaaaaaacccccacaatcacctaatacctattcattttgatttatcacatataacaaaattaacagcagttgcttagtatctccaatagatagtccatgttcaaattaacccgattgtctttaaaatgtctttttttcctcctgaatcaagatccaaatgaagcctacacaactgttgggtgatatatgttttgtattaatcagaaaccaccaacccttttattaatattatttatttattgaagaaattatgtcatttgtcccatagaatttcccacattctgcatcttcctgaaatcattgaacatgtttgtttgtttgtttttctgtaaactggcagatagattttgcacttgattagatttagaaccaactcttttggtaagaatagtccatagatggtaggtactctgtgctgcctattttgtcttttcatcaccttgggaggcacagagtatctggatgtcccaaaggggaatttttttgcctgtaaaataatgtgacatatcgtctacttgctggaatatttctgaaaagaaagaaaaaacattaaaaaaaatgtcactgttgccaaagtttacttttaaaattctggtgactttgcccatttcttttatgctagtaggatattacttctcacaaagagcagtactgcatattcttggcctctgtctgtgtcttccttgctgcctctcatcttcccgccctttctatttattcatccacccagtacctatggagagtctgtggtgtgttaggcggtatgactgaagcagaggactaaactgtgagcaaagagatcctttcctcgggggtttataatgtagtgggagaaatagacgaggcaatataggcaatgataccaacatagcatggcaagctatgataaggcaagcacaggggatttgggaacccaaggatagcttcctgagaacagtgacagctcttctgagagctgaagggtgaccagatggtggcaaatgaaggatgaatgagggaatgggaaaaatgcataggaaagcctggaatttggaggtaattgagcagggcgcatctagggggatctgcccagcagagccgtatccttggctctgctctggaaagtgcttggacagtactgctaacatatgcctccagaattcagaatttttttctgtccctcccaagattgaatagctttcctgtggcataaggtaattcttgatgaaagtcatgccttcattcaggctacagccaagtctagctgccctagaagtcatttggtctctacgttaatctgttctgatttattgtttgttgataggaaggttaaattttagaaaagttttatttttcttatttccatgtgtttttgaaagctgtaagttttatcttttatcctgacctatccccagaactccaaacttgtatatctgtcagtttaacgtctgtgcatggagatatgaggtacctagttagtagactaggtactccaaatttaacttgggcaaaactcttgattttcacatccccaacctgcttatttttatctttgtaaagttacccttatccaagttattgcttgagccaaaacttttcattcttctttttctttctactttggtacaatccattagtaaggtatgttgactgtgttcccaaatccacttacttctcatcttcactgtgacactcttgtccaagccagtgctgtctctctgaattactctggtaaccttctaacttgttccctgcttctgctcttgctcccctacacggcattcttcacacatcatgcagtcattttttgttaagtgaccgtgtgaaattgctttgcttgaaaccttgcaatgatcccccatctcacttaggataaaccccaaatgcctcaagttttgttcagtagagttatgatgtgagtactcgtgatcaaatctttcatgaatctccagtcacaccagttctacttctgtttgcatcttccactctgcctgcttatgtcatttgtatcttgctgtgtgttttttctcagtttgcttctgcgtgtgtgtgtgtgtgtgtgtgtgtgtgtgtgtgtgtggctgtggctgtgtcattgggttattttccctgttgctgaggctttctttttgtctctcttatttatatatttatttatttgttaattatttttgagacggagtcttgctttgtcacccaggctggagtgcagtggtgtgattttggctcactgcaacctctgcctcccgggttcaagtgattctcctgcctcagcctctcgagtagctgggactacaggtgcgcaccaccatacacggctaatttttgtatttttttttcagtagagatggggtttcactatgttggtcaggctggtctcaaactcctgacctcaagggatcacccacctcagcctcccaaagcgctgggattacaggtgtgagccacggcacccagcttgcctctctttttaaaataatataaagctgagtatcattttatttaatgaatagagcctttaaaaacagaaaagcaaaacaatttctgttgtactctcaaaaaagaataaatgtttttataaacttgtggacccttctgtcactcagtcttctgtgagtcagtggtccctggcaacaaaatgatgtctgattcctctaacccaaacattgttgttgaagaaatatgaagaatatatagatctgcactgtctagtatggtaactgctagccacatgtggctttttaactttaattacagtgaagtaaaattaaaacatcagttcctcagttttactaactacatttcagtagctttagttgtacttatatttgaatgcttaatagccacaggtgaccagtggctactgtattggacagtactctagagaacattttcgtcactgcagaaagttctgttggacagcactgctgtagtatattttatgcactggtatgttttatgtataccacttgtgagtgactgttatactcattagccaaaaattctatttaaaatcttttttctttcttttttttaatctttgtaaaggtacccttatccaagttattgcttaagccaaaacttttcattcttctttttctttctactttggtacaatccattagtaaggtctgttgacttttgtattaatcagaaaccaccaacccttttattaattttatttattgaagaaattataccatttgtcccatagactttcccacattctgcatcttcctgaaatcattgaacattttttttttctgtaaactggcaggtagattttgcacttgattagatttagaaccaactcttttggtaagaatagtccatagatggtctgtcgcccacgctggagtacagtggagcgatctcggctcactgcaacctctgcctcccaggtgcaagcgattctcatgcctcagcctcctgagtagctaggattacaggtgcctgccaccatgcccagctaattttcgtacttttagtagaggcggggtttcaccatattggccagggtggtctcaaactcctgacctcaaggtgatccacctgccttggcctcccgaagtgctgggattacaggcgtgagccatcacacctggcctaaaatattttttttaaactacaacaaaaacatcaaaaaaattatgtgaacttccaccaatatgctactggtaactgatcttacaaagaatgggcacatgaaaagaacagaatacttatttatgtatattgggtcacaaagcagtcatatttgtttaaaaagctaaatgtgctttttgtttttatttcagatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacaggtattgtacatattttgggaaagaaaaaaaatgaaagcagttatttgtatatatgtgggagcccatacacatcgatgcacagtggtgcagggaaaggagggaggatgattaagccccagccaaaggaaaaataagatgacctaatcactgtctctggtttctctgattttatttttattttttaaaaattaagaagtcagaaattagttttttagttgttgaggaagaagtggagaacaagtagttttttctattccctttgacatgactctacctcagaccattgccttttcaaaatagccctgtttcttccttctagatcttgccttcatcattctccctttctctcttcctccctccatccatccagtaaacatgtattgagcacctgctctgatttaaaccattggttctcaacctggttacacattagagtcaaggagaagctttgaaaacatactggtatttgggtccaccttccagagattttgatgcagttggtttgtggtagtatttggggatcagtatttttcataaagcttcctggatgattctaatgtacagccagtttgagatatactgggttagatactatgctaagtgctgggaacagaaagaaagaatgatatactttatagtttcaagattttaatcttttacattaacctgtaattataaaagtatgtaatttgatgactgtgatatgtatagtaaagtgtgtgaatacaaaaggtgcttgtccagcctcagtgagtcagagatgacaaggaggacattatagtcaagttagggtgagaggtacagatggaatgataggtttattttcataacaaacacttcttacttccctcctctgtgatttccagttgctgcctgaagacatgccccagctttgtgacttctttgaaagccctcctttatgtggagacgtatcatccatactctttgaaccttttctcctcttattgctgtatccttacttgcgctccagtcaaatgatcacttattcctcactttcgccccacactttgcccttcaggacttttgttcatgctttcttcttcccacaagcctccatgcattttccaccagtccaaacttggtccgttcttcaaattccagctccattgctgtctctttcatgaagtcttttctaagcctcccaaacacccctttctctttgtctctgtctctgtctctctctctctcgtagcagttattgcactttttcttctataattttttgtgtaattgtcttacctttagaatgtaagctttttccagttagggagcagtgtgtcttactcattgttgagtcaccagtcctaattagtcttaacatgcagctgggaagcatatttgtggcgtaagaatatgaaggggaagggagctggttggattcaatacctgccccttagtactctttgtccccactgttttattttccatttctgtgtggagaaagaagagaaaagggatacgaatgagaaggaagtacgtatatgatttgtttcagaatatgttttgtgtacatgatggtggtgaagttaggtttagattttacaggggaagaaatggcatttggaagcgattgagggaacattttgataggactttgagagaggatacaggtagagaggtgactgaagagcatgacatttggaagtcagtcttgatatagccagagagttgcgttttccttgaatgcttgcatgcgtgctagggctgtgagcccacataggccagaattttgcaataactttcagattccatggggcatctacctctgcctgctgaaataattagttaccatccatgaattggtgttccagttctctttagttttcaggcaaaagtttccagacattacctgagtaaaaccagcttatattatcacgttttcagagcatagtctagtggtcaagagtacggactctagagccagaccatctctgtttgaagcctggctattctgtttactagttttatgggctacatggattaagttatatagcctatgtgtgtctcagttctcctctgtaaagcagaaatacacacctagtaggtatgttgtgaggttttaatgaaatacagtaagctcttaaaacagagccctacgtatagtaaatggcattttatgaagtttttaataaagttgcaatatgctagtatgtccagaattggttccttctggtgggttcttggtcttgctgacttcaagaatgaagccgcggactctcgcggtgagtgttacagttcttaaagatggtgtgtctggagtttgttccttcagatgttcagatgtgtccggagtttcttcccttctggtgggttcatggtctcactgacttcaggagtgaagccgcagaccttcgcagtgagtgttatagctcttaaaggtggtgcatccggagtggttcgttcctcctggtgggttcgtggtctcactggctttaggagtgaagctgcagaccttcgcagtgttacagctcataaaggtagtgcggacccaaagagtgagcagcagcaagatttattgtgaagagcgaaagaacaaagcttccacagcgtggaaggggacccaagcaggttgccgctgctggcttgggtggcctgctttttttcccttatttggccccacccacatcctgctgattggtccattttacagagagctgattggcccattttacagagtggtgattggtccgttttacagagtgctgattggtctgtttttacagagtgctgattggtgcgtttacaaacctttagctagacagaaaagttctcaaagtcccctacctgattagctagacacagaccactgattggtgcgtttacaaacctttagctagacacagagtgccgtttggtgcatttacaatcctttagctagacagaaaagttgtccaagtccccacccgacccagaagcccagccagcttcacctctcactagtagtgatggacaaagttcttctgccctttcctgtcctattaacaattatttattacctgccaggcaagctaacagtggtgaccagaaagctcacatccagttatccaacagcatttaagagacatctgctgcttctctctctgcataggggccactgggattaccatttattgagtgttttctgtttaccagtactgtaccccaggtactttatatgtattatcttaacacagccacctagaaataggcttgaagagattaaataactttttcaggattgctcttctaggagcagggcagagcaggcgggactcagtgttgtaatagctatgtgttaataatccactattgtcattgtataaaacacttgctgtgtgccaggcactgttccctgtgctttacattcatgaactccgttaatcctcacacagtctggtgaggttagatggagcccatggctccgtggaattcattagaaagggatggtagtgttcttccattccaggcacttaggagccactgcttgttataaacagatctcattagaggcagagaattaacactgcctgagatatgcccatgccagggcagttggagctcatgtgtgtggctttccctctctcaacactgcaaattgatcttttcagtctctttgttacgcctgatgagtctgtcctggataggcagagcttctctttacattcaccctgaagtcctgcagaggggttggtctgcagcgtgtctctactgtagtctttccctgttagtttgtgactgtgggaaagtttattactcctttgtgggatgcttgaacttgtcatctggcagcatcttaatttttctcttccagtttccattatccccaccaccgcccccatgccattactggtgacagagtttccctttaaaatctttgattttatatttaatgcctaactgtctgacacatagtaaaatactcagtaactatttggttgaataaccaatgaatagagggaggaaaaaaaccattttgttttaccaatcattctttgcttttttcacaatagtttgtgccagaaatgaccattctgtctggtttatgttttctgtcccagggaagcgtggttttctctgttcattgattgactcagtgttagttgagctgtcactggggctcactctggcccacttgcggcttattgtgccaggtactggcataagtgctggggaaggagaggtgaataaacaggcacttgtcctgcctttgtggagtttatagtctggttggatgagacagatattaaacaaaaaaaatccttactggaatgtaggggtcacagtctttgtctgttgcattcattgctgtatctctagcacccagtacagtacctgacatgtagtagatacttaataaatatttgtggaatgaatggatgaagtggagttacagagaaaaatagaaaagtacaaattgttgtcagtgttttgaaggaaaattatgatctttcccaaagttctgacttcattctaagacagggttagtatctccatacataattttacttgcttttgaaaatcaaatgagataatctatttagattgataatttatttagactggctataaactattaagtgctagcaaatatacattttaatctcattttccacctcttgtgatatagctatgtaggtgttgactttaatggatgtcaggggtaggtccctaattgcttcttgcttctatcataacagtaagtcttggattcaaaaaaaaatttcgttctgaccacttagcatagtgctttgcttattttagggacccacttaatatctgttgagggaatgaaaaattgacatagatgtccctgtaacgcctttgtgtgcctacagtcttttcaaaaattctgaggtagcacaagagtgccacctactgttaagttaatggagagactgtgtctgtgcacttagtcatcagtgatgttggttgcagataatacttaagaagtactttcacatatctcatacaatttgagcctcacaaaaatcctgtgaggtagattatcttaatcccatttatttcctccccttttgaggatggtaatgctcctcttccctccccattattgaagtctggacttctaacagctttgatatctggtttgatttttgagtggtactcaactgtaaaacagagtcctgtaatccctttttgctctaacgactggagatgcataatattcacataattaatataactatagtagtatactataaattagtaacaataatttataaagatatgtttgagggctaggcaataaatgctttacttatttatttttcatgtaatcgttttagcaatcttatcagaggatagtgttatgcacactctgtccacgggaatttgaggttccagaggattaaatagtttgtcctaggccgtacagctagtaatcgatgatactggcagttctgacttcacggtttatgctcttcatctcttttctatattgacctatacccactgcattataaactcatatagatcaattctgtaataacgttgagccaaagaagctcttccagcactctgaccagatgatagcctaatgaatctttattatagtctctttgagttgcaaagtatcttcgcagagttgctggagaaacagggctaactgcagcatcacaagaagaagtatcaggttggtgcagtaattgcagtttttgtcattaaaagcaatagcattaaaagcaatgacaaaaactgcaatttgcaattacttttgcaccaatctaatagataacctaaaatgatggacatcttcagggaaggcatgctgggggggcatttcattaggcaaacatgtatcttgagatctatggttgtgctgagcagaatggtttgcatattataagtgctctccaaatgtttattgcaggacatttctatcttaatttttgctatgactttctacagatgtttggttacaatagcagatagtagtatattgtattattagccatagaaaggctacataaagacttacagtcctcattgcctggatgttatatatttacatttttcagatttgtgtatgggctcttgaaattgataaacattcatatataaatgttatagattacatagcagccgtgtgtgtgtgtgtgtgtgtgtgtgtgtgtgtgtgtgtgtgtgtgttttgtttcagagacagggtctcactatgttgcccaggctggcgtcaaactcctggactaaagtgatctgcctaacagccttccaaatagctgcagctacaggcttcacaccgcactcagctttattatgtatttttttaaatcaccagtttttgaaaatacagaattattatgtgggaagtggtcagttaaaagattttgcatattaaggaaagttggagacttgattgggcactgctgatcctgtagctaagagaggcattgaaagacctatcctgctatctggtttcacccttcatgctgaatttctatgtttcacgtctccactgctgcaaaattataagaactaaggcagtgagaccgaaatgtacccacgagacaaggtttctccccactgaaaagacaaaactacatgcttgagcagcattactttgcagtaatcttgaacacaaggtttacaattatttgaacctatcatcttcttggtgtcctgtattatttagagaatatggtgtagtgtttcaagtactagagatttcccagaagttggatgaaagggagggattggggaagtagaagaagcaaaatgtattgtgtttaaataaacttgaaccaaatttgatactttttttttttttgagatggactgtcactttatcgcccaggctggagtgcagtggcgtaatcttgactcactgcaaactccacctcccagattcaagcgattctcctgcatcagcctcccgagtaactgggactacaggcacgcgtcaccatgcccggctaattttgtacttttagtagagacagggtttcaccatgtaggccatactggtgtcgaactcctgacctccagtcatctgtccgccttggcctcccaaagtgttgggattacaggcgtgagccaccgcacctggccaatactcctttctaagctccgagcatgttggcacatttgatttggtttgctctttctttatctgtaggccatttgatattgggccatcattgaaagaggcctgtctttcttcttcttttctaaaaagcaatctaattgaatgacatgggctctttttttgagagatgatccgtagttccctaacatatttgtgtgtgaagtttaggacaattagctgaggtgtctgagcactagtacctacatttctgaataattttgataagatgaactcgcttaatgattttggagatagaaatgaaagaaaaaatagagctctataggagttagattaaaatatcagtattggaacatcatgaattattgtgatctccgtaaggattttaggctggttttaatggctatgtgcattttgtatgtatggaaaaaggaaatttctcattgaaactgacttgtcaaatatttctctcaaaaattgtttgcagcattagtgccagcagtagttcccaagggctgtctcagccatccacccagacgactcagtatctgagagcagacacgcccaacaatgcaactcctatcaccagtaagagttaatttaattctaaagccagtttactcaagttgtctatgctgcttcccagtggtcttgcatggttagtgtacttgtgggacatgttgtgtaaatcgtatctaaagtatgcaaaattaggtatgctcttcaacttttgctttctagagcattgaatgaaacattctaaaattgaggtatcaaaaatgaaatttaagtttgctagaattggtgtggctttcgggagatttccatagatttattatactaaaagggctactaagtcacttctatagaaattcaaaaggaagatttttcaggtaactatatggaattaactattgagctgcataaagacagagactttagactgtaaggaattgtttgatggtcttatgggccatggtgaagactttacattgttttttaatcataataggaagttagctaccactggaaagttgagaatgtcggatctgatttccttttttggactggcatttattctttagtaaaataagattaagatatctgtcctctacccagtgccctattgtggttttccagtactgtctcccatgaaaaagaaccaggattttttggagaaatggctgattccaggtctgagttaggaagtgaacaagataagcctgggacatgttgctgagtcagatatcaaggaaatagctaagacttgaagagcttccactggctaaagataggaccatttgatcatcaaaatgaataatgactataatgaattaaaacgtaaaatgtgtaaaaatccacaaatttgtaataatacattatttaacaaaattgttcattatgagaggtgactaaggctccagtgaataccttactctaccaactgactacatgaactgtatttcaggttaaccagatggtgctggtggatgagagaaaatttttctttacagatgattctcagctaataaatgtggaagaaattatataattagaaaatcacatgtgcaactcctgataaaatagttgattcagaaaaagatcatcagtgattgaaaggaaaatggggaactctgccattgagggatcaggctgtcaccacctgaatacactgatgaactcagcattactaaaagtaggggacctaggtatttcgtacccaaggatatgatgtaccattcatggagcattcttttctgtccctgctgcaccccctacaagttaacctggatctgatcaaggttatagacctgacttacagtttacaggaaatactacttgaagaagtagaggccaaacattttccagggtagccgacccagtttcttcaataagacagtggcaagaaaaaaggaggaaagaaggcattatacagtaaacaaaatttaagggaaataataatagcagctactcttcccactaatgaagaaagaaatatatgctttttaggaaatacgatagatgtgaaagtagtttaagctactcagaagaggcacatcattgcttttaatgtttaaatatcaatctttgctcattagaatggattcttaattgttatacgtgacctcaaagaggtagggaattgttgttatacatgctaaaatactttcttaaaaaagtcaaaggggccgggtgtggtggctcttgccagtaatcccaccactttgggaggccaaggcgggcggatcatgaggtcaggagatcaagaccatcctggctaacacggtgaaaccccatctctactaaaaatacaaaaaattagctgggtgtggtggctcgcgcctgtagtcccagctacttgggaggctgaggcaggagaatggcgtgaacccaggaggtggagcttgcagtgagctgagatcacgccactgcactccagcctaggcaacagagtgagactccgtctcaaaaaaaaaaaaaagtcaagggaaataaatttatttatcttttaaaaattgttgccatcaataagaaatttacttgtttgtaatcatggccattaccgtaaggagctagataatttacttactacatatatatatactgaaaacaaacactttttaaaaaagtcaatagaaatacatttgtttacagatagaaaaagaggaagaaaaaaatatttgaagacatagtagccaagaattttctaagataacaacgcaacagatcacagatccaggaaactaagagaactccaggtagaattaaacattcacatatactcacacacctagacagtctatcacagtcaaactgctgccaatcagtggtttcaggtggtgtcagtctacatgcattgtaaagttgcccaaaacttttcatgtggttctcctggcaaccattgatgatcattgcataggtccactaattttggggggaggtttcttcccattatctggagatgccattccaacttctacttgctaaagccagattttccttttattctaacattttttttcttgaagtgaaaactaatttgtggctgtaaattctgtttttactgtcattgaattaagaatgaatgggaattaagggaacttattaaatttgaatctcacaatggttttactaggatgtggtaataccagaataattacattgattatgtattttgtttgaaaaaagccttttcaaacaaaaataactttctgtttgaaactttttgtttgttcaaacaaaacaacttttcaaatgaagagatgtttgaaaaaaatcttttcaaacatgtcttcatttgaaaagttggtgtgttatgagactatattagaaaaccttttgggagaaaaactgtccataagaaggattaaatgaaatttcacagatcaaagcttgtttcatttggctaaaaggcaattgaagtggtggtcatggtaatactatttttaggatttcttgttgcagttcagaattttaacattttggagtagtattgtggtgggtgaggagacatttctttaacatttagtgtggccttcaaataactctcctagttcatatatatgcctgtttccttttatgattcttacactcattcctgtgacctgagtcctgaggttctaactgaactagttgactccaataccataataagggtatttatattgcttggtttggctttgttggctccttaggttatcctaccttgcggatagagaagaacgacttgagaagtgtcactcttttggaggccaaaggcaaggtgaaggatatagcaatatccagagagaggataactctaaaagatgtactccaagaaggtatttattatctcaaagtcggttttttaagtatgatttaatgttaccactatagacacttttttcaaaaatttaaaaaatttcatctcattttgtgtctaagataaggataggaagcagtgtatggtttttcttttataaaaattattttcatttgctcctatacttgaatgggccttgtacaactttggtgcagttcttgattttcaagtatattaaagcacgtatattattgttggctatatttaaggtgtattctctgtttggtttttatttaaaatggccactacctggcaggtctctctgagatagtctaagttactttctctctgacggataacttgggggttgtagcggaaggaatggacatgggcttgggctttggttttggtccttagttccaatcccacattttattctccgtgtggctttggagaaatcacgtaatgtcttcagtctccagttccctcctctataaatttggactgcgttgtcatctcttagactagttataaagatgagatgaaattaggtacagtaaatgaatgaacacataatagtgtttgccaggtgttagtatgcttcccttcacctctcactgggccttgctttcctttttgaattggagggtattgattagggagatgctgaaagaagaagacagaaattaataataaaatactgcactgagctcttcatgttgttaaatagagaattacttttttacctccactgtaattcagtttggaatgctttggatacttatgagtcctccttatgtattcctttgctggttgggacacatttaggtcaatcacagctaagtcaggtacttaaactgtccccagtagcaaatggtaattaatggaagcagattttctggtatgtcttaaaatgcatgattgccacttgttaatagttgactgttttctaagcataactagtttgcagatctttttgcaatctgaagagagtaagtagaccaggtagcatttcctaaagaataaaaaaaaatgagagatcaattaatgttatatttgcagtttcttttggtctctgaatgggatagaataggcaatctgttgtagtggtatgatttgagaagaaggaattctgaaccaggtagagtttttctttattggtcttttcaggcccataatagtttattttaaaattcttttgatttcagaaaagaaaatatggtggctgattaacatttaaaaaggtggtcaggttcactggaaatctgataaatgcaaagaaaacaatagttacatgcgattttttttttttacgttagtttgtgaaaaagtaaaaagataatttctaggttgacgggtatggaggaacacatgctcttttacattgctggtaggaatgtgaattgctgtaacattgtggtaaagtaatatgtacatatatatttttgtgtatgttccttacttccattgtttttaagtatatgtaaatctgtgtttgagagtaatatttaaaaatgggactaggtactgggaagaggagacaggaggttttgcagtgcttcagtgcaagagagttaagaagctcagtcaagcaaggtgaacttggctggagagagaagggaaaacctttgtgaggaagacaggtcagggtgtgtagctctatgtattgactagagtgtttgaagatatttactcagcttcaagcaaaatgtcttaaatgaagattatccaaagtcttttctgccttgagcatacaagttactctgtctctaggccacagtgaaacctgatgatacatggataccaacaactccacctcatagagtggaaggcattagagcaagcctatttgtatgcatggtatctgcagcaaagtgaaactatttgcaagcttatcttttaaattgtgaaggaaggaaagtaaacaattttctagtgagaaagagtaaaatgagattcattttcagtgatcatcttgtttgggagttttctatgggcaattacaaaattggtaataaaatctagatggattttcttagttccttccctagcacccgcaaaggtcataactaacttctcttattactataagagtttttgttttttgttttttttttttttttttttggcggagtctcgttctgttgcccaggctggagtgcagtggcacaatcttggctcactgcaggctccacctcccgggttcatgctgttctcctgcctcagcctcccacgcccggctaatttttttgtatttttttttgtatttttagtagagacggggtttcaccgtgttagccacgatggtctcaatctcctgacctcatgacccgcctgcctcggcctcccaaagtgctgggattacaggcgtgagccgcgcgcagcctcttctcactctaagagtttttaggaacacattttaccagtgaaccgagagtctaattggcttgtctgagaccttctgaggagtgagtggtagaaggaatggaacccaggactgtctggatccaaaacttgtactccctggccttcccttgaagctactttttaaggctctgcggtagagaggaaagttcatttttgtcttttcgtcatttctctgaggctaagcctagaaactcataaatgccattgtggatacctcattactgagctccaatgctcctggctatatcattagtttatttagtataattcaggaaaattttcatatacttagtttagatatggtgtttctgaaagcaagttaagatgtgtaatagtcacaaaaaacttttaacagtcgttaaaaccaaagatttgggtctttttactctagggctacagtaatgttgatcacatatgaccttgttatttttgttttatgttatattgtgccagaaagttttgtactataattttatgaatgttgtatgatctcattaattattacttttccttttaggtacttttgggcgtattttccatgggattttaatagatgaaaaagatccaaataaagaaaaacaagcatttgtcaaaacagttaaaggtaggatcttttttccatagtatttccatgatgctcttctgtctcaggtggctcctgccagcaaaattctgtctcagtttcccaatgtgtgccagaccttttaaatcagtcagtgttaatttagctgaaaacaaaaattgtcttatatgagcctaattgttttggaaatttgggttgttctcattaagtatagaaaaacagaagtctgttaaattaagacataagacatttcttagatattactcagttaattgcaagtcaaactgcatccacttgatttcattgttactatgtttagtgttggtatacttttgcaggtatagccatagttggaattgctggcctaagggtgtgtacatttaaaattttaatagagcccaggtgcagtggctcatgcctgtaatcccggcactttgggaggccgaggtggccagatcacctgaggtcaggagttcgagaccagcctggccagcatggtgaaacccctgtctctgctaaaaatacaaaaattagccaggcgtggtggctcacgcctgtaatcccagctactcagaaggctgaggtgtgagaattgcttgaacccgagaggcggaggatgcagtgagccgagatcatgccactgcactccagcctgggcgacagagactctgtctcaaaaaaaaaaaaaaatatatatatatatatattgttagattgtcctctaaaagatagcactggtttatattgtcatgaacagaataactgttttcacatattcttcttttgggccagcgtttgaaatgtgacgcctaatttttaatttattgatgtgtataagttatttaattaaagattccctatcaagatactacagtgttatttatgcaggcatatggcttatttcctattactggtagatttgcaagactttaaaaaatactagaattttaattacttacaacagatgcttgtgaaagcttaaatagttctgaattaagagctgggtgcagtggctcacaattgtaatcccaatgctttgggaggctaaggcaggaggattgcttgagtccataagttcaagatcggcctgggcgatatagcaagaccccccgtctctacaaaaaaaaaaaaaaaaagtagctgggtgtggtagcatatacctgtagtcccagctactcaggaggatgaggcaggaggattgcttgagcccaggaattcaaggctgcagtgacccctgatcatgccactgtactccagcctaggtgacagagcaagatcctgttttaatttttaaaaatgatgataataattctgaggtaagtcttatttgcttatctagagagaaagaaaaatgtgataatttatagggtgcttaatgtctatcaggtctgatgtaaattgagaagacatgctaataatatctaaaaacaaatttagcactttcccttcagaaactgaagggaagattaaattcagttttatgagtagaaagtgataaaattttatacagtttatgaagttaatttataagaactgtttctaaatttacttaaaggaatacatggaaagtatgaagggtttatgtttattggttgtaaaaagttgggttataccaatctaacaaaaaatctttggaattgcttttaattgaacaaaattgtttgtttaaggctgctacaaatacatccatacacacacacctctttaatattttctaaacaagtggtttaatttactatatcattcaatatttattttattcattcaccccttcccagcaccaaaaacacttttaaagggtaatatttatgtgttaggtccatcctttcggctaagaccaagtgtaagttaggtcccagtaggttttctgactaggagagtttacatattactttttgtaaatgtaaaatttgaactataaggttattaaacaacagccttttgttactcttttctcattttttttttaaggaaactccttaattcaaatatttcttccggggtttgtaagtattctatagactgtgtagaactgggctattattgacttgttctgaattaaggaaggaggtttttatacaaaattgggttgatttagggttggaaggggagataaaaggaaataatagtgataagaaaacacaatgagtatacttggactgtttcacaagataagacttctctttccgtatatgcttgacttgtagtcactggttgtttctgtgctttaccactgtaattataatgttctctgtgagctgtgcggaaataagagaaagcacagtgagtccttatgggggacagaggggaagtgcattgcctcaaatttgttagagagatagcgccacatgactgtctctgagattgattattttggaatgctgtttttatggttttagttgtagccacatagagctgaccaaggtctttcacaaatctgtatgctttgttacatgttgcacaattagaagtttagcataaaataaaaaaacagtgttttagaaagcactgacctttgcctttaggcataagcagaaaattggagtttggcttttaaaaatattcataattttatacagagacttcatagatactccagtataaatttccagagattgaaattagcaacccgaatcttacacactaaatattgtgaaattgaattccataaaataaatgaatcagtttggatttactggtattaagttcttattttctttattatagctactaaatttttatagttttgtaaataagcaagtgtttgtttttaaaaatcattttgtgcatccttgtaacttttagaatatatttaatagtacccttttcaaatgtgtacatcttgaagatagacctttcattatgtaattaaaagactaggatgagactgggaaaggaatccaagaaaacgagtttttcttactaaatggataaagttattttatctttaattgagttttcttagatcatcattcaagtgtcctttgctttaatagaacatgcttatcaaaataaaaacttgaaaaaagtaagtataaaatgacacattctgaaattaccatttgttgtacttagatctccttaccagttgagggaatggtaaaagtctttttaactgggcagggacctccaactattactagttttcagtcttgaaaagatcctactagcctccagtagtcctggccataatttcattagaaattatttaggttatagaaagagtaataaaggcacattttgctatttactaagaaatcccacaagcagtttgtagacacttagagtttattccagcagacattgatatgaagcaccttttccaaagaagtaccgaatgtttcagatccttggctttttgtctacccattttacattcctacaaaagtcttaactaagagaagttgcttggaaaggggacacttagtagcaagtaatggaagtgaagcaagacgaagtgaagcaggaatgagattccaatgggtagatgtggaagtaaatgaaatttgagatttctcagctttgacagttccacatttaaagaccaaatgtgacaatcatagtatctgaattcagtggggtgggttttattgttggttcagcattttcctaggtgggtctagaatatgaatcttggctttgccagtcttttacatttctctcttcctcttattgcattggtccgaagctttataaattattatttaattaattaattaatttatagatggggtctcactctgtcacccaggctggagtgcagtggcacaatcatagctcactgcagcctcaacctcctgggctcaagcaatcccccacctcagccacctgagtaactaggaatacaggtgtgcaacaccacaccctgctaattttttttttttttttttttttttgtagagatggggtttcaccatgttgccagcctgagctttacaaattattattgctgtttttactactgatgtaaaaattcgttatgggtttctttgaaagggtttttaagaatatactgttaagtttgttttaacatttaaaaactattttttaaaattcaaacccacttcttatttgtttattattattattttgggagacagggtcttgctctgttgcccaggctggagtgcagtggtgcaatcatggctcactgcaaccttgatgtccttggctccagcaatcctccagcctcaaccccctcagtggctgggactgctagtgtgcaccaccaggtccaactaattaaaaacactttttgaaatagagatggggtcttgttgtattgctcaggctgatcttgagctcctgactttaagtgatccccctgcttcagcctcccaaagtggtggtattacaggtgtgaaccgctgtacctggctgcattttcaattttataatagaaatattcttttcaagcagtggagaaattcctctatactgttaaggtcgtggtccctataagatgaggaatccttgtggatttgtgcaaatatttgaaggcttaaaaattcctttggagatgtagacttaaagatattggtaaattgcattatcatgtttttgtttcaaaaacattgacctaaaagttcatttgttctgttttgctactttggaccaaaaaccatgagtttagaaactaaaactaaaatggcataattctaattttggttatcatatgaaagttaactatatttttactactgtattattagttctttttgtttgtttttaaccacagagaagtaaaaagaagaaagcaacagaataggccataatctccaatcataacttttgtagtcattttatacctgtaatgtttgttaggttaggaagtataaacagaacagaaaggtacaaaacctaaattctcccatcttgaaaagtagccatcatatgtaaacaattccttaatatgtaagaaatattaggatatgtaaacacaagttgtaccttgtttttgaaatttaatataccttagagatcgtcctctgtcagtacatatctcatttttcaaaagtagccacatagtatcccattgtgtcaatttaattagttctttgttagtgggtactttggtggttgagtttttttgccattgaacagtgctcttattacattgtacatagatgagcttttgtgactatatctgtaacagagactcttagcagtgggattgatgatggaaggtatatctgcatttcaaaattttgttacatgttgctttctccatctatccaagctactattgatgaacctgttttctcacactcttgcccaaattcttaatagtaggtagtggaattttttgtgtctcaatttgacaggggaaatggcatctcctggtttaatttgcatttcttaggactgaggctgtgagtcgttttgtaatcttgtgtgtcatttgttttttattttctcagtgaactgtgtgtttatatcctctgcctctttttcttattgatttatatgagctatttaaataggaaaaaaggaagttagcagtatatatgccttatgtgttgcatatgtttttccagtctgttattgcattttctgctttgtttatggaaacttaattgattttaatataaaaatttctgggaaaattgacctatttaatgagactgcagtagaatttttatctagatctatttagatttacctgtaacttataatgaaaacctatgtaccttatagttcaagataattatttactaatagcagaaaatgttaatgccatatatgtagtattattattcaagacattttcttttctttatatatagatcaagcttctgaaattcaggtgacaatgatgctcactgaaagttgtaagctgcgaggtcttcatcacaggtgagaggagaaaccaccagcatttcagtgttgagcatggcaacacttgatgccacatttttatgtgcagaacattgtgatgacttctgaattgaaagctttgtggaatagcttaatttttttttctgaatataaaagtgaaatgcattctcattgcacaaaacttacaaacacagtaaagtataaaagaaaacaaagaatagtatgtaagcccacatctggataatcatagctaatctagctgatctttccagaaataatttatacatatttatgtgcacatttccctttaaaaaataggatgatggtttacatatgttaaaaaatatttgttatgagatttttgaacgtataggacctcaaagtcaagtataataaacatgaataaatcttccttctagatgcagtaatagttaacattttgccatattttctgtgttgtgtatgtttgtgtatttatccatctgtatctagagacatatctctagatacaggtatctatatatttgtgtatataactattttataataaattagacatctcagtacttttagtgcatgtccagcatgtattttcaataaaaagaagatagttttctttataatcataatatcactgttgtctttgacaaagttaacatgcttcttaatttaatgaaacaatgtatctgacttttgatattggcaactgtaaatccatgtagccatttaaaaaggctacatagtagtccactgaatggatgtaccacattttatttaactaatttctggtatacaatcattatgccatagcatgatttttaaaaactacttatagttctatatgaagaccttttttttttttttggagacagagtctcgctctgtcacccaggctagagtgcagtggtgtgatcttggctcactgcaagctctgcctccctggttcacgccattctcctacctcagcctcctgagtagctgggactataggcacgcctggctaattttttctatttttagtagagacagggtttcaccgtgttagccacgatggtctcgatctcctgacctcatgatctgcccacctcggcctcccaaagtgctgggattacaggcatgagccactgtgcccggccatgaagaccttttttaaaagcttggtattggtcctgttcacagaactgtaacaaaaacttctaccttttgagccagaagcagcttaaatgtaacatcataatgtgtgacagtatcaacattagagcaaatttttttaaagcactatatagagtcaacataatttgtatgtctactgaaaatttgatcacatatgtttaaaaaaagaactgtggttatctctgttggaagatgtttataggcttctgaaaaaatatagtttctgtatactttagacagttccttgagttctgctgaaaaataaggtgactacccagagccttacttttaaatttagttatattttggttcatattcagaaggatttgaggacctaaaaagaaggcagccacagtaagataaataaaatggtaatgaaaaagaaactgagttttttggcattgtggtggtaaaaaagaaaacaaatgagccagcagtaaggagaacaaatatttttactgtgactgaacataaaacacctcctagcttctcggcaaccaagggtgaaggaaacactaaaagttgataatctcagtagcagaagggaaagaaacagttggaatattgtcctttttggcagtgttgaaagtgcttaatggtctattacactgactctagggagaagggccaaaggtgtttaatcctagtatataatgttaacctattacttagatacctagccaatgttcttaccccagtgaaaggtttgcatcacttcagcacagaagtgagtagcagggataaatgtagacaaagccaggattttcccaagaaacggttttatattcactgtagccttaaagatgtcttggctgaaaaatgctcagagcaagcatttgcagtgttgtgtctcatgcagttttagattgtaaggttttgcagcatcccatcaggatgaattagcagtctcaggaggtccttagggaattgaatgacattacatactaaattggggttatttgatactgagcattcagtccttgaggaaagtcttgtaaaggtaggttatagcttgattatgcttaattgttcttccttctatgaggtgatagcaggagtcctagttacaatgaataaaacacattgtcagcatgtagaaagtatattattctttccattcattgtagcagttcatttcatttttaaggtgaccagggcctatcacacattttgttttgatccttaatatgtatagactgttcatagctatacttatgtatttgtttgttcattcttttattctaattcattcagtacccattttgcacttggaactgtgttaggcagaatgaaaatgaaatgatcttcagagatcgtattatagaatttatcaagcaacagaatatagaatttattcagcaagaaaagacacctgtttttagattttaccttgtggtatgtaatacagcatgtttgcttcatgttttaacatccatggttacggattgtacgcgtattgaagtgttttaaagcattttgaaatcctttcttttcacacatttttccactggaatttatgaaaataattttattaaaagttaaaatagctgtatacataaaagatattaacctattttaatttcattagaagtgcttcacatcaaagtactcttgcgctatttctgcttgtagtttggccccttcattggcccaaagatgcctgatggtgaacacttcttatgccaaatggctcacagctctccctctgcaaacgccctcaacaagactgagaattagaggcagttcttgtgccaagccccacagaacctacccttcctgtaccttctttcttcactatagcatctcctgctttcattcactcttcttagagatccagaccttccccttcatcctccttttcattacaagatgggcagaatgaaaaacagccatttgtactttgaaacattttcatgaagtttgttagctctaccagtggatttttaatcctgtggtagtggaataaaagatttgacttcacccagcaaacctaatggataaaatgtctttaactctgctaaatgaatttcagtcacaaagaaagaaacagaagtaatctttggtgagttaaatagattgggcaacagtgtttaatggtatgcccaagttaatccttagtgtaaacctgtagtcattttagtattcatgggagttggtggaaaggaagctctgtaatctcccatgtgatctcccttgctcctctggagagaaagtctagtggtccaggggaatgcaaagggtattgaatcagatgaagatctgatatttttctccgtgtacttgctctttgtccttggcaggttacctaaactttctctcccagcgtggatttccttgcatataaagtggaactcctaatcgctgccacttgagcggttatagagaggttgcctcttagaggtttactgatctttaagtcctcattttcccacctcctcagggtcagtgctttccatgttagtaactcctgcaaatatgaggggagcgcacagctttgccacttgtgcattggtgattgtgccacggttttataactggggtttaaaaagtgatacatgctcaattaagacaatttttaggaaatacagaaaacaaagctgaaattatctatagtcttacaacttaaagacaactcttaactctttgcatatttccatgcagacctttattatttttctccatttttataattatcttgcaaatgggaattttttatcttactttcttgtaagataagcttttacttatattctcatattgtgaccaattgtgacttattatcctgttattctttccttattaaacatccttagaagcaggatttgccaagttaaggagtaggaatgttttaaggctatttgttactgttatttgttattaaatgtttgttttatatagcatagattacgaagtgttgggtataaaaattgagtttaccttagtttttgtcttctagcaatttttagcttagtggggaagatgatataattatgtaaaaagttacataaccttgggaaaaattagcagttatttccagatgtcagtggaggaggtgttattagacagtaggatgaaatgtatgtatgtatgccatagaaattaaaataggaacgggattgtccactacatgcttggttttattttgcacatcacagcaaccttttatggttggtggggtccctatgttataagaatggaaaccaaagccaagagaagatggtcactctgatagtaattggtaaatctaggattcaaaaatctgattctaaatccagtgtgaccagctaagaactttttggcttttgtggcagtttcagccttttagagaccttttttgatgatcatattcttgaccaccgtctggattgggccttttttttttttcatgtgtgataatggagtaagtgggatattgttatcataatacactcatgggcaagtcagtttttagatgtctctgattaattgccctttggagtaaagatatagtgtggttagagtgtgccttcagagaatccagcccacaggaagcaactttgagtttatgatttttccctaccaagaatgtgcatatatggggatatatgcacatatataggggacacttaagtctggtttaaaatacagaacacttataattttacatttttaatggtaatcatgtttttaagtattttggggattttgttttgttttagattatttttattagaagtaagcccctaacattttggattcctttgtctttctcccaattttttattattttatagaaatcttcttcctattactcatgtgtgtatagaagaaggagaaaagcccatggtgatattgccttacatgaattgggggaatcttaaattgtttttacgacagtgcaagttagtagaggccaataatccacaggtgagaaaaatttgcccaaataccaattatttaccagtagtttctgataatgtctttgaaagtagatattaacattcttaaatataaactgtttagaggcctgcaaaaaagaacctcaaaatgaaccacaagatatttataacctgttggcttaaaggaaaatgttggcttatgttcctgccttgaggcttacactgtgctgatgctgaagttttccttatattctcgttgtgtacttattcataatcaactcaaaccctttgtaatgccatcttaggtgttttcctgataactgagggtacttgtcctagatcttcctcttaggaatggaaacagactttctagagccatttggttcatactataccaaagtctggtgatgactggaggtctagattgtgggagataattggatgtattgttaatatgcgtggctgtaagatggcagtcatctaagagtgtttctcttccctgcttgtgtttataactgtaaagcaaaggtcagataccaagcatattatgatggtagtggtagtaaagcctagtgggttttttttgctgtcagctgtatcttgttgtcccattaagttgctttaggatttataatagtatgcttattatagttgccaggagaaagtgggttcaaaggctgcattcagtatttggcctaatatgtatcatatgctttgtaaattgacaagactaaagctgggattctcaataagtggttagaggctgtggctcatctgcattacctggggaaggattttattcctcagccccaagtactgtcatacacctagaagaacacatcagcagaaaaagctaggagctcgtactttgggtttgtgtgtggtttttttttgtttgttttttgttttttgtgtttttttttgagatggagtctcgctctgtcgcccaggctagagtgcagtggcgtgatctcagcactgccagctctgcctcccaggttcacgccgttctcctgcctcagcctcccgagtagctgggactacaggcgcctgccaccacgcccggctaattttttgtatttttagtagacggggtttcaccgtggtagccaggatggtctcaatctcctgacctcgtgatctgcctgcctcagcctcccaaagtgctgggattacaaatgtgagccaccgcacccagctgcagggtttttttgttttttgtttcattagacaggatctcagtcaccaagggtagagggcagtggtgtgatcacagctcactgcagcctcaacctcccatgcttaagcaatcctcccacctcagcctcctgagtagctgggaccacaggaacatgccaccatacctggctaatttaaaaaaaaatcattttgtgtagagacagggcctcagtatgttgtccaggttggtctcgaactcctgggctcaagtgatcctcccacctcagccttcccaagtgctgggattataggcatgagccactgcaccaggcttagatttgtgttaatttgaaaataatcccaaagagagaatctcctaataaaaactactgtttgggggaaaaaaagattactgaattataaacatttgaaatattaccttgagaactcagcattcactgaacagatgtattgagcagctgctgtgtgtgctggatattggggagatacatctaacagatgaaaggagacagagtaaatggtagattacagaataataaggactacagttgatataagtatagggatatatgggaacatagtcttggtcaagaaatagcttttaaaaattctgtgtgtaggtttaaagcagtatttttggatggagtaggattgtggaataaaaaaagtaagaaagtgccatcatatttgtgtgctatttgcaaaccatgttattttttgttaccacaggcaatttctcagcaagacctggtacacatggctattcagattgcctgtggaatgagctacctggccagaagggaagtcatccacaaagacctggctgccaggaactgtgtgtaggtgccatgagcttgacgctgtcacttgatgtagagtgcttcctggatttggggttctctgcgagtcacagtgggacttgtgttgtatttaagggtggtgatgatccctactttttaatactctgattgcatttgatgttcatatctttacttttcagcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtggtaagtgccgggacccccagatagcaaaagaatagagaaacagctttctgtttttaaatgttctactatttttatcttttgggtttttaaaaaatctgctagctgttcccggaaatttttatccagaaagcaagtgtaattagctgccagtcaaccagtttatggagaggagctgtgacccagaccataggccagcactgtttgtaatctcatttcatcctcacagtactgctctgacagaagcactttttttttttttttttttaagacagagttccactcttgtagcccaggctggagtgcaatggcgcaatcctggctcactgcaacctctgcctaccaggttcaagcgattctcaggcctcagcctcccaggtagctgggattacaggcgtgtgccaccatgggcacatgcccagctaattttgtatttttagtagagacggggtttcaccatgttggccaggctggtcttgaactcctgacctcagttgatccacctgcctccgcctcccaaagtcctgggattacaggtgtgagccaccacgcccattgacagaagcactattaacactaggagataggctgtggtatcccagttttaaaggtgaggattttgagactcagagcagttacagtaatttcattattatttctttcttatataagaggcagaccaaatagttgctagatcataaagatgttttctttttttcaggtgacctcttctaagtgttatggctcataaaatttgtaaatccccccgtcatcctcttccttttgtcaagtttctgggtggttttgccacttagccagatcatagttgggccctttgtgatgtacagtttcagaagccacgttcacttgttcatattttacagccatgtaaaatttctgtcacttgatttcttagtcttatttggaagactaagtgtaatttattttcctgtctcttgcctgttagactttattattgttgcagaatatttagggattaggtaaaacttctgcttatagggtcccacatatgttcactcagtgataatctgtttgtgttatatgtaaaatcctatagaataatttgcttctaagcttcaactgtaagaattgggcttactgtatcattgtattttgtgtgtctatattttaaaatttagggctactcttttgtttcaaagtgtgtatgttttaaggattaatcttttaatcatgtattactgtacgctaattaattatattaattggtatatactcatttcctcggtgtatgagttttctgtggctgctgtagcaaattactacaaccttggtggcttaaaacaatagaaatatagtctctcgtggttcacttctgaggccaaatgtctgaaatcaaggtgtagtcagggctgggctccttccagaggctctagtggagaagcagtccttgcctctttcagctctggtggctgttggcattctttggcttgcggttccatccctctgttccaagttcataccaccttcttcttcacatacgtctttcaaactctctttgcctccctcttaaaaggatacatatgatttagaacccacttacataatccagaataaacttttcctctcaagatccttaatcacgttttgtcatgtaaggtaattacaagtttcagggagtaggacatgggcatatctttggggctaccattcagttcactgcagtcaataattgaaatgatctaagatttctttactgaaaaactgatattctaatttaaaatccttaaaatgagaataatttgagaaaggggaaaattcctttaattaactctaactactaaataaattttttttcctttttagaaactatgtgctatttgatattgatatggtttggctatgtccccacccaaaatctcatcttgaattggaattcccataatccccacgtcaagggcgagaccaagggtggagataattggatcatggggggcaggttcccccatgctgttctagtgagtctcacgagatctgatgcttttatcagcgtctggcatttcccctgctcacactcactccatcctgccaccctgtgaggaaggtgcctgcttcttcttttccttcgtcatgattgtaagtttcctggggcctctccatcattgcagaaataagtcaattcaacctctctcctttataaattactcagtcttgggtatttattcatagcagtgtgagaagggactaatacagatatattgctccttttacataccaagtattttgataaaatgtgttcacttaatgtgaatgagcaatttacttatataatttttaaattttttttttttttgagacagagtctcgctctatcaccagactggagtgcagtggcgcgattgcagctcagtgcaacctccgcctcctgggttcatgcgattctcctgcctcagcctcctgagtagctgggactataggcgcgcaccaccatgcctagctaattttgttaaaatcaaggtctttcattttatatatcttcaaaatactttgttttaactcaagataaactattctcaaagaaacaatttatctgacatttgtgagatgaacaaagtaaatatgaatgattatgagaagggatgtgatctgcttcacagagcagtctcagaagctaacactgaatgacaacctgtttcatgttgtccacagcctctcctagccagagaggcatcgggcatggtgggtgatgggtggcaggatgagggaaataaagccagactcttggatactgaatcccagggttcagcttatagagcagtggggtactagtcctggtctgtttttccagagctctgatgataaagaaaaaatctctctctagcattaatgtctagaagttaaacataccaagtaaagcagtacaaatatgcaaagcaggttatattctttttaaatctctacgtaatgagaacctgggcttttttttagggagagaaaggttacatttttggttttgatttttatatttttcaaatgacatacgaagggaaagcagagtttgattttagaccaatgcacagctgctgtactgaatgacagtaaggactagttctactctttgataatgtttttggttttagagttgccaaatctttattcagaaattctgaattgtagctggaactgtttaccagctctacattaagcaaagctattttcatggagtgggaaaggggacaggaggaattggtttggctttggttgtagaacataattttaaaacataatatcagttgaattagagcagtgtgatctcaaatttactcctttagtaaaagctcacatctaaacatttttaaatgtagaaaagtgaagtaaacttttcttagtgtttactttgaaaattttattccgtagttgatttaaaagatggattcactcgtctctttgggatgttaatttttttatttccagtggttgatttaaaatttttattttgttatttattgaaatatagttgcctttgctgaaatgatatggctgttgtggtgaaccaaaactagttcgatgggcagaaaatggaagataattcttagatgataatctataagtatttcgtgtaatttgaagaggttggaaatctttttattattctcttagaaaaaggagcattgatagcttgtatttcaaaggggtatgcaagatggcaagtagtgctatttgcttgcacagtggaggcccccaaaatatgtattactttttttttttttccttagctacttctgttgcccaggtgggagtgcagtggtacagtcatagctcagtgtagccttgtactcctgggctcaagtggtcctcctgcctcagcctcctgagtagctaggactaccagtgtgtgccaccacacgtggctaattcttttattttttgtagagatggaggcttgctgtgttgcccaggctgatcttgtacccctaagctcaagcgatcctcctgccttgacctctcaaagcactgggattacaggcgggagccactgcacccagcctgtattacttaatttaacgtatttatttctgtgtaggtataccattgtataattaagcgatgataggaattatttttttgtaacatttatgattaaatattttgtaggacctacagagtgaaaattaagttagataatatactttcaacaaatgaggctatagctaataataaatctccaagcaagatgctccaagagcgttgagtctcttcagctgggtattagctggcaaagttcatgttgaggatacatggtttggttaggcagaacatttcaaattatatcagaaatagttatttttatggttatgacattttgcaggagttcacacattttatgtaagaatctgccatcatcagaatgcagttacaccaaatacttagttgcttgttcatgtggcagctttattttaaaatatcaccattaacttaatggtgagcagattcacaagagaattactttagttagttatttagtttgttattacagatagagttttttattcattctcctcctccgcctcttcctcctcgtcatctttgcctttctcttccacctttgtccagacaactttagtgggaccttttgcgccatcagattttcctttagacttgcagttagcaacatccttctcatacttctccttcagctttgttgcctttgtgatgcaaagctgctttttagtgtcacttaaattactccacctctcacctagcttttttgccacatctccaatagagatgccagggtctgaattcttggggcagaattctgaacagaacaggaagaatctggacagtgaccttttggggacattgaggtcctttttgttttttatttttttgttttgcctcccttagatagtccataatccttcatttctgaatcatagcatattttatctacttttgccatttcatcagatttagacttctctttcccagacattgtcttccacttctcagtgtacttttggacaattttgcaaaaattgacagggatctttgggtttttctgcttaggttctctgtatgcctgcacaaagaaggcataagcaaacatcttgccttttggttttgtggagtagcttttagccaccctgactgaattgttcatgagtctgggcagcacagggcatgacatgtagcttagtgattccccagcctcacgctagctgcctccacaaaaggcacctcaacaggagaattactttaacatcataattactttcagtgtgttttggcataaacttacttgaaatagctgtgtgacccaaattttctgagctatacttagcatgtgatgttaacaatatcctccgatttgcatttaacgtggttaactcctagaaagtgctcacatttttcttttgtagcttattataaatttgtttccatatatatgtatgtgtgtatatacaatcccacacacacatatgtatgtatgtatcgcctttgctttagataattggaattgaaaggactaggaacacccttctgttttccatgactatgatgtgactgttcgtgtaaaagtcctgccttttagttttttgggattgaattttttttaattcttaaaatattttaaagcacacttgttgaagattgctttttaacatttgggttggaaatgtgtacacacagtcattatattctgttaccattttttctttatgggtgaagttgggggcttaaaagttacatttaatattctatttttggacacttccaccagagtctatacacatgtgaaatacatatttttagatgtaaatgtagcacccaacaaatgatactgctgccttggagggaacattttctcggtcctttaagacatccttaacatttttgcatttcttcataattaaaaattctacacgatttatttagaaatacattgatgttttccatcatgaaaataatacattgcatctctgggctgtgttttcagaatttttactgaaaggattcaatatttcagtatgtccagattcttctgttaacgtcaacttttaactgttgagcttaagaactatgcacatcaagatttgactagttataaatgtctaatattattccaagatatgacatcattgtaggcattcttaagaatttctggatattgtttttattgtgttttcatcagatgtggataccaccataaatttttttatgtgactttcttttcctttatttgaaaatagagttcttgatttacatcttctttgaattacttagctaattatagtagctaacgtaattctgctcttaagaactactttctattaggagattactaaatgtaatcaggagtatgcagttaggaatttctttcttattggttttcttgtctttatagtattacattgtgtttaagaagcattttcttaagaaaaacaagtcaaggaaataacttccatgccaaatattatcagcatggtttatggcagtgaagagatccttttaaaagtatttgaacagtttttaggggataggacaaatcaaaatgtgttgcttgtgcctttacattatttattttgtgactatcaatgatcacctagaaaataaaaggaagtctggagttatccagagactgcatctgcagcacattgctacgtatgactcttttaactccctgtttgcccagtgctgtggagggagcccagtgcttgttgtatcctgagcgacctgagcgggagagtctgacatttattatatacccatggaaagtagtctgctgaactactgtggtatcaaagagaaagctagagttacggaggatgcttcttcttattattattattttattttttattatactttaagttctaaggtacatgtgcataacatgcaggtttgttacatatgtatacatgtgccatgttggtgtgctgcacccattaactcatcattcacattaggtatatctcctaatgctatccctcccccatccccctaccctacgaaggccccggtgtgtgatgttccccttcctgtgtccaagtgttctcattgttcaattcccacctatgagtgtgaacatgcggtgtttggttttttgtccttgcgatagtttgctgagaatgatggtttctagtttcgtccatgtccctacaaaggacatgaactcatccttttttatggctgcatagcattccatggtgtatatgtgccacattttcttaatccagtctatcattgatggacatttgggttggttccaagtctttgctgtcgtgaatagtgcctcaataaacatacgtgtgcatgtgtctttatagcagcatgatttatactcctttgggtagatacccagtaatgggatggctgggtcaaatggtatttctagttctagatccttgaggaatcaccacactgtcttcaacaatggttgaactagtttacagtcccaccaacagtgtaaaagtgtttctatttctccacatcctctccatcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtatctgttcatatcctttgcccactctttgatggggttgtttttttcttgtaaatttgtttgagttctttgtagattctggatattagccctttgtcagatgagtagattacaaaaattttctcccattttgtaggttgcctgttcactctgacggtagcttctttcgctgtgcagaagctctttagtttaattagatcccatttgtcaattttggcttttgttgccattgcttttggtgttttagacgtgaagtccttgctcatgcctatgtcctgaatggtattgcctaggttttcttctattgtttttatggttttaggtctgacatttaagtctttaatccatcttgaattaatgtttgtataaggtgtaaggaagggatccagtttcacctttctacatatggctatccagtttcacctttctacatatggctagccagttttcccagcaccatttattaaatagggaatcctttccccatttcttgtttttgtcaggtttgtcaaagatcagatagttgtagatgtgtagtattatttttgagggctctattctgttccattggtctatatctctgttttggtaccagtaccatgctgttttggttactgtagccttgtagtatagtttgaagtcaggtagcatgatacctccagctttgttcttctggcttaggattgtcttggcaatgcgggctctttttttggttccatatgaactttaaagtagtttttgaatctgtaaattaccttgggcagtatggccattttcacgatattgattgttcctgtccatgagcatggagcgcttattattttttaaagtatagaaaactttattcattattaattttagagtaatgcatagattcctaatatttgtttcctttatagttgtagattttatatacaataatcttggaacaattatttaagtattaagttcacattaagagaaataaatattaaagacaggaaaaatctagaggtgcaaggattatttcagactttaagaaataaaaatttaaaatttaacattaagatattgtttagttttatttaatggtattgttttattcatcctaatattttcttggaatgaggaataaatggatttactttaggaagagttactgtattttcagaggtgagcacttgctgtcctgtgatcaagtagttggcctgggtgttttctgtcgttggctctccctcaggataatttactgataaaatcttgtaaacaactctttacattcctttaaagagacttgtccttattctgtttaatattcccctcagatagccccagtgttctgatggagtaatgtctatgcatctgatacagtggcaaaaagtgccataaataacagatatgtgtaatggcctggttagcatccaatgttggctcctctgtctttcctaatcacagatcgtggggcagattcatagcagaagtagtcacttttcaatcacgtataacactctgcttaaagattgctgatgtttgaagttgagttggtgtcttagtgtattggagccactgtaacaaactgccatagactggataacttaaataacaaacaatgaattctcataattctggagtctaggaagtccaaaattaggtaccagcaggttcggtgtctgttgagagcccctttcctggttcataaatatccatcctctcttctgggtcctcatgtggcataaggggtgagggagctctctggtggtctcttttataagagtaccaatcccatttatgagggctgcactctcatgacctgaccaccttccaaaggccccaactcctaataccatcacttgggggttaaggtttcagcatataaatggtggcagggacacacacattcagtccaccacattctgccactggccttccaaaatttatgtcattctcacatgcaaaatacattcattccatcccaacagccctaaaagtcttaagttgttttagcatcagctccaaagtcttaagtccaaagtgtcatttaaatgtcgtctaaatctgatatggatgaacctcaaggtacagtttatgctgaggcaaattcctctctagctctgaacctataaaagcaaataagttatgtgcttcaaaaatacagtggtgggacaagtaatggatagacatactcattccaaagggaagaaataggaaagaagaaaggagtaatgcatctaaaataagttgaaaacctaaccgaacaaacaatattaaaccttaggactcaagaataattccctttggcttcgtactctgcttttcaggtccactggggtgggaacatcatctctcagctaggtggaacgtacctcagtggctgtttgccagagccccaccccagaggcactgaggtccttttttggcacttggggcacaccagacctaaagaggcatctaagaggaggcatgtccctctggacatctgctctaggcctggtaaagggcgtctacagaaaaacctatagctaacatatttagtggtgaaaggctgaattgtttttatttaataccaggaacaagacaaggttgcccactcttaccacttctgttactcagcactgtccttaagattatagccagtgcactaagggaagaaaagagtagatagaaaaaagtaactatttgcagaatagtatgatcatttatgtagaaaattcagtatgatatacaaaaaagctactaaaactaataagtgagtttagaaagattgcaagatcagtgtacaaaaataaattgtatttttgaacactaacaatgaaaaataaagttttaaaaaagtttataagaacatcaaaaatacgaagttctcaggaataaatctgacaaaaaatgtgaaagagctatacaatacattgctgagagaaattaaataatacatacacaataggagaggtacaccctttttgccttggtcagaaaactcaagatattctctccaagtttgaaaaatattatcaacattattagtcattcattagggaaatgcaaaattaaaccacaatgagatactgttggtttggctaaaattgaaaagtctgaccataccaaatattgacaaggatatgaaagaacaagagctcttttacactgctggcaggaatgtaaaatgggatatttccaaactttgggaaacagcttggcaatttcttaaaatgttaaatatgtatgtaccatattcagtcattttgctcttagataaatgaaaacatgttcttaccaacactacgcagatgttcatagcagctttatttttaatagctaaggctgaacataattcaaatgcttatcaacaggtaaatgggtaaactgcagtattcatataacgagctatactactaaataaaaaggaatgaactgttggtacatgctacatcacagatgaatctcagaatcattctgagtaaaagaagctaggaaaacagtatacagcttgaataattctatttatataattctagaaaacgccaactatctagtgacagaaagcaaattagtgggtacttggggatggtagtgctggtggtagggaggggtggaaggaaaggatcaaaacagaatcatttggaagtgatagatatgctccttatcttggttgtggcagtggtttcaggagtgtttatgtatatcagaacttatccagtggaatactttatgtgcaatttcttatgtgtcagctgtactacaataaaaataaatgaaaactgtctttactgtctgatcactgcagctaacaaatctaggactacttgctaaatttacccaatcttaagacccaccaaggacttttgtttaaagggatgtgatccaggcctgtcatggtggctcatgcctataattccagcactttgggaggccacggctggtggatcacttgaaaccaggagttcgagaccagcctggccaacatggtaaaaccccatttctgctaaaaatgcaaataaataattaattaaataaaataatgtgatccaggcttcagaattattaagataggacagaggaactggactttttagcaagcaccccagataattcttctccttcttataaaacacttaacccaggttcatttaattgcactttggtaatctgcagccatgtctttatgtgagaaagggatattaggtttctaatatgaacagaaaggcctagccatggaccacctgatgatgcttccactgtggtcagataagataatttacaattgaatggaattattttcctttcagtttatagtttactgaagtgagccttgcattgtaagttcctgaagtaatcactggaaatgtcttaattcagtagctccatctttagttaatgctgcactaaaagaaaaaaggaattttacttacatactttttgacaagtcacattcatatatgttttagtggaaaaactgttttacatcttatatatagaagctgtaaaataacatgttctggggagaggaataagatgaatagaataacattataattatctaaatgttctttaaatggagatagccacaatctttcgtaaaactctggaaagaacagcatgaccttcttattgccccctttccaccgacgtcaaacagaaggaaattatagaataagtctgtctaaattttaaatggttcagttatcggaagaccttagagagcaagttttccacaaatcatctctgcgccattttgtcttgattatttttttaagggttggtttgccaacatgtaattaatcacttttgttagtttttaaggaaatgaaactgcattgttccctttggcttgactgttcttttttatggcgtcttttagtgttgtagttgtaatatgaaaaccttaggtaaatgttgggcagtaatgtgaacaaaacagtgggaagggagtaatttttaaaagcttatctacattgctgctgtaatacttacattcaactccagatctcaaataccaccaactttaatatcaaagtcccttaaagtcagaaggtgttataatgtcagtggatggggttattccctgtgtacaaagagtcaggatgcacttgtcaccaattcccatggtttcttcttccaaaatctagtttgaatggatcatttcatctctggaggaagggatgggagcacccttccgaccagtttcatttctttgggctctgttccatctgtgcagggaactaccttctctatggaaattggacacgattttaaaaataaagcattgcatttactaatgactgtcagtattaagatttcatgtagatcttgttgcttctcagaaaaaagtttcatatacagtaaggttttaaagataggcaaataactagttgtgagcaggcaccatcctttaacttttattaatttgaaatcatttttccatttttaagcagaatagaatgtcccagtaggtgtaagggaaatttcagtagcctccaagactctgtggagattttgaaactatacacgcttctccatctgtcgcctgccccctcctcccagagcatagacttcaaggctggactttgctccatgttaatgatcactgttaatgaaaaagataataggttccaaaaggctgaccacctgtttttggtatttagggtaatgctgctgtcaaagtgaatgagatatattccttcctctgtgttctgaaagtttacgtagggttgggtgtgtaatgggttgaattgtgtcctgcgtctccaccaaaaaaaaaaaaaaaatggttgaagccctaacccccagtacctcagaatgtgaccttatttggaaatagggtcattgcagatgtaacgttaagatgaggtcatactcaatgagtatgagctctaatccaccctaagaaaagagacacacacatgaggagaaaatgtcacgtgaagatagaggcagggactgcagggctgcagctgcaaaccaagacacaccaggggcttccggcaaccacaggaagctgggaataggcaaggaaagattccccctacaggtttccggggaagcacagccacgctgacacattgatttggacttctagctatcagagcagtgggacaataaatttctgttgtttaaactactcgtttgtggtatgttattatggtagccctagaaaactaatacagatttatattttctttcaagtttgatagaattcaccaaacagtgttgagttttctttgtggaaaggttttgaattgtgaattcagtatctttaatagatgtagggctatatagatgttctgtttactcctgtgtctgttttggtaatttgtattttaagaaatttgtttatttcatttaagttgctgaatttattggcataaaattggattgttcataatattttttgatgtcttaaaggatggtgttccctcctttatttctgatattttaaattttttgttgttgttcagtctaacacagtggttcttaactgggacagttttgctctggctaaggacatttgtctgtgccaagggacatttggctatgtccggaggcattttgggttgtcacagcttggaggatgtgctactatcatctagtgggtagagcccagggagaatgctaaacatcctacaatgcacaggacagcttctcacagcaaagaatcctccagcccacaatatcagtagtgctgaggttaaaaaacctactctaggctttatagtgtaaaccttctattttccaaaaatattatatcatttcatgtttaatatagtgtttccattcatccccttccagtcttcaaactggttgtgggcataccttttacttctctgtatattataaaccccacgatatattgttagctgtttttgctttaaatagtctgtcaaggaaattttaacataagagaatatgttcagttgttactaatatattttcagcactctgtattctttgtgttgactcagatttccatgtggtatattttctttccacatgaagaactgctttcatacatcttacaggtctgctggaaacatagtctctctgcttttatttgtctgaaaaactctgtatttatcttcattgttgaagtatattttggctctatatagaactttccatgacagtttttaatttttttttctttctttgagacagagtctcgctttgttgcccaggctggagtgcagtggcgcgatctcggctcaccgcaacctccgcctcccgggtttaagcgattctcctgcttcagcctcccgagtagctgggattacaggcatgcgccaccatgcccagataattttgtatttttagtagagatggggtttctctatgttggtcatggctgatcttgaactcctgacctcagataatcctcccaaagtgctgggattacaggtgtgagccaccgtgcctggccctaaaatattttaaaatatgtcatttcattgttttcttgtttgcatagattctggggggaaatgtagctattgttcactattataaggcttttaaaaaaatctgtgtattttacaaagtattttgggattttgttgttattgaaaaataataacctaaaatttaatgcaacatgtttagattttacaaacagacttgtatttgacttgcgtttggtatttctcttttttccttttctttttttcacttttttctcttttactcattaaaatatgtattttggggcaagctatttctctgagcctcagttttctcacctgtaaaattgagctaccaatgattctcacaggtttattgaggaaattaaatgtattgaaggatgcaaaatgatttgaatttgtaggtactcataaacctgatactacagtacacaggtatccccctcctcatccaagttcagttgttctgacctcagggttcacacttggcggcagatcagtggatgtaccggatctgagtccttcccagccatgtggcagcagctctgtgtagagacgttgcctgccccccgccccctgcacgctctccaggagccaagtacagccaggaattggccaaaatggagagccccgaacggaccatgaatggacactgttgccactgtttactattcctgttcctttctgtagtttacctgctgattttaaataaacctgattgcttactcaagcaaggttggaagtttttttaatcctttaatttaaaactttaaatacagtaaaaatccatgacttcttatatttcccctcatttgcgtatttcacttaggatgctcttccctttaattaaactaaaattctgttcattttccacttctcaattatgcagactagctataatatttaaagttacaaattctcatattagaagaatcttggacataattcataatacgtagcttgtaatcaacagtaaactattacttccaatggatctaattacttagaatttataatactaatattggatgcactcttttttatcttagcaagggaaactaactgtgtatgatagacatttttttgtaaataacatttcgcttttccaaagcatgagttgagctgttattttttgtcctgtagctggctgtgggcgctagccccctgactgttgttttaaatgtcccctcattgtgcttctgctcctttactagtgggcctttggagtgacgctgtgggaactcatgactctgggccagactccctacgtggacattgaccccttcgagatggccgcatacctgaaagatggttaccgaatagcccagccaatcaactgtcctgatgaattgtgagtttttttgagcttgaaggcatgagttttattccatttactatattggaataaaggaaaaagagcaggtttccatattcacacagagccttcccttttgagaataatgactctttggatttaaattagactcttataaaaaaccacaaagtcagggagattcgttcactctttcatgcatttgatattagaacgtcttgcattttattttatagtgcataatctaagcactataaattagtctgagaggacgtactaagaaaattgaatgctacgtcagttattctatataaagtgagtatctgacttttatagttataaagtagttataaaggacatagtagttataaaaaacctctctcgttgtcattttgccttgccagttagtatcagctaatacagggaagatgatctggactagtaagccaaatagttgctttctgtttcctgcttctatcacatagcttatcttgccatgtaatgagaatgggataaacaggaggctatgcagggtgattgatcgtacagatgagtatattctcagttccagaacctcctgaaggtttctgcaccatgacaaggtggcagcttttgtactgattttactctagatccagggttcatagaacttagataaaactttctcttcctccaagttcttttcttaatttaactacaggaaaacacacattctttttttactgtgttttaggtttttacatgaaatctctgtatttgctgaaatattttgatatgttgtcatgaagaattgaaattcacacataatccaaataatttcttttagcttctttctagagctgccaacagatagtaaaatggatccgtttttaatatatcatcctctccatacccacctttagacaggcaacataactggcatcaaactgagcaaaagttatgaatactgtatccttactagcccaaattttcatttttgtcactctgcagatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 37981 - DNA, 92061 bp, Homo sapiens; identical to SEQ ID NO: 37526

SEQ ID NO: 37982 - DNA, 93744 bp, Homo sapiens; identical to SEQ ID NO: 37173

SEQ ID NO: 37983 - DNA, 6373 bp, Homo sapiens; identical to SEQ ID NO: 37098

SEQ ID NO: 37984 - DNA, 6618 bp, Homo sapiens
acacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtactactggcgccgggccgaccctgcgcccccgggaggcctccccttcggctttcctctgcccagggacggttctgccagggccctggcccggccgccgcctctgctcctccccgcagccccggcactccttgcctcggggcgcagcccactccgggttccgacccgcccgccctgtccttcccttccagatggcccgaggcagcgccctcctgctcgcctccctcctcctcgccgcggccctttctgcctctgcggggctctggtcgccggtaagtgcggggcgcgtctcctccgagcgaaggggacatcagagccggccgggcgtggagggcttcctggaggaggcagcctccgccctgcccgcggggatgggggtggaaagtggaaaggcgggcgctgtcctggctgcgggcgtcgcgggaagggtccggggctccctgggattccccccgcgcgcttctccgagtgtatcaacagccccgggctataaccaggccgccgggagagctctgcgcttcgggtcagcgcctcgggaaagcgagaagctcgcccgttccgcagggcttagttagaatggagggctaggagccactggcgtggcctcagcgtcactaaagcaggtgcagtgcgctgagagtgcgcgggctcaggccctcaagtgaagtatttcgtaaataaagtggttccattttcatgtcaaatatagccgacttaggggtaaacctggaatttcgcgagctatccaaaagcacatgcattgttctaagtcctctgccatgccgggaaagcctgggtgcacccattcagcataggctccaggcacagccctggcatctgatccccttttctcccttcaaggccaaggaaaaacgaggctggaccctgaacagcgcgggctacctgctgggcccacgtaagtgactgacagcatggcctccccactcctgaccccacctgcccctcgctttgaaccctggctcctgcccctccgcctgcggctgggcagaccctctggcctccctcttgacctcattgcccgtctccattgctctgcacacttgatctgtgtacggttctttccagaagcttctcctgccccggctctgccgccctgtcccggggtgagattcccaccctgggctttgctcaagttctcctgggctttcccgccttgcagtccttacaggccctgttctgggcctctccccaggcccccgggtctcccaaaacactcaactcctcggcttgcagagcaccctaggtcagcggaccccaaatcctgcctccctcttccctttctccaagctccacacgggaattgccagatcgcctgaaggcagcccagacaggctcccctcaaaacaaggttcaggtgaccctgcctgcccaagcctgtgtcccctccctctccctgtcctgttgttgtcacctgtgtcagcggtgtcccctgctgcctgaggtgagccctagccctagatgggacactgcaggctgacacctccccgtgtccgcccccgcccctgtcccaggcctctactttctccacatccttggtctgtgcagcaatgccttctgactttcctccaaaggaggggacaagaggaggccttggttccctcctgtaactcaccttcccctccacacctcaccatccaccttaaaagcctccctgtactgccttctgccagaggaaggatgtgaacagcacgcagggcctatctgagccccgcggagcagcaaatggggagaatggtgctcttctccccatgccaaggaaagctgacttagttctcagtcccagagtcgaatacagcttcctcctcctgcagacgcttgtttatcggggtcactcagaggacccccagagtcaggctttaagaaacagacacggggatgacagagccgcctgaggccgcgtgcggatcggtccaggctgttcaccacagagcctgctggtctctgtgcggccctctcatcctctccctgcccatggagtggcctgacctgcctgagggtcggctgatttcctcaaccctttgcaaccctgagctctgccactcagagggcacctcatctttgtgtgctacgggcccaaaacaaaggcagaactggtcaatgagaacatttatctgtgttgctttggaatattgaaaatctatttgtcaagaagagtttgacccctaattagaaaacaaactcattttcgccatcaattttacggccctgttcagctgtagctagacgagttgtttgtcaaaatacttaaaaatgtgcctttgatttctaggatctgctagaaatgcagcaaaagcaatgtttttgcaccagctgctgctgaacgcagtgtggccgtggctgagggtgcatcagtgacatgaggcgacctatgattcctctataaatttagcaccaagaacggcatctctggaaatacgcgttaattctcctttgtctggccttgtagatggcacagtccacccaggccaaccagctggaaacacagaggcgtcctcaccctcgtccccatctctcatttccatttcctttcctgcacagccccaaatccagccctcctcttcaccccacgcctcttggtttacagccttcatcgtttcttccctggaattctgggatctctgtgcttgcaatcacagttcctccattttcgcaccacgaaacacacccacacacacacgggaacgcacacacgctcctgcaccccccacccccatcctgtctccctctgtgaccctctcgctccctctgtctctctccttctctctctctggctccagtccatcttgcacacagctgccagagtgaaaataaaaatcagattcagtcacaacttaaactcttcagcgtcccccatgctttcagggacatgaggacccagctcctgttgtctgccagggagtcacccagtttgatgccagctcagtgccagctcagatgccagctcctctggacccaggcgcaacccctgcaacagggcaggttctgggcctctcccccacttcaggagccacacctccctttctcccacccaccctgtgcaaaccctcacattccctttgaccctggtgtgagcggccaagctcttacctcagctgggtggagaatcgctccctctgctctggtgtctgtccctgggctctatttcacagtcgagttgcgtgtgtgtgttggctacaggcagccctgtgtccttctttgggtgtggggagggcgtgcatgacagtcacacccagaggctttcctctctgatctgcaaacagatgccgttggcaaccacaggtcattcagcgacaagaatggcctcaccagcaagcgggagctgcggcccgaagatgacatgaaaccaggtgagaggactcctatcccgggccccggggcacctcacttccaccagctcccaggtgcatgcaggggacagctgtgggtgtcggggctgtccacagctgcagcccaagcctggccatgacttgactaagacgatgtggcctcgccacacctgtcagcagctgcaaacagaacgtgcaaacccgagacagcaaggggtccttctaggctgggaggctgcccaggcaccagggcctccagaagagcgggactgggcacgatggctcctgcctgtaatcccagcactctgggaggctgatgcgggtggatcacctgaggtctggagttcaagaccagcctggccaacatggcaaaaccctgtctctaccaaaaatataaaaattagccaggcgtggtggtgggtgcctgtcatcccagctacttgggaggcagaggctcgagaatcacttgaacctgggaggcggaggttgcagtgagccaagatcatgacactgcattccagcctaggcaacagagtgagactccatctcaattaaaaagaagaagaagaagaaaagcgaggcctcgaactggatatctccccaactccctcacattgaacaagggccttggaaagcacagcagggcctcaggctgctgggatcagatcattgaccttgcagcgcccagctcctctgtagggagggggatgacctgagacactgaagcaccctctgcacaagtcgtgaatgttgatcttttctcttctaggaagctttgacaggtccatacctgaaaacaatatcatgcgcacaatcattgagtttctgtctttcttgcatctcaaaggtatgtgaaatatcatcaacttaacattcatctcttagtacactggaaacgtaaaaggcccatcgagaagagaacccatagaatccccctgggaagtagccgattacttatctacgtacaaagtcctgtttggctgtgtgtcgggataacagagaatgtaacactagagctagctccagagggctgggattgcggcaggggcattctaccgtcgtggagggccatcgggccagcgctggtcccaggaagagagtgggcctcagggtgcagctcattctactggaaccatatctattcacacggtgacaactgctgtaccttttagggcagaggtatactacaggccaagttctttgtgaaccgtcctaaaccttttctcttttcttttttctctgtcttttctttctcttctctcttttctttctttcttctttctcttccttccttcctttttcttcctccctctttctctctctctttcttccttccttccttcatctcactctgtcgcccaggctcgaatgtagtggtgcaatctcagctcactgcagcctctgcctcctgggctcaagtgattctcgtgcctcttcttcccaggtagctgggaaaacaggtgcgcacaattatgcctggctaatttttgtatttttagtagaggctggggttcatcatgttggccaggctcatcttgaactcctggcctcaagtgacctgtctgcctcagtctcccaaagtgctgggattacaggcgtgagccactgtgcctggccctaaaccatattttctaagcatgggaaattaatagaagcccatatcttagactgcagtgtttctctatgcagccttcctgccaggcaggctgccttgaaatctaactggaaaggctctgatcctggcttccagtgtcttctgcaaacactggggatgaggagacctccgcacactacgcttggcattcattctacgatgggcatctggccttgatcagataaccacacaggtcctactgcagcagtggagggagccggaaagcggccccggtgctctgagggttaacagggaggtggtggtggggaggagggatggaccgctttgcctctccagcagagaagaccttcacctggtgctctgagagttaagggggaggcagtggtggggaggagggatagaccgctttgcctctccagcagagaagaccttcacctggtgctctgagagttaagggggaggtggtggaggggaggagggatggaccacttagcctctccagtggagaagaccttcacctgctgctctgagagttaacagggagctggtggtggggaggagggatggaccgttagcctctccagtggagaccttcagttgcacatcacagttttgtccagttttgaaaaatcaaggctaatccttgggttcattttggatcaggatgtttttcatttgcagtgttatcgggctgcactttaggtggcgatggggagagggaagaggagtgaggggaggggagcgggggaaggagactgccagagaaggtcttggaaaaggcggtgttcattagaaatctcaaaaccgagtcaccaagttccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaatta

SEQ ID NO: 37985 - DNA, 20524 bp, Homo sapiens
cttctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgacggggaggccttgtgcgagcgtcccactgcccacccacctggttgggacagtagaagagggcgggatggagtggagggttcgccgaccgcgtcgccctcctgggtgtcgcagctccttcctcggcagtcccggggcatgagagcgcgaccggccaggagttgggggacccgggacacggccgcacgtggcctcccagggttccaggagcccctgagttagccgagcgtgcgcgtgggtgtcgggggtgcgcaagtctccagccttgcagagacggaggaggctgccagatgtgggggcggtgggggttcctggagtcccaccgcctgccctaaatttccactccgcccttgtcgcccagtgtgaccttgggcatgtactgcagctcccagtgcctcagtttcctgctctgtggagggagagtgacagtggtcccacctgctgcgtgtatgagggtttggcacccctctggcctttgggaaaggcttaggaaacgggctgtttctttactccggttttacaggaaaggaaacaggctcaagacgttttagtaacttctccaaggttacccagccagcaagtgatggggtccaggcctgaccagcgcccccgccccagcacattctagaaggttctgccccagtttaaatggggtgcatgctctgaggcctgtcacagctttttccggcttaacttctctgtccctcctctgggagtctccactcccatgtctgactctctccccataaccttctggggcagctaagggtctgagtccctctggacatgagcccctggctcaagcacatcaggcagagataaggggctcagggagcaccagcttcatgggtgaatgaatgaaggaatgaaagacccggctgtgtctttcaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaaggtgtgaggctggggctgaagggaaggccagggggaaagtgggcaggaaggtgaggggggaggtctgcaggggaatgaggagggcggggagacagctggcatagacacctcttcctaccctccaacccgcttctctctgtttcagacttttattacgttgccatggatttcggaggtcatgggctctcgtcccattacagcccaggtgtcccatattacctccagacttttgtgagtgagatccgaagagttgtggcaggtaagaaacagagtgtgtattttcggcggtgtggggggtgctctagggcaccccctcttatcactggaggcggggtaggatccaggaagcagcgctggcctgagagtggggcctgggctctggccccaggtctgccagcaattcacgggagatcttgggaaagttgaagagttcgcttcctccagtgggtcccccaagctagtgtcctgggtggacaccccagatgctgggaagggatttcctgagcctggggactagaagcaagatcgtgggctgagcctgtgcccagccggaccttctggctccttgcatttccagccttgaaatggaatcgattctccattctgggccacagcttcggtgagtacagtggccaggagctgaccgggcccggagtagggctgggagggaaggataggagctgctgccccacccctttcccctgcacttatgagatctgcaaagagagatgagagggtcagtcagaggttgaccactgtaccctctgacctcaggcaactgccgcaagggacacagggatgagggaaatgtggtcttttgagtggtcaggtctgatgaaggggacatcatggcccagatgctgagcccccagccacccatatggtgccccccccccccaactggtgggaagaagctttagggtatgcagctggggagggagtgagggaatgtcacccacagctcttttgtcccccaggtggcgtcgtgggcggaatggtgagtagatggctttgtctggccaactggggctcccttgggtggagtggggaggggagcacaaaggaggaaggagaaggtacctgggacagaaagtgcctcctcctgtcacagtgacagtccttataccaggaagttggtgtaaacggtggagactcctggtagagttcatgtttccacgcccccatacccggtcccaccgcaccctggagtccagccatcaccaaggtctggagctcagtgctgggtgcagacttaggggtggtgggggaaggcacaccatagatagaagattctcctctggcctcttggtcagcaccctccccccagcctaaaagatgtttcggggaactccagggtccccagggaaaggcgggagtgtcctttccttcttccccctattcattctccccttttggcatcctcacagtttttctgtaccttccccgagatggtggataaacttatcttgctggacacgccgctctttctcctggaatcagatgtgagaagcgggctttcgtgcatgctgtcattagggaggacctgggccccgggcagcgctcccagccctgtctcctttggtggacactagggaagcacgaggaggcggcagagggtgggaaaggggagtcagggacccgctccccaacagatgacaggcttctgctgcttatacccctagcagtggtcaggacaaggggtgtgggggaccccttggaaactggatgtgtggctcgggatctgcagaatgccaggctgatcacgcagtggcaggcagtggaagagggcagcggccatgggtggaagatgttctagggcacacagctgggccggcacactgcactcacacccagtcgaatgcctttgcactgtgtccacattgcaccaccacacatgacagccctaaatgtgaactgaaggaacaaggactgacccctctgaccaccactacccataaccagtactgtctctgcgtctgagtcctggcctggtttacctgctgggtgacccctggcaagttactttgcctctctgggccttagttcccgcacgtgtaaaatgaggttgggctcaatgacctggccagctctgacatcctgtcattttcttgccaaggtctcagcctatcagttgtgacacaagtctcatcagtttcagttttcttgtccatagaatgaccacagatcggccagatgcggtggctcacgcctgtaatcccagcactttgggaggccgaggctggcggatcacctgaggtcaggatttcgagaccagcctgaccaacatggagaaatcccgtctctactgaaagtacaaaattagctgggcgtggtggcacatgcctgtcatcccagctacttgggaggccgaggcaggagaatcgcttgaacccaggaggcggaggttgcagtgagccgagattgcgccattgcactccagcctgggcaacaagagggaaactccgtctcccaaaaaaaaaaaaaaaaaaaaaaaaaagaatgacggcagatcccataaggataaggatcatgtccatctctgtcaccacatccccaatcctggcacctagtaagggctcagtaaatgttccttgcatgagctcagctagctcaggggctattataaggatccaatttacagatggcagacagcagacactcccttctttctgcatttcacccactgaattgacaagtgcagtgcccccaggggcttcctcctgggcgagtcaagaggggcatttggtcctcttgtcctgcattctcaggcatgggtagatgggagatgcccccctctgcagccccaggcagtgggcctgaggctgtcctcacagagtgagccacacatcatgggggagcttggaagccccagaaatgcgccctttctgccagtccctttctgccactgagaatgatggcattcgttgaaccagatgaaactgccaaccccagatggttcgtggcctccggaccctaatttcatgcctttgcaaagcacttggcagttgacagagattccccttcctctccatcatcccacctgatctcttcaactgtccctggccgcaggcaagaccaggctggctgtgactgaggcgaagcaaagactcgttcagaatcgtggggctgactagccagggctggggctgtgtgcccctttgccgagaggggctcagctgagagcagagggcagggctaggaggggcagagacctcgtctgcagcctggatccctgcccaccagccaactgtgcctccttaggaaatggagaacttgctgacctacaagcggagagccatagagcacgtgctgcaggtagaggcctcccaggagccctcgcacgtgttcagcctgaagcagctgctgcagaggtgggtgcccggtgtggacggggagctggtggggtccaggggaggacatcccgtgagacgtggagaagcttctttctccctctcacccaacaagcctgtttctccctggggtcacgctgagcaccaggcttcccagggtcttcagggacgttctctctttccctctgcccctgctccagccatgccccttacttccaataccctccccacacctctcacgcacccgcctctctcccaagcacatgctgcttccacgccttctctcccctctgggactccagcctgggctcccttacctggaattctcccctgtgcttgctcactggcttccccactccttggggcctcagctgggaaccctgccctgacacccccaggcaagctgtccctgccctgcaggtaaccacactgtccaataagagcctattgattcctctgtttcccgaggcatgtgaactccgcaacccccactatggctgatttggtcatctttgtgcctcctgcatctggcagtgggcctggtaggtcagagctccacacatatttgttgtctgaaggaggagaagccccccactgccccaccacacgcacgcgcacacacacccacacacacacaccctgccgctgtaaacatgcaatcgaaacacgggacacaggccaggcgcagtggctcacacctgtaatcccagcacattgggaagctgaggtgggaagatagcttgagcccaggagttagagaccagcctgagcgagatagcgagaccctgtatttaaaaaaaaaaaaaaaaaaaaaaaaaaattagctggtcgtggtggcacacgcctgtggtcccagctactcagcagccttagttgggaggagtgcttagccccaggaggtcgaggctgcagacagccatgatcatgccactgcactccagtctgggtgacaaagtgagaccctgtctcaattagaatacaaggtccaggcacggtggctcatgcctgtaatcccagcactttggaaggcggaggtgggcagattacgaggtcaggagattgagaacatcatggctaagatggtgaaaccctgtgtctactaaaaaatacaaaaaattagccaagcgtggtggtggcgggcgcctgaatatctatccagaagaggcgttagacattctctagatgtaacgaagaatggcatgaacccgggaggcagagcttgcagtgaacccagattgcgccactgtactccagcctgggcaacagagcaagactctgtctcacaaagaaaaaaaaagaaaaaaaaatcacgagacacatgcacgctttgtgggtgacctcccttttgctgcccttgtctccatttttttgttgttgttgtgttttgtttttggagaccaaatctcgctctgttccccaggctagagtgcagtggcacaatctcagctcactgcaacctctgcctcctgggttcaagtgattctcatgcctcagcttcccaagtagctgggattacaggcacatgccaccatgtccagctaagttttgtatttttagtagagatgaggttttaccatgttggccaggctggtctcaaactcctgacctcagatgatccgcccatcttgtcctcccaaagtgctgggattacaggcatgagccaccgtcccccccggccctcctctcctttttatctgacctcctttttattggcctccaggcacccagcatccttctgtctccccccaggttactgaagagcaatagccacttgagtgaggagtgcggggagcttctcctgcaaagaggaaccacgaaggtggccacaggtaagggactctactgtccaaggccattttatatttgtcactattcttaccgaggatgtcaaggacttgccttagaccaggcaggatactaagcgctttgcaaacagcatctcactgaatccccctcctgcctcaccctcatcccatttagagcaggagaaaccaaggctcagcattgccaagcaacccgggtgaggccatacagttactgcacatcccagaaagccacgctctgggagagtttggtcaggtgtcttggactaaatgttggtgaatgtcacggccatgctctgctggatctggggtgggtgcccagcgccagaggcaggctgtgaggacgtcccaggggctgagtgacttgggagaggcttttcacaatggagaggtggagctggtatgtcttggtttcagagcagcttctggcacaagcgatttgtgtactttgctttttacccaggaattttttttctttcgttcttttttcttatgagacaaggtctcgctctgtcacctaggctggagtgcggtggcaccatcatggctcactgcagcctccacctcccgggctccagagatcgtcccacctcagcctcctgagtagctgggactacaggtgtgagctactgtgcctggcccaggaaatcttttgtaagggcctgctacaggcccggctcagtgaggctgcagtgagcaagagccgactgtccctctctcagtggggccagacctcccgcaccacaactccaggggctgctgtgcacaaatggcgccccctggagttgagtaaggaagagtctgggcagaggcctagattcttggaagagaagcagatgatacacaggtgaacaggcacatgagtggttagacattctctagatgtaatgaaggaaatacatggtgctctagaagagactcatggcggggcctgcttcagagcagtggtccaggaagcagctctcccagggtgagggaacagctggagggagatggtgtcgtcggatggaaaatgtgctaagctgggcaacacaactttgcttcctgacactgccagctcagtgatcttgggacagtcccttcccttttagactccccttgtttgctcaggtgacaaacaaggtcttgggttttttgcgctcattggaccaggtgaggtgggcatgtgccttccctttataaagtgctgagtgaggcagggggtcagaaactccagcacctgggggcgggggtgggggcgtgttgtggagttgagggtgcaggccgggagggaggctatgggctgtgtagggactttggagctggaggcagcccaccctggtaggcagctgggccggtgctaatcaagtgggaattcagtctcgtgtggccagaattaccagttgctcagctctgcagttgatctgctgaggtgagtatttttagttgtcttgagtccagaaatggacagcatcccccgagggtctaaggagcggcacctgtgggctgttttggcctcgggtcgccagtttgggaccagttgggtcttcgtgatcatcttggctgaacctttatcttgcctccctggaaacccatcatggggaggggaggtcaaggaccccgggcccaggcttcctggacatgcctcacggatggctgacctagggagccccaggcacagaagtgagctaatctggaatgaggccggggaattcgattaggcccaggtcacaggaaacagtgaatgcaggatgctgaccaggcacccctatgtgggtgtcaggggggtgagggaacaggcaagagggagggctgagaaagaggtgaaccctgggtctgggggaagtggtcagctggctggaacgttgtgtgcagacaagccctctgcagcagttgtggccttttgggacccagcattaacctaaaagaagacagtacccagccagaaccccccacccagtgcctcaaggacaatgtaggttcctcccaaatgcttccctccaaccccagggcccctgagagttcacattctattctgaactgggataacttcccttccctgcccccatcatccaacctgattcctccagaatctggagcttaaacaaccaagacacattcccccacagttccggagttcagggtccaaggtcaaggcctcggcagggctggttccttctgagggctgtgagggagtatctgttcccacctctctggctgctgggagcctcaggagcccgttggcttgtgtgtgaggttctctgggtgggttacagagtgcgtgagaaggggagggctcgtggaggacgcagagtggggagggcagcgagcattgttggagaggctgcagctccacttcctcttttgaataggaaggtctgggtgggcctcatgagaaggtgacttttgagcaaagcagtgaaggtacgggagctgctcctacggactccaggaggagaaaggagctggcaggacaggcctggaggtgtgagctggtggtgcaggatggggagagagcagcagagatgagctctttatcttctcatctaagtttaagccccacaatactggctttctggaaaccatcttgaggtgttcccatgaaggagggaggggcccactctgcctggggtgccctaaggacagagggacagtctgtgtcagtctggcccctggccaagcgtattcacacatgcctgtaatcccagcactttgggagtccaggtgggaggactgtttgaggccaggagttcaagaccagcctgggcaatatagggagacacccccatctctacaaaaaattcaaaaataaacggcatggtggcacacctgtggtcccagctacttaggaggctgaagtgggagactcacatgagctcaggagtcggaggctgcattgaaccttgattgtgccactgcactctagcaagaccctggctttttctttttttctttttttttttttttgttgttgttgttgttttcaacagggtcttgctctgtcactcaggctggaatgcagtggcgtgaccatggctcactgcagccttggcctcatgggctcaggcgatcctcctacctcagcctcttgagtagctgggaccacaagtgtgcagaccacacctggctaatttttgtatttttttgtagagatggagtttcgccatgttgcccaggctggtctcgaactcctgaactcaagcgatcctactgactcgacctcccaaaatggtaggattacaggtgtgagtcaccatgcccagccaaccctgtcttaaaaacaaaacaaaaatatctggcccctgaagccccgtgctgtgggggaggctcaaatctttctcataagctggactgcatacaggttgcagataataatttgtttaacttgtgcagtttaatcaaaaacatttggcatggggggaattttgaatagattgcccacattttattttttattatactctttttattttttggaggaagggcccaaggaccagagcagaagggctattattttaaatagaaagattttatgtaaaaatacagatttctagaccaggcacagtggctcatgcctgtaatcccagcgctttgggaggctgaggtgggtgaatcacctgatgttgggagttcgagaccaccctgaccaacatggagaaaccccgtctctactaaaaatacaaaagtagttgggcgtgatggcgcatgcctgtaatcccagctactggggaggctgaggcaagagaatcgcttgaaccgggaggtggaggttgcagtgagctgagatcataccattgcactctagcctgggcaacaagagtgaaacttcgtctcagaaaaaaaaaagacaagaaaaaacatgtcttttgtatggcttctggaatttgagtcatagttaaaaggtcatgcttgacactaatattattttgggtctagcactagcatttaaatatttactacattggatccttatctagtatacaaagtgaggtttgcatctgacttcatctttttccagatggctcctcaggtgcctaatgccatttttagacaagtctatctttaccctgttcatgtaaggggctgccttggtcagacagtgaatgcccatctgtacttgggtctgtctctgactgcctgtctatgatcttactgtaccacacattttaaactgaggcccgacacaggatttttttttttctttttttttgagacggggtcttgcttttgtcgtccaagctggagtataatggcacaatctcggctcaccgcaacctccacctcctgggttcaagtaattctcctgcctcagtctgccaagtagctgggattacaggtgcccaccaccatgcctggctaatttttgtatttttagtagagatggggttcaccatgttggccaggctggtctcgaactcctgacctcaggtgatccacctgtcttggcctcccaaagtattgggatttcaggtgtgagccaccgcacccggcctgaggattttcgcatctgacgggaccgtctcccttcatggctcttttacagagtttttctactagtcttttttcttttcctttttgagacagggtcttgctgtgttggccagactggattgcagtggcaggatctcggctcactgcagcctctgcctcctgggctcaaagaacccttccacttgagtcttcccagtagctgggactacaggagtgtgccaccatgctcggcgcgcgcgtgtgtgtgtgtgtgtgtgtacacgcaacaaggccatttatttcacctgggtgcaggcgggccgagtccgaaaagagagcaaagggtgatgggatgactacgctacgttctcctacaaatggaccttgagagcttgtttggaggttctagcaggggagcgcagctactcgtatacccttgaccgaagaccggtcctcctctatcggggatggtcgtcctcttcgaccgagtgcacagtttcgggagggacgcacatggagcggtaaggaagggaggggacacccgcctagccgccagatcagctgaatcaaccctggcgatcaatggggtgacagatgtcgcagccagatcaccctcacatcttttttttttttttgagacggagtctcactctgtcacctgggctggaatgcagtggctcgatctcggctcactgcaacctctgcctcccgggtttaagcgattctcctgcctcagcctcccgagtaactgggattacaggcacctgccactacgcccagctaatttttgtatttttagtagagaccaggtttaaccatattgcccaggctggtcttgaactcctgacctcgtgattcgcctgcctcggcctcccaaagtgctgggattacaggcttgagccaccatgcctggccttggctaattttttagtttttttgtgtagagatggggtcctgctccattgcccacgctggtctcaagtgatcctcccacttcggcctcccaaagtgctggaattacaggtgcctgacctcctgctattcttacctgtgtaatttttccacgtgaacttgagaatcaggtggtttaggccccccaccaagaaaatcttgttggtatatcatatatgtatggttttttagtggtttttgtttgattttttgagacagagtcttgctctgtcgcctaggctggagtgcagtggcacgatctcagctcaccacaaccagtgacaccattggtacttatttgcttcttcctagtgactaaaggaatgaatgagtttctcagagactagagctccaccgtccacgaggctattagcctaagctcccgccctcattctgcaccggccctttggggtggccggtgagggcccatgtgggctgacaggtctgtggccaggtggctgtggtctagccctgctccagctggaccccaggacagggagtcctgggcagctgaggacgtcgggggcaggtgggagaaatgggccctggctgcaaaggcctggagggttccagcaaagtcacggagcgtcccctgaccctgatggacagcattgacgctgctgtctttgtgcttccgcctccaggtctggttctgaacagagaccagaggctcgcctgggtgagtaccactgcctccgggtcccccgccaaggtttgcctgttagcgtctttgtcgtttttgaaaattacaggccaggcgtggtggctcacgcctgtaatcccagctactcaggaggctgaggcaggacaatcgcttgaatgggaggcagaggttgcattgagccgagatagcaccactgcactgcagcctgggcgacagagcgagactccatctcaagaaaaaaaaaacaaaagaaattatatagctaacataatacttaatgattgtcaatttaaccgtttgtaagtatgcacttcagtggcattaaatacagtcgatggaggtgaggagaggagggagacatcccaggcactggctgctgcacagggaaaagctcgaagtcagctcggtgcatctgttgagagggggattcctgatagaggctgtgaagattaaagaggggaggggcaggatgacaaaggttctcaaaaaacagcgtcccatctggaggcctgtgtcactggagcacttgtattaatagaaacttggccatctctgccagtgaggggctgtaggaccttgggcaaggtgcttaccctctctgagccttggttgtctcacgtgcaaaaagaaagtgctttcattcgctcagctggtttatgagcagcttggctaggggagccaagccctgggcctgcctttgaagggttgttgtcgagactaggtgaggtcatgtgtgttgagtggcctcgcacagtgctgtcgcttcaggtgctcatggcctgtgctattttgtgattgttaaaatatggtagaacattggacacatgtgagacactgtcattagaggtggggacgctctaactgcagggagaccgctgagagctgctgcccaggcccaggccaagagatgaggcttggaccagggcgtcagccaatggtctgggaatgttaacgtgtttgtctttgatccgtgtgggatttgttcttgagcatggtgtcagatagtgattcattttcttttctttttttcttttttgtgttttaaaagttcgatttttcggccgggcgcggtggctcacgcctgtagtcccagcactttgggaggccgaggcgggtggatcacaaggtcaggagatcgagaccatcctggctaacaaggtgaaaccccgtctctactaaaaatgcaaaaaattagccgggcgcggtggcaggcgcctgtagtcccagctactcgggaggctgaggcaggagaatggcgtgaacccgggaagcagagcttgcagtgagccgagattgcgccactgcagttcgcagtccggcctgggcgacagagcgagactccatgtcaaaaaaaaaataaataaataaaaaaaataaaagttcgatttttctttaattttattattattattattattattattgatacagagtctcgctcttgttgcaaaggctggagtgcaatggcactatctcagctcacggcaacctttgcctcccaggttcgagtgattctcctgtctcagcccccaagtagctgggattacaggcacccaccaccacacctggctaatttttgtgtttttagtggagatggggtttcaccatgttgtccaggctggtctcgaactcctgacctcaggtgatctgcctgcctcgacctcccaaagtgctgggattacaggcatgagccacagtgttcggtctatttgaattgtagagacagggtctccctctgtcacccggactggagtgccatggctcaattatggctcacacagcttcaacctcctgggctgaagtgatcttcccacctcagcctccggagtggctaggactacaggtgtgcgctaccacacccagctaaattttttacttttgtagagacagggtcttgccatgttgcccaggctggtcttgaatgcctgggctcaagctatcctcccgcctcagtttcccaaagtactgggattacaggtgtgagccactgcagccagccattgtaattgtttttctagatgaacaataccagctgttgggtggtcctccctacccactaaggctcactcactggtggtttgtcccttgtgtgtgctgaccttcgtggtaggaatttattgccagatcctagtcaatctggcttttggagatgcccccttccctgtccttagggaccatgtcttatgtgacctgttctgtagtgggagctgtgatcacccataatgctggaaggaagatggttcccagggatggaaagacttcgttaggacataaactaaattgcagaagatacacattacaaaatggagctggcccaaaattctcttttattttttaagtttctggccagctaagttttaagtttctgcagttgctcatgcctgtaatcccagcactttgggatgccaaggcaggcagatcacttgaggccaggagttaaagaccagcctcgccaacatggtgaaaccctgtctctaccaaaaaatacaaaaattagccgggtgtggtggcacacacctgtagtcccagctactcaggaggctgaggcaggagaatcgctttaactcgggaggcggagattgcagtgagctgagatcgcccaggctggagtgcagtggtgggatctcagctcactgcaacctccacctcctgggatcaagggattgtcctgcctcaacctcccaagtagctgagattacaggcgccctccaccatgctgggttaattttttgtatttttcatagagacagggttttgccatgttgggcaggctggtttcgaactcctgacctcaggtgatgtgaatttttttttttttcttgcaaaggaacatttcacaattttcgtatcacgcttgcacaggggccacgctaatcatctctttgttgttccaatttagcagtatatgtgctgctgaagcaaagcacctaccttctatttatttatttatttagagaccaagtcttactctgtcatccagggtggagtgcggtggcccgagtttggctgcctgcaacttctgcctcccgggttcaagcaattctcctgcctcagcctcctgagtagctgggattacaggcgcctgacaccatgcccagctaatttgttgtaattttagtagagatggggtttcaccacgtttgccaaactggtctcgaacttctgacctcaggcgatccacctgcctcagcttcccaaaatggtgggattacaggcgtgagtgactgtgcccagtctaattttcatatttttagtagagacagggtcaagtttgcctgttcaccttgtgcccaggaagcccctcctgtgtgcaggcccaaaaagcttggtcacaccctgctgtgagatgtggcagctgacatatgagaacacgcaggccttgggaacagtatgggaacccctgtttcagggaaggcacttcaggtcattttagtctgagaagcagaaaatagctggagggccagggtggaaacagggcagtgagttttcactggtgtgtgtgtgttcatagcaatttgtgtgtgtgtgtgtgtgtgtgtgtgtgtgtgtgttcatggcaattttatattcacaatggtgcaggagtatcgggtgtaacttaggggagctggtccttacgggagcttcccggaattaatccactcagctgcatttatgaagcttctcctctgtactccacgtgctgagaactagggatagagaaaatgctgagagctcctgcccttggagtccccagatcagagcagcacagtgcaatggaagcaaagcctcacagaacttgacatttctctagcagctatattaaaacaggcccaaggctgggtgtggtggctcacacctgtaatcccagaactttgggagtccgaggcagacagatcacctgaggtcaggagttcaagaccagcctgaccaacatggtgaaaccctgtcgctactaaaaatacaaaattaggcctggtggcgcatgcctgtaatcccagctactcggtaggctgaggcaggagaatcgcttgaacccaggaggcgggaggttgcggtaaactgagatcgcgccattgcattccagcccgggcaccaagagcaaaactcggtctcaaataaataaggctctaacaattgttctcatattttaacatccacaatgtgattcaagatgtaatcaacataaagcttgattgcattattttgcatgctaagttttccaaatccagcttcgtgtcacacctacagcacatctcactcaagctggccacatccctgccatccagacgtaaaacagtcacaagacagggctggcagggccgcggaggaggccggcaggggccatcacggagtgcccatcctgcactgtggtcccagcaagtttcttcctcctggcaagaagcctgtcccaggctggcaggggacagcgtgaggtgcagcctatggactgggaaaggggtgtggaagggccacacctaagtcctaaaatccaggcccagaagtggcccaactcacttctctgcctttaatctcacaggcatacccggtggcaaaggagtatgggaaatggagtcaggctgggtagccacgagcccaggaagaagggagaacagacttggagagggcaggagtctctggccaccaggggctaaagagccttcgatgaggcagtgatgtggggtcctgggctcagacccagggtgggtggctaaggtgccctcgccaggacttagccaccccaacagagatgggtttcgtgcccacgagagtgcctgtgccttgtgacgagaattcaccatgtttttgtctctgcaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtttcgccatgttggccaggctgctctccatctcctgacctcatgatccgcccgcctcggcctcccagtgttgggattacaggcgtgagccaccgtgcgtggcccaccatagacgatttttaagccataaaaagaaacgaagcactgacacgggctccagcatggatgagcctttaaaacatcgcgctaagtggacgaattcagacacaaccgtctacgtgttgtatggctgcattcacgttcaagtcaagtccaaatagggcacactgcagagacaaagccaggtcatggttgctcaggaccggaagcctgttgggggcggggggcggggggtggggtggggtgtgtgtgtgtccgcgtaagctcagaggttcgcgatttctttgggggcgatgaaaatgtcctgtaattgtgacgatggtctcacaactcaatgtattaaaaaccacagaattgtagactatcaacgggaggattgtgaagacataaattctctctcagagcaagtatgggctccagcgcctgttcagatcccagctctgcttttcagggctgactgtgaccaagtcctgaactccctgtgccccagaaaggctgtgccttcagcattcacttgtgcctggcttgtgccagctgagcatgagctgagattaactgagcctcaaatccaacccagggtcaagggacccagctgtgggagttggggtagcccaggctttggtttctcctcagaggcctgaacccagggcaggatgggggcaccgctgggaggcggttctaagatgaaccccaacaacccccaactcctcactttccagagcagtccacggatattttgattcaagacagaattactctgagaaggagtccctgtcgttcatgatagacacgatgaaatccaccctcaaagaggtaagacggggctcaggcagctggtgtccagccactgtcgcccactctggtcccacctcacccatctcttctcatgcactgggaagaccctgggtctgcccccaggcccaacaagtgaccaccaggatctatcaggcctcatgctccactgtggtcagtccctagaggcctagggacacatgtaatcagaattaaggaaacagagacctttggtggggaacccctgccaggttcaagctactctcgtgcctcagcctcctgagtagctgggattacaggcacctgccaccatgcccagctaatttttatattttatatttttaagagatggggtttcaccatgttggccaggctggtctcaaactcctgacctcaggtgatccgcccaccttggcctcccgaagtgctggttttgtagatgggagccaccatacccggcctagtcgcacattttacaggctcccaaaccacagcagaatacccgactgcctcatccctctgcacccatcatgacagtgggcgtgctggctgtaggcagaggtggcttttcccccaggttcctgggagcacgtggtgttttatggtcacctacccgggaacactgaccctggggcctctgcaggtttcttggcattgtcacaaagggaagaagcccacctgtggctggccggctgccaggtcagagccaaggcaggcaaggccttcctgtctggcttttttttttttttttttgagatggagtgtcgctctgttgcccaggctggagggcagtggcccgatctcggctcactccaagttccacctcccgggttcatgccattctcctgcctcagcctcccgagtagctgggactacaggcgcccgccaccacgcccggctaattttttgtatttttagtagagacggggtttcactgtcttaaccaggatgctcttgatctcctgacctcgtgatccgcccaccttggcctcccgcctgccttggcctcccaaagtgctgggaatacaggcgtgagccactgcgcccggccctgtctggcttcttgaaggcagacacaagtctgcaggctgttcacgcccccatctcattatcttttctcacgggtacctcttctgatacaatcacagcaaccctggcctcggccccgccctgtccctgccatgcaacttcacaactcagctggcctagacccctgggaggcctccaagtccctagggttagacacctcctggggtgctatggactgtcggggctccaaggagccgagtgtgggggaaactcactgtgggaggcgctcctgacctgcagggagctggaatgctgtgggagggccctgaccccggggcccatggagctccctaggctcctctggccacacctcaccacccaccccctcccctctccagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 37986 - DNA, 46265 bp, Homo sapiens; identical to SEQ ID NO: 36111

SEQ ID NO: 37987 - DNA, 895651 bp, Homo sapiens; identical to SEQ ID NO: 36080

SEQ ID NO: 37988 - DNA, 159703 bp, Homo sapiens
agctggttgggttgctggggctcggttgttgtagtcgcgatgttcttctccgaggccagagccaggtcgcggacgtgggaagccagtccctcggaacacaggaagtgggtggaagtaggtttccggagggcgactgagcctcggacttcagcttggcctgggcctctcgcttcctctcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtaaccttgagtctgcatctctcccgcctttcaaagccagcccctttgcctcaccttcctaactccaggactgaattttgggtagaatttatctcagtggcctaaatgaattaatttgcgtcacctagcggttaactcgtttgcactttgagggaaatttcagcccatgtttaagaaaatttcagtccatctttaagatttcttgagaattaatattgggataatgaaattctattttcatactctaccgctgggccaagttttagattttcgaggtccaaactgtataataaactagtaataaaaataaaccatttctgtctcattaactaaagctatttaatgttcttcaggtatttaaagcatgtgatgaagatcacaaaggatatctcagcagagaggactttaaaactgctgttgtaatgctgtttgggtacaagccctccaaggtagagctttcttatatatttggggatggggtagacgatcaaaggtgaatggatcctaagaaaagttcacagggctagcttaggatgtttataaattgctttataagcaatttcagagatgtgtccagtgctgaattttagcttcctcttaacacctcagcccagagatgaagtagaaatcttttccactggagtctacacaagcctatctcaccaccaggctgctaataactactataaatacaagatgctagagaggtgccaagagggaagactgagaggggagtgttggtaacaggagaaatttacataggacatgacatagtctctttctcgttttacttttgttgctttgtttataaaatacatccacggtcaaaaaattaaaacagtgcagaaaggtataaagttgagcataaaatccgctcgccgcctaccagagggtcccactcctaggggattaccattaacagtttttttgtgtaattctgaaattttctatccatgacatacatatgcatagtcttttattgaaaacataaatgggtaaatattgtgcctactttaacttgcttttctcatttaacaatatatcaacctaaaagcacacaccactactgcattttaaaatatggttgcatattctttttagccaggttcctgtctggggttatataggtggggttttttttttttttctgccaacattgctgcaatgatacacacatttatgtccttgtggctgtatatctgtggaataagttcctagaagtataactgctaggtcatggaatatgtacgtttaaaattttgttagatatttgctctccagaaaagattgcaccaattcaccaataatgagagttgagctgagcctccatgaacctcctgcttgagtagggcaagtttcctgctcacccctgtctttatgcttttctgctttcctgttacattcattcgagagacaacacccttcttgttaagctggaattagtcagagtcaagatattgtccagattcaagaaattgagctgccaccatcaagcaaaggaagcactcagagctcagcctggaatgccatccctcactctcattagaccagacagcttggcagttaattagggcccagctgttctcctcatgagtggactgtgcctttctgtcagattgaaagcccagcaaagccagggaccctgtgatgtcatgcctctccgccctatttgtgtcaacagaacatacttactgtgaagttgtgatgcacaataagtattaatatattctcttgacccaagtaggttgcatgaacagctcaggtgggttcagagtggctcagctatgaggggctgcctagttactgagaagcttattatggagctcagagaagtagtcagggctgactcttagaaatggcagctctcctgtttacctgtaatcatttcagttggaattacaaagcaggtcagctgaaaagagtcagcctgtgaagcattgtatttaacttggattcacctggaaaggtatcttgtctcatttttgcctttatcacccttgagtctatttggtttcaattttagaatgaggaatttaatgacagatacagtgatgtaacatactgtacatacactccatgaaatttaacagattttacttttcatattgaggtgaggttttctattttattttttaagcaaatgaactatttagtaaccgcaggtcactaaacggtatttactaatagcatgtcacctataaacttagtcatttgtacaatgaacttttattatgcaggtgacacttaatttctgtgaaattcaacagatttttttagactaggttgaggtttggggtttaattttttaatattgcttttgagcaaatgaaatattcactgactgcaggtcatgaagcaataaaatacttatataataaatcacttatacattcatgcagttttttacataattaagtttatttatttgttgagatgcagtcttgctctgtcacccaggctagagtgtagtggcgtgatctaggctcactgcaacctccactttccaggttcaagcaattctcctgcctcatcctcttgagtagctgggactacaggtgcacacgaccatacccggttcttttttttctttttttttttttgtgtttttagtagagatggggtttcaccaatgttggccagtctggtctccaactcctgacctcaagtgatccgcccacctcagcctcccaaagtgctgggattacaggcataagctactgtgcccacccatacacaatgaaatttattgtttctatttaataaaaggagtacttgctagttgctagtgatataaagatgaatgaaacacagtctctacttcgaagcagttcagagtttaatatagaaagacataaaactgtgatagataccaagaaagagaagagattgaaaaacaaagtgaagggagcaaagaaggaaggcctaattctagtggtaactataacagtctgggtggtcatttagactagagaagatagactactctgataagtatctaggaacactttgtgggtggtgggacaagttaggccctgatgactgattggatgtggtggtggtaagagtgacatgaccactgggactgaagggatagcaatgccaccaattaagagaaaatttaagagtaggttcagaggaagtcagtgagtttcgattggaacacattgagtttgaggcagctatgagcattccaggtgcattcactcgttaaataatatgctggctattgaggttatggtggtgaaaatccaccgttagattttactgcttccctgagatgtagcaatctgaaattgggtggaggggatagggctggagatagacttggggctccttggtttccatgtggttgctcaaaacacgaggctggatggcattgcccaggaagagtatgcagaataggaagagccatggtctgaggatagaacgttagggaatacaagcatttaagggtaggaggggacttgaagaagtgggagtgggaaccatttggcaggaacaagaggaaccaggaaaatgcaggaaatactgggaagggttcgagaccagaagtggagaaattatgtcagatgctgcgaaggctctaatactataacgtttataaagcccttgtaacagtgtggtaaagggcttatattttaacatttagtgaaagcaggtcctcatattttctatacagtaaagtctcaaatgtttaaagatgcataggggaaaaaagctgattagtctaaaatgataacaatgattttcattggatggctgattttttaattttcttcataattttttgtatttttcatgctttctacatcaatcatgtgatacttttataattaggaaaaaaatcttaaaaatagagccatagagcccattataacagttgtatttgtctaaagtagaaaggctgcctgcctgttagattatattatatatgggacagccaaattgattttctgttcttaaactgttttggtcaatggaataaagttttgggggctattagggactagcagattagtgtctgctattttatagatgttgatggaaaaataaaatgactattatagctattgtgtatcattacttgtctgcttggttcaacagacttggtttctcataaaatagatccttattcccacctgaagaattaagaacttgcactgtgaaaacgtgataaaattacatgttctattattttttcctcttttctagatagaagtggattctgtgatgtcttcaataaatccaaatacttctggtaatatgaaagttaatattaatttttagtaccttatttagacactgagatggcttggctgtgtccctacatcagtctcatctcaaattcctatgtgttgtggaagggacctggtggaaggtaactgaatcatgggggcgggtttttcgcatgttgttctcatgatactggataagtctcatgagatctgatggctttataagggggggcttccctgcacaagctctctctttgcctgctgccatccatgtaagacgtgacttgctcctctttgccttctgccatgattgtgaggtttctccagccacgtggaaatgtaagtccattaaacttctttcttttctaagttgcccagccttgggtatgtctttatcagtagcatgaaaacagactaacaacactcacaaaatgaaaattaaaaacagaaactaggctgggtgcagtggctcatgcctgtagtcccagcactttgggaagccaaggcaggtggatcgtctgaggtcaggagtttgagaccagcctggcaaagatgatgaaacaccgtctctactaaaaatacaaaaaattagctgggcgtggtggcaggcacctataatcccagctactctggagactgatgcaggagaattgcttgaactgaggaggtagagattgcaatgagctgagattgagccattgcactccagcctgggcgacaagagtgaaactctgtctccaaataaataaataaataaaaactatatagcattatatttaagcacatctttattttgtttcccgttgtccaaaagaaaggttttggtggtttttatttttttttaatttttaatttttgtaggtgtatatatagagaggtggtacatgagatgttttgatgtaggcatgtaatgtgtaatagtcacatcatgggaaatgggataattatctcctcgagcattaatcctttgtgttacaaacagtccagttacactcttagttattttaaaatgtttatcattttgactctagtcaccctattgtgctatcaaatactaggtattaatagtcacatcatggagaatggggtatccatgctatgaagcatttatctttcatgttaccaagaatccaattatactcttttggttattttttaatgtacaattaagttgttattgactatagttaccattctgtactatcaaatactaggtcttactctatttttttttttttgtatccattaaccatccataactctccccaacatcctcactatccttcccagcctctggtaaccatccttctactttctatgtccatgaattaaattgtcttgatttttagatcccataagtgagaacatgcagtgtttgactttctgtgccttatttgacttaacatagtgacctcccattttcatctgtgttgttgcaaatgacaggatctcattcttttttattgctgaatagtactccactgtgtatgtgtaccacattttctttatccattcatctgttgatggacactgagtcttcttccaaatcttgcctattgtgaacaatgctgcaacaaacagtatatgagaatgcagatatcttccatatgttgatttcctttcttttgggtatatacccagcagtgggattgctggatcatatggtagctttatttttagttttttgaggaacctccaaatggttctccatagtgattgtactaatttacatgcctaccagcagtttaataagagctcccttttctccatatccttgccagcgtttgttattacctgtcttttggataaaagccattttaactgtggtgagatgatattattgtagttttgatggcatttctctgatcaatgatattgagtaccttttcacatatgcctgtttgccatttgtatgtgttcttttgaggttcttttaattttgattatttataaatatgtttatcacagggaaattttaaactgttgaagtgcataaagaaaaaatatcattcataattttaacattcaaaaaatgatactaggttttctgacttgtgcagctggatgaatggacatggcacctactgaaaagagaagatggcagacgggtggggcggtggggtgggagcagggggcaggcaatacctgggggtgagggagactaagagctcaattttgagtatgtttgagaagtgttagtttactatgtcaaagcagtcagattggatgaatttcagaagtaagttctgggctgaagaaattgggagtcatcaacctgtagacagattttaaaatcatgagaatgaatgagaccacctagagagatagagtggactgagaatgttaagaactctagccagtagaagtcaggtggaagatgaagaaatggcaaaggagacttaggagtgacagaggggcaagaggaaaatcaagagtgtttgatcaaaagccaagagaagtagatattttaatgaggaaggtgtggtcagcactatcaaatgctcctgaaaggtgaggtggcataactgatgagtatcctttggagttggccacctggaggtgtttgatgactttagcaagaggcatttcaaagtgtggtgagggcagagtgggttgaagataagtggaaagtgatgatgaagtgtgacaatgtgagtagatgagtcttttgttaagtccagagtggcaatagatcaagagatgttttgtttgcttcttcttgtttctatttaaatggaagaacatgtttccaagcttagcagaatgatctagtgaagaggaggaaggaagatgagagagagggagggaaggagacctattgtgtaaggggataggatccagagcatgttagattggctttttaaatattacctttttttgaataatttaaaacttccaaaaagttcaaaataaaacagtacagagaatagcttactctctgtgtaaggtataccttttacccagattgacattgttaacattttacaccatcttccttctcctttgcactttctaccactatccccttctcttctgtaatgaatataaccaaaatatgcttatcatattcataaatatatgttgatactgttttatctgatttatcatctatattttgtcagttgatctaataacatccttaatagtatctttccttttttagtatgttaaaaaatcataagtgtatctagggaaaaaaaagacacatatgaataggaacaaagataaaaatgacagcagttggctgggagtggtgactcacacctgtaatccaagcactttgggaggccaaggcaggaggattgcttgatgccaggagttcaagaccagtctggtcaacatagtatgagactctgaatcgacaaaaaagcaaaaaaaaaaaaaaagccaggcatgatggcacgtgcctgtaatcttagctacctgggaggctgaggcaggatcccttgagcccaggagtttgaggttgcacttagccattatcataccacagcaccccagcctgggcgacagagtgagacctcatctcttaaaaaacttaattaattcaacagaaggaagaaaatgggaacaaaaaatagatggaaatagacaagtagaaaaataatatggtagatttaaatccaatcattaatgttttagttagatgtaaatgatctcaacagccccattgaaagggagatactgttaaattagataaaagagtaccaactaactctgtgttgcctagaagcccactttaaacataagggcaaaaaagattagaaatatatactgtactgaacactaaccaaaagtatgccaaagtgagcatgttaatatcagatgaagtagacttcagaagaagaaatattaccagggataaggagagccagttcattaagggaattaaacatttatgcccctggccaggtgccatgactcaagcctgtaatcccagcactttgagaggccaacgcagacgaatcacttgaggccaggagtttgagaccaaccatgatgaaaccccgtctttacgaaaaaatacaaaaaaattagctggacatggtggtgcatgcctgtaatcccagctactcggggggctgaggcacgagaatcatttgagcccaggaggtggaggttgcagtgagcccagattgcatcacggcactccagcctgggtgacagagcaagactctgtctcaaaaaaaaaaataaaaaaaaaaaatcccctaataatggaaattcaaaatacatgaagcaaaaaactaataaaactgtaaagaaaaatggacaaatccataatgatggtaggaggttgcaacacccctatcaataattaagcaagtagacataaaatcaataaggatataggagacgtgaacagcactgtcaaccagtgtgacctaattgtaatctatagaatgttctacccaacaaaagcagaatacacattcttttcaagtctacacagtatatttaataaaattggtcatactctgggccattaaacatgtcaatacatttaaagtacaaagtatgttctttgtgatggaacgacattagaaatcaatagcaaagctgtctggaaaagttgcaaatagttgttccaagtaaaagtttaaaagttccaaacaaatagcacacttctaaataactcataggtcaaagaaaaaatcaaaagggaaaaattaggaagtattttgaattgaatgaaaagaccacatttcaaattttgtaggatggattgaaagcaatacttggaaagtggtagcactaactttctatgtttaggaaagaataaaggtgtcaaactgatgacctcagcttctacctttaattatcttctacctttaactacaaaaaagagtaaataaggcccgaaataagtggaggaaaggaaatagtaaagattggaatggaaattgttgaaattgaaaagaggacaaacaagaaaaaattaaaagctgattttgttgaggtaatcaataaaaatgagaaactactacccacactgagtggggggggaaaagagagcagggattactaacatttagatttaaaatctaatattttattagatttattattagatctaataaaatctaatattttattagatttattattagatctaataaaatctaatattttattagatttattattagatctaataaaatctaatattttattagatttattattagatctaataaaatctaatattttattagatttattattagatctaataaaatctaatattttattagatttattaatattgtattaaaatctaatacactttatgtacaaggtttagaatcacatttaaaataagactttcaggattattgctaggagaacatgttcttgatataatcgctaacttgatagaattgctccaggttttaaatttcttgttgaaaattttcactttcaaaatattcagaataatgtttgatgttccattagttacaacttcttgataaagccttttctacatttttttcattagggttttttgtgaatattccaatctacagagagttttgttttctggcaaaaggatttcccacattctttgcattgataggatttctctttcttaagagttccctgatattcagtgagttattctttctggatgaagatcttaccctagtcataatatcgtgtttctctattatgttactgatatggattggctgtgtccccacccaaatctcattttgtaactcccataattcccacgtgttgtgggagggacccagtgggagataattgaataatgggggcaggtctttcccaggctgttcttgtgatagtgaataagtctcacgagatttgatggttttaaaaagagaagttccccagcacaagctctctcttgtctgctgtcattcatgtaagacatgacttgctcctctttgccttccgctatgatcgtgggggctccccagccgtgtggaactgtaagtccattaaacctctttcttttgtaaatcgtccagtctcatctttatcagcagcatgagaaaagattaatacagtggcttttctgatacatcaagtgtgactattgctgaaggcattttaacattcattattctcatagactttctttcttctgtatgttctctgattttgaattaaggatttgacttcacactgaatgttttctttccttaactagttctctaatgtgcagagaggtatggattctggaagaaagaatacagtccccacctgtattctcccagctgtactctagtgtgagtgtgtatgtatgtgtgtgtgtgtgtgtgtttatttggagaaactcaagaccacaaacattcaagaaaaggagtaaaatagcctagcaagaaatcactgctgtactctgattgctgctaacatgcaatttttctattagaattgttcaatactgaaccaatttcaaaccatccactttttcttctttccctcttattgatacgagtcaattttacatgctatttctcttgaaggaagagagcacatgtgcagattaaatgtttttccacatatattatctctcttcttaatgtttggatcttgaagaactgaaattggcggggtgtggtagctcacgcctgtagtcccatgcaatttgggaggccaaggtgggtggatcacttgagcccaggagtttgagaccagcgagagcaacatggcgaaaccccatctctacaaaaaatacaaaaatgagccaggcctgatggtacatgccagtcccagctactcagggggctgaggtagaggattgcttgagcccaggaggttgagactgctgtgagccatgatcacgccactgcacgccagcctaggtgacagagcgagaccctgtttcaaaaaaaaaaaaaaaacaggtctgaaatgctggccttggcctcctgggaactatttattcaggtaatcaactttccaaagttgttctgtataatacagctgtgacttgggaattctctgctatccattgttcttcttacttcggaacagggctctaacacaccatccacaggattcttttgcagggcccagttgctgcccagcttgcagggcaaggtcagactcacattctaggttggcccagactcagctgcttttaggaagggccagagtccggaagctagacaccctgcactttgggttcgggattatacctaaacctggatgcccaggccctgcttcccaagggcttcgaatcctcttgaaaagtaggtcatttcaatagagatttcctcgtgaaaattaagaagagtgaaaagttaagtcaaagctagtagaaataagagtaaagtatctggaagaagtgtacatgctgggagaatttgagggcagccagggtgagtagcagaaaggtgctaatgatgtttttattgcctgtaacctaacaagcaagtgaatataagcaaaaactgttgtggctgcttgaaacaaggaaatatatgagtgggagaaaaaaatcaagccattagttaaaggaagcggcagatcacagttgaggttggttctgatttatagtcttgctacctctttcagagggtttcattataaccctcattctctgtgatgcacttcataacttttccaagtgtatagaatgaagaagcttgcaactagaagagacctggaaaacagtcatctgtccttattttaaaatgaggaacctaggcttcagagaagaatcacaaaatgatatagaggaataataaaataataaatacttggcaaaatccttttacagtatttattattattatagataattgcagcaatcatttcctgaacagttatcatgcagatctgtgatgagcacattcatctgtgatgattgttatatttaatgtaactatgatattatgattatcctctgtattagtccattttcacactgctataaagaactacctgagactgagtaatttataaagaggtttaattgactcacagttccacagacttaacaggaagcatgactggggaggcctcaggaaacttagaatcatggcagaaggcaaaggtgaagcaaagaccttcttcccatggtggcaggagagagagagagtgaacggggaattgacacactctttcaaacaaccagatctggtgagaacaacaagggggaagtcagccctcatgattcagtcacctcccaccaggcccctgccctgacagggattacaattcgagatgagatttgggtagggtaaggacacagagccaaaccatattatcctcattatattttatttatcattttagatgattatttttgagacagggtctctaactcctgggctcaagtgatcctcccaccttagcctcccaaagtgctgggattacaggcatgagccactgtgcctggctatccccattttagaagttaaaaaactctggccattcatggcggtatgcacctatattcccagctacttgggaggctgaggtgggaagatcacttgagtccaggagtttgagaccagcctgggcaacagagcaagaccatatctctgaaaaaaaaaaaaagtactaaaaagtttaaaaataaaaaataaataaatccagaagcctagcaagattaaataatttgcccagagtggcaccggtagctagtaagtaccagaccaacgtgatccgaccttctagctcaccctcttaaccaattgatgagcccttcctttgatttttaatagtgccatgggtcatactcctaattgtgacaaaatcgaggccagtattcattcccctaaggaactttatgaatcaatgagttgaagtcaggagtagaatcaatacacgaaaaacaaatcaccatgttctctatagttgttaggcattaatttcaaatttggttctggactacctagcatccagaacaaataggaaaacacgagcaagcacagctgcagtcagggtccatgcaacaaaacaatttttctagagaggcataagtcctcctgccctgggatagttcttctgtgatgtctcatggaggggaggctgctgagtggatgtcagtgtcgatgagctgttcaataaatgcagtagtgaattttgtaaggctgttgcttcatcttttctcaatgtagaccagtgtttaatgtcagggcaattctatgaagggcaaaggctgtgtgttccaagtatacatatctcaggtggtctgactttattccagaataaattgtagatcattctatataaataacaacagctaagatttacagggcttttctttatgctaaaagctataaataagaactgaatgagcattgtcccactgaatcctcatacatttgtctctttgttattatctcggatctatgtaaaatatgcctaagattaaaaaccagaaaaaaggacttcagaattttgttttcactaggcgattagattgagcatcttttctgtttccttatactattgccattttaaattaatgaacatattctactttgatacttgaaaaagctttccaggaacttacttttaaccctcaactttgaatgatggaaaaatcaaagcgattgattcatcatagcagtaattatggactgtgtgactgctatccagtgtaaggtccaattgaaaaataatttgtggatgagtaggttaatggtcagttggcttgcatgcttttatttattaatatcttgtctggcttgttctaaacaagacagttgactattaaaggtattatttttctaaatttaaatatcctttttctggtcttagtttctgtcataaaacacctgctgttgtgtatggttttttattttggctcctatggaacaaagatcagggtatagcagggatgaaggttttggttgatttcagatttcaattggcttcttagttcttttctataatcaggaaactgcatacacattaaggttaccttattttgaaattataatcgtagcattttatggaatctcctacagatattcacccatccatgtttatttaattacccatttagaaaacagtgaatatgtttcactatacagatggggaagaattaggagacacagacactgacctaaagacatttaaaaatatatattttatgtgggctgggcacggtggctcacgcctgtaatcccagcactttgggaggccgaggaaggtggatcacgaggtcaggagttcaagaccagcctggccaacatggtgaaacactgtctctattaaaaatacaaaaattagctgggcgtggtggtgggtgcctgtaattgcagctactccagaggctgaggcaggagaattgcttgaacctgggaagcggaggttgcagtgagctgagatcccgccactgcactccagcctgggcgatagagcaagactccatcaaaaaatgtgtatatatcttatgtgatagggaagatgaaagaaatattgccacttcttttacggccagatgttatattactattataggcaagaaaacctataagagttcaggagggcagcactgccccctagaggaggtgtgggcctggagctggacatgctgaaggatgggtgggatttgaaatagtgatggagcaaaggagaaaagaggcggtaaatgaatgcagggcaggtgccagctgtgtgccccgcctcctgctcctgttgctggtgctgtgctctctgtgtagagttcttcagagaccctcttctgtgctgtccacgtcagtgcctgaaatcttttcttcctagatccctgttcttttacaaatctctcgcccatctcagatttgcatacctaaatatatcagctatcatgctgttaatgcagtcctcccattaacagaatctactcttcttggatttttactttttttttttaacctctgcaacagcaaggaatatagtatgtaactataaatgaattgtgtccagccgagtcagctggcatgatgagagctgggaaggattaaggaccggtgtgcacggaaggaaggatgaagctttaaagtccagaataaggtattaggactttgtggtgtttgacactgaggaaccttttaagctttatgagcaggagatgtgtataataaaaaagtaacaattcctgcctgggtttgatagaaataagattttattggttcagatttctctattctactgtaactggtttttttttttttttttgctttgttgttgttgttgttgttttgttttttgaaatggagttttgctcttgttgcccaggctggagtgcagtggcgcggtcttggctcactgcaacctctgcctcccgggttcaagcctggaggtgaacatgtgattcttctgcctcagcctcctgagtagctgggattacaggtgcggcaccacctcacctggctagtttttgtgtttttagtagagacaaggttttaccatgttggccaggctggtctttaactcctgacctcaggtgatctgcctgccgtggcctcccaaagtgctgggattacagatgtgagccatcacacctggcctctaactgtttttactcattttccctccaattatatagtaaaacttgatttcttccattaaggtagattattttctctttatttccctacacatccatagtaagctggaagaaaatattatcctctgaattcatttatcataggtgacaactcactatttttgaagtcactttcacctaccatccttgcagtctttctgtgcgaacacattatatccttctcccaccccttcactgtcatggcctccaaaagtcataatttgaattttgtgtctcagactagagaaggcattatgtcttttgaaagactgcttcatccttttaaaccctaatttttaagcatttttttaactcctggaaaaatcaatatgtgacacaatgaacatgaacccttcctttctactaaatctaggaccaggcttactgtccaaataacttgcgatttttattgttttctccttcactctccccaggtttattgcagtttctaagttgagctcactgtgatagccagatgctagactccttcattttcaagaggatttctctgtgtgcactgaccctgaagcttagaactgtgaaccacaaaaaactatacttaatggaactttcaagtaaaaaatttatatagttttgttagactttttgaatttatcttcccctgtggtgaaagatgattaccctcctaagaaactgcttaaaaacaaacaagtaaaaaaaaataatctttctagtctctctctctctatatatatatctgtcatagatatatatacatgtattaagtagtttggaaactaaaaaatatgtacatgttggccaggtgcagtggttcatgcctgtaatcccagtactttatgaggccgaggcagacggatcacaaagtcgggagttcgagaccagcctggccaatagggtgaaaccccgtctctactaaaaatacaaaaattagccgggtgtgatggcacacacctgtaatcccagctactcgggaggctgaggcagtagaatcgcttgaacccaggaggtggaggttgcagtgagccaagatcgcgctgtagcacttcagcctggcgacagagtgagactccatctaaaatatatatatatatgttatagaacatgaagagagtccattttaccaaggattgtttataaaatggaaggagatgttttccagttgtacaaaaaaatgcatggacttgcagggtcaagaaggatttgtaaagatcattggtccagtggtctttaaaccacaaacctcaatcctagatcctttggggacacattcaaagacactgttggatagggaagaatgggaagcccacccacttcaaaccaaatagttcttccttcatctcctctacacatgaggctttccattttcatataaagaagaatctttcctacagctgaaaaaagaaatagtttgccaactattgatagagtctaatgacccaggcaatttctgaataccttctgcagacatattaataataaacacagataaacacatagatctgtgtggttcctaaggttgtgatgctaatttgtaaccacggtaaaggatgtttaggtaactattagtagtggaacagtgtgcacaaatgactcaacattgtatttgaaattagaattttctgaacatattcttcctctggaggcggggtgggaggggacacaggtaatatatttcttattgggtatgaaatctgatgtcagtagaattactgaaagcctttgtgaagtggtaattttaggtttgaatgttgtgacagcaggtggagctagtagtaggaactctatttctaggttatttaaagagctagatgtatacagcttacattaatgtgttttcattgcagagcttcaggaatagcatgttactatgtattggctttggaaagtgatcatattactacaacatgagagccgagctgaacaaaaactcctctgtgctttttagaaaagggtcttgtatttggataaatgttgcgttagaagattaagacaattaaaggcatagaagggaggggatatgttcacacaatatatgcttgatgagtttaacccctagagtatggactttaagaaataaaagcatatgattgtgtgggaaaatagtgtgaaagaaattgattacacatacggagtaatttttgttattggatgggttttccttttaagtggtaataggcatacagtttaaatccacatacattttctcctagtaaaagctaaagactgtttgtttttatcctacaatattgtaaaataaagacctgaatacttcacagctccaaatactcatgagttatctgaatatgtaatttaaaagatatcaccactcaggtccttttttttccttgtgaattacacgatgaaccaggaattgtgcttttttccctttatcacttctctaagtcaaatgcaatgataagagcaaatattatcgatgtagttctctctgaattttgtttggtttttactatatcatatgttttaagaaattggagtttctgaagtgacagtttattttgctggctatgtgaatagaaagagacctactttttggcattcatttacagagttataagatcatttaaaacatgggtttttttttttctttttttgagacagagtcttactctgtcacccaggctggagtgcagtggcacgatctcggctcaccgcaacctccacctcctgggttcaggtgattcttgtgcctcagcctcctgactagctgggattacaggtgcatgccgccacacctggctaatttttgtatttttagtggagataggttttgccttgttggccaggctgatctcaaactcctgacctcaggtgatctgcctgcctcagcctcccaaattgctgggattacaggcgtgagctaccgcacctggctaatttttgtatttttagtagagacagattttgccatgttggccatgctggtctggaactcctgacctcaacctctctgcccaccttggcctcccaaagtgttaggattataggcatgagccattatacctgctctaaaacacacattttaagcctggcatggtggcatatgcctttagttccggctactggggagactgaggtgggggataacttgaggctaggattttgaggctgcagtgcgctgtggccatgcctgtgactagcctttgcactccagcctgggcaagagagcaagaccctgtctctaggaaaaaaaaaaaaaaaaaacccacatgcattttaatgctttttgctaaaaactagaaataacatcttgtttgttattattcattgaatgttacttactcagcaaacatgtaatgaatgcctactgtctgctaggcatcatgctaaacatgggataaaattttgagaacactatacactgctttccctcagcatgtctcaggcagacatgtggccaaataattaccgtagatcctaatcacttctatgattgcatgatgaacaaagggccgtcgggtcacagaaaaaggacttagctgagagaaatcagagacatattcaaacaggagatgatgcctgggttgcatctggaaggagatacaaatattcactaggagaaaaaaggagaaagtgcattattccaggcagtgtgttctatacatgcaaaggtgtggagtgcgaaagggcctcttggcttggggaagcaccaggaagttgactaggaagccttgagaggtggactggggtacgtttctgaagggtctcctaggacatgccattatcagtgaatacattattcaagaatttcggctactctagatgctacttaattgactagattttggtgttcatgaagctaaagttatggatatgatcttatgggcacatggcatagctagacttcaattttaacctcagctaacaatttgtcattatgttctctgtcacaagggtaattagataagaatggagctgcatcaatatgtattccccacaactatggaaaaaaatgctacatatgctaatttgctacagtacgtatgattgagcacctgccaggcactctggtaggtgagggagatatgccctgttgcctagaagacagccggccacctcctgaacttctcctcttggttgtctccagagcactgaacacttcacacagctgaatggcaactcttcatctcgccccaattttgctcttcccccagactttctcctctctttaagtagctcttcaagccagaatctacgggatattcttgacatctctttctttctcacctgccacatctagttcttcatcaagctatgtcatttagattctaaaatatatctggaaaccttccactcctctcatccccactgccagcaacctggcaaccacatctcttgccagtaggctcctaactggtctctctttttacatttttgctcccccacctccgtccttttatcaggataatagccagaaagatcatgtaacttcccaattcaaaccttctgttgacttcctattgccacttaaataaaacccaaattatttactgtggcccacaagagcctgtgagttttggcccctgctgccctccccaacctcatcttgtatcacttctctctggctcactttgttccagccacagcagccttttttcattttcccaccttgccacacaacagcctcggcacaggctgttcctactgccagcaatgctcttcttcccaacattaggcagttggtattgtctcatggtttaggtcttggcttaaatatctcctccttgaagggctctctctgtcaccagagtctacttgacatgaggattcctgtgaatctttttcacaacctcctgtctttcccctcattgcccatgccacagtttgtaatgaggtgtgcatttgcagttgaacctgtgtaatgactgccttccccaccagatcagtagctcccttgggactggaatcatgtgtattctcttttcccctctatttccaaagcttaatacagtgcctggcccatagtaggtcctaaaaggaatcatttaaaaagagacagatttctttttcagtttataaatctttaaatgtaaataaagatgtaggaaattaagaaaatcatttctacatttttttaaatgattggaactattttagaaaaggtatacagcttagtattacatcactaaaagaaaaaatgtgcatgtggttattgtatgtttggaggctatttttaaaacagtgataatttttttatggaaattctgagttataaaaatgaaccactctttttatatatgtagagctcagttcactaaaatgtttaaattcttggcttcgctctttaaacctactacaaagatcacattagaattcgttttaatagacattgtaagcacagtatccaatctcattttatcatgctgggctcttttatgatgagagtcgcaggaagctgagcctgaggctgctccacacgttgtggggcgtatccagggctggagatggtgccagctgtattgtttatgtaatattctccccacctttatctgtggtgtacaattggtattgacttttaagaaactacttctctgacccgatctcccagttggaaaaaaacctgccatagtgacatctggctaggaaaaaagggatcaaagaagcataaggaaacaaaaattatgagaccttgtttaataagtagtttcatgcctattagatctgttagagggaagagtgttacagttttttcaaggtcaccattcctttacccctggaaaaagctcagtgaaccctaaaagtgtcttgtgttttcactattgatttctagtgttggatctgttaaatgttagcatttagcaaaatgcctttttcggtcttcaggaaacttcacagatcttgagtaaatactgttcaccaaaattaagataaaatttgattattggtgagatttattactgtccatttctgtttaattttttcttaaagaggaagacaataatctttgacaaattgttttttccccaacttttaggtatattactcgaggggtttttaaatattgtcaggaaaaagaaggaagctcaacgatatcggaacgaagtaagacacatcttcacagcctttgacacctactgtaagtgtctctaaagtgttttgatgtaaaaaaaattacttttaagggattgcaaataggattatatacccagtaaatcaaatatataatatacttggaagattatattactgtattcattagctgttaccttaggtattgatgcacatttttttctccgtcgtgatttcttgacatttaccatagatgaaatagtatttacagttatatagttgtactaatatattgtaccttgattgtcatggggactgcaaaaggactggccctgggggatataggccatgagccacctatggaggtgtgggagaccgtgtggcttcttcatcaactcttgctctgacctacatatgattggtggaattgttttcccccatagggtgtggctgagaggggtgggtggctgtagaccccctaggccccacagatcatacacagaatgaaaagactcatggagtctagggtcagtgtcttgactgctgttatggtttccttctaaatagcaatatttcatgattctaataccacgcaaaggaaaaaacatgcattttgaagactgcattgttttggcaactcgcaaagactcaaagtctaacaccgttgttagagtgcatgtctctatatagtgctatctctggtactgagagaatcagcaaaatgatagggccagaagtgaccttcaagatcagccgggactgcactgaaggaaagtattattagaatcttaaattattccgatgagacaatctcagattaccttatctgtgaaatcaatcgtaaactactgcttttctcctagtaatatattaaaataagttttgcacaaatgttatggctgaagtaacagttgataggtcttattaaagtaagtgaatattttttattgttttcaaatagatcgtggatttttaactttggaagatttcaaaaaagcatttaggcaggtggctcccaaattaccggaaaggactgttcttgaggtattcaggtaaggcatcaaaatccttctgtacaccaccttttgatttaccatttgcttttacatgtttttgactttatggaaagaacttatttattctgatttttgagtctggaacatttttctcttgcagcatagtgtcatggtccaggagggaaatctatagttagctatgggtccttccatgcccctgacagtgaactgtaaagttgggggagcgcttgcacaccaggcaggtgcatacaagcacttatgagtaggggcaggagaggaacaggaagaaagaacttcttcagatacttacgtgtgaaccaagggaaaatggagctttagtaatatttagcatggatgctggtgtcctcacatggtctgtatttcagacaaacacaggttacatgtggttcttgagttgtctggagagaacagctggagttgcctgatggtagcccccttgttcccttgctttcaaagctactgacacatgttgctgttcacacatacctgataaagtggatttaaagattatattatgtggttcttatgaacaaatcctgacaaaatggacaagtggcttaaaagcagtttttgttaggaaactgcagattgaaggtaatattaatagtgcaaacacatgctgacgtgagaacacagcagagctgtctcttctctgactcccagcatgagctcttcatcaaccctgttaacaggtgtattcattagcgttcagcacaccagcgagagccagaaaacccaaaagaacggaaactcaaaaaatatagaaattcatttctctgccatataaacataggcaaaccaggggcgaatgttgaccacacagtcgggaaggatccagattgccccttttcttgttgctctggctgtatcaacacctggcttctccctcttgcttcaagatggttgcttaagtttcagcagtcaaatattaagtttcagcagtcaaatctgaattccagctggttaggaggaaaagaaagtagaaggtatgcactccttttcaggatatatattatttccacttacaacccagtgaccaaaacttagttccaaggtcatgcacagctgcaagggggaagggttttggaaaatgtagtctttgctctgggcaatgatgtgcccacgaatagaggttctgataccaaggaagagggggagagaatggatattgggggacatctggcagatgttcccatttgggataaaagtaacttaatgaaatatgaccagagccagcccttctcaatagaaattagtaaataggttatttgaatgaagatttgcagtcattatcattaacagtgacatatatgaaattcatttgctgcatcattgacaagcaagctactgagcaagctattgaagaagagcaaagaagttaaagccagatgcatacaaaatgcttatgggaaaacattacttagctgattttgtaaaagcaaatcctttaaaatgtagcatctttgtattttgtgatgagataggtagtgaatatcaatatacttctaccatacaaaagttgtttttaacaaaggaactaaaaattgatactcattttctttttacaaaaagaccagttgtccaaatatgatgaactttatgtgttaaatggttttagtagatactaccttatagagatttttgaaaaatgtttttaaatatagccattcaagatacaggcaatgttttaacgatgaatgagaaagtaacaccttcttagaagaaaagctatgctacagggagaacatttttgaaatagatgtttgaaaatgttattttattttaaaacataatgtcacctattaaaattcatatctgcatgtttggtatgtttaaaatggaatgtcctggccaggcatggtggctcatatctgtaatccccacactttgggaggccgaggcaggtggatcacctgaagtcaggaattcgagaccagcctggccaacatggcgaaaccccatgtctactaaaaagacaaaaattagctgggcatggtggcatgcgctgtagtcccagctactcgggaagctgaagcaggagaatcacttgaacctgggatgcggaggttgctgtgagctgagatcacaccactgcactctagcctgggtgacagagtgagactctgtctcaaaaatctgtaaagttgtggtgattttagcacacaattattaaaaacagaaattcggcctggtgtggtggttcatgcctgtaatcctagcactttaggaggccaaggcaggaggactgcttgaggccaagagttcaagaccaacctgggcaacagagaccctgtctctacacaaaatacaaaaattagccaggtatggtggcatatacctgtagtcctagctgctagctatttgggaggctgagatgggaggatctcttgagcccagaagttcgaggctgcagtgagccaaggttgcacccctgcaccccagcctgggcaacagagcaagaccctcctaaaaaaaaatatgtgtgtgtgtatatatatatatatgtatgtatttatatgtccatctttccataggttagagtatatcttgaaaatgtattaaagctattgaattatatatataattatatattgaactatatatgtaatatataattatgattggaattatataaatgtatataattgtatatatgtaatatataattatagatgtttaagcatatgtaatatgtaatatataattatttaattatatatgtaatctataatatataattaattgcatttatttaattatatatgcaatatataattatataattaatataatcagttatatacaacagaattatatattattaataattgtatatatgattaacatatataaacatacataattatatatataattcaatagcaagatatcaggaaagatggactttactagctgaattttagttggcattaacaacaaaataataatttaagaaaacaaaacaaattttcaaattcctaaacctttgcattatcagaggatggagtcagtggcatgatgagcttttcccatttagatctatgtatttacatgaggtacctatactgtccattaaaaccaagtatcaaaacaaattgaattttaaattgctcacttataaaatattaagccaagattttcagaaataatagagtatattaatgtacattgttctggttaagtattaataatttctagagacatcagaaagttatttgccattaataaaatattttatctttaattctttagaaatttctatactttaaccatgtacatagtatattaatataataacatatgtgctcctctataaataagtatattcatgttgtggagtatatgcccacaaatcttgtacttcctagggttgtgagaccaaaacagtttggaaaccactgtaacatacagccaaagaagatactttgttgactgaatatgggctttttaaactctcaactgtatttttataatatcacaatcccaaagttagactaaataatgaataacacggtcaggcatggtggcttgcacctgtaatcccagcactttgggaggccgaggcgggcggatcacctgaagtcaggagttccagaccagcctggccaacatggcgaaactccatctatactaaaaagtacaagaattagctgggcgtggtggtgggcgcctgtaatcccagctactcaggaggctgaggcagtagaatcgcttgaacccgggaggtcgaagttgtagtgagccgagatcgtgccactgcacttcagcctgggcaacaagagcgagactccgtctcaaaaaaaaaaaaagaataacacatattaaaggaagttgcgaactggaaaaatatttcctgtttgtgtaaattgaagtaggccaaagaaacagagatgtctaacatatcacacatatccttatttcagtcatgcaaacaattttcaataataaaaaaatcagctgctgaggctattagtgatgcaaaattatttaatgtttccaaggttagacgttcactttttgagacgcttgagtagcttttcacttaattgactagcatgtatgggtttctttacccaggtccacaattcactacacaggtccagaaaaaaagctgatctctgaaaagcactaggagaaggcagctagagagggagaattctaattaggccggggtcctctgtggcttgaatgactgaataagtttttatagtcttcaattcagtgactgccagattcttcccaaagaaatttctagagatcaagagtaggctctttcggaagtacttgcccgtattacactttaattttacaaaccaaacaacagcaattcaaccaatcaaacaacaaaaacaatccaaagaaagagacttggacataggcatcaaggaatcatttcactttataatttaatagaacactggtgtatcattcattaattctgaaagtgagaactaaatgtaaaataattttgtaaggtttgtgaattgttgcctaggtattctggtgatgtttactttagtgattttatcattaatgaaagcaatgtgtttttttagaaaacatattattagggttcataacgttgacattctgttgtgcaatcataatctcctgttttgttttagtcatagctctacagttgaatgaattcaaagctcacctccaggccttttgctatggtttctgtttagctgaagtttatcctcaagtaggggtcataagaattatattccccactgtctttcatgttcaaaaatgcttatctgggtcattgtatttgaataaaaatatgtaatggattgaatgctaacatttttgagtcacattctttttctttgagaacattggttatgcctattttggaagtccttttaagttttttgctaatttttattttaattgcttgctttgctcttagtatattaccatgtctcttcgtgtattttcaacaatatctattctcctttgtgctgcatccaatttggcatttttctttttctgttttggttttacttttctcttacatttctttcttgagctgtatctgctgatgtctcatatccttttgttattttgctgtatcttgttattttgtagtagctcccctacctactttcagctcttgttttatagaggtctttgttttattaggggaaacagtgatttttcagattttatttttaaatgagtgattgcttgggggaaactaattataactttttccacataaattaatgaaagcaagttttctaccaagagaaaagttgtgaggaacaaattactttcataaaccaagggatatctcatatacaaaattcaaaattgctactcatttgttatgtctaaagatattataaaatctttaatacttggatttcaaaatttgagacttttttcagtgtttgaaacttaaaactttcgggtgggtgcggtggctcatgcctgtaatccaacactttgggaggccgagacgagtgggtcacttgagaccagcctggccaacatggtgaaaccccgtctctactaaaaataaaaaaaattatcccagcatggtggtgcatacctgtaatcccagctactcaggaggctgaggcacaagaattgcttgaactttggaggcgggggttgcagtgagccgagatcacgccactgcactccaacctgggcgacggagcaagactctgtctcaaaaaaaaacttgtctctactgaaaatacaaaaattagctgggtgtggtggcacgtgcctgtagacccagctacccaggaggctgaggcaggagaatcgcttgaacccgggaggcggaggttgcagtgagcccaggctgcgccattgcactccagcctgggtgacagagcaagactccatctcaaaaaaaaaaaaaaagaaagaaacataactttgtattcctcttagagctggtagtcacaatttgtgtgtttgtgtactgtatcaaagatgatgtttcatttttagtcagaatttctacccattaaaaatggcagaagttcaagagacataagagctgtttgtactatagtactgtttgtactatagaattaatgttagataatagggtgttttgagcaattaaaagttaagtaagaaacatctttcctctttaacactaataaaactgactgaaaattttgtagtgctatcttttgtttttcatgttcagaaatcttcagtgactctaaggggtatagttaaaactctttaacctggctttccaacatctggtctcttttccaacatctggtccccttttcaaactcatcttacatcagtcccaaattcctgtgtttcccttggcgtggtacttgttcctttgattatgtgatgtgcatttatgcttcattctgtttgcagtgcctttctctactcttacctgtccaggtttaaaccatctttaaaggtcctcctcaataaagcctttctttctctgcattgtacagtcttctttccttaaatgttgatagtatttattgttatgtattttttcattcacttacttgataaatgaaaacacagtgtttatgattatccccataaattagtacaagttctttgagtttatggacttatatctgtaatcgccactgtccttggcatgttgccttttgcactgcagttaataaataatcgttggtccattgccacttattccaaataccctgtgacagtaaaattctgttttcttcgtggtttaatttatttctcataaactaggaaagagtcctttaaaatgcagtcaggagcttcatagccacatgtggctttgctttccattttcctctgtctacatgtgattttcatgaattaatctctggtggtctctttttgctttatttcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaatgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttgaatattagaaattgggtgaaaatgagaatgtcattgcttgttgaataagatattttcaaaatcagagtattagtgggggctgggtcttaggaatgcaattgtaaaagggagtgatggatattcccttggcagaaaaattatatagatgttatatcacagccattataggggtaaggactgtcaccagcttgggtaaaacaaataggctcttctgttatgctgattggaagagtcttacagagctgagggcctaaaggaaagtgatttcagagaacatttactttttcaagtcatttgcgtctcttttgaaatgttatttctcactgtaatttttagcttcccataattcctttctgccagcagccaacttgtggagtatcattttcctggtccatctctaacaagagaaaatttccagtcattattttgtgcttcagaatgattctgtgtatgatcatgcaacttcagtaagatcacagttattaaaatgagtacctaatttagtgactatgactattggtctttgagtatctgcctgcttccaggtatagaaacatccataaaaacacctacaaatcatatttcattctttgtagccatacatagataacagtcatcagctataccttctgtgtgaatggcatgaccgaagaagtagacttcttgaggtcccaacttttatttcatgaaattttgtgtcttctctggaatggaaatgctttagtttttatttcaatggttttgtttcaaaattatattgtcagagattcccttttctgattgtcctgttgcacatgcttataagatggggagtatgaatgtgtgtaagcttttcaagctgacctcagaatttcctctctgagggacttctagggattttcacatgtgatatattgaataaaactgtactttaaaaattcagctatagaaataattatgttctagtcattttaagaaaataccaatttttcagagggttcttaattgattttgattgtctctttttaccagtatgaactttagaaatggaggaattgaaactcagaaactggaccaggaagcaagtagagaagatgactttgttacatagattttcaaatagattatgttattttggtttcttcatttaagctaacttatgaaggatatattattagattggaaggaatatttagtctcttcacatttaggaagctcagattttgaagtcctctctcatgttaaacccatccggatacaaattcgattcatccttcaaggcccagctgttaagatatttcttatcttgaaagccggccctactctgccaccttgcaacccccaaaaaggaaattgtcttcaccttctgctttaaactcctaatctttcataaatatctttcttcttcatgctttttcatagttatttgtacccatgtgttatttccagtgtcagaatggaagctaaacgtgagaaggcatagtagggtattcatcatcacactccccacacccgtagcacagttttgtaggtcttgaatagatgacttcatcttatgtaaatgaatggcttatttcattggaaaaaaaaccacaggctttttattactattatttgttttactctttaaataccacactggcaccatgttaaggtcaggagtctagtcaagccccaggatgagttctaggcccagctctgcctctgacccatttttccacaaatcagtgaacctctctggactgcactgtcatctgagaaaaaagggtgttgtgttatacaatctggcaggcttctccagctctgaaattcactggtggcgtcatctatcatggagaatggcatggccgtctcctttattttccctgcataccacagatattattcagaatccaccacagcatgaatatagatgtggtctgtcagtgtgacaaagactgttctcaagaggaaattactgggtttgacagctacccaaccctgggtttagtttttgggatgtcactatagcaagtgttgtggccgatgtatccaattcctcatctacatatatggctgaatatgctgttcttgctgtaatagcatgagggctatttttcttttaattcagctgtcacataggaaactgctgccatggtttccttctatgaccaaatgttgctaaccctttcagtcatccttgaagttattaatagccacacatcatgaatgtattcatgccatttcctttatagaaaaaggaatcaatttctcgtgtttttcttttgtagtagatagctaacttctaggtggaattttggtaatattgaatgtcatatttataaaataagagaaatctgtatttaataaaatacacattttatgagatacttaacaattgttttaaaatgccatgacaaagtaggccaggaattaagaattacatcaaagttttgattgtccaccttatgtatagactaaaatcaagaccaaagatttccagtactacatttttatcgatgacagcaacctatgagtttgttgccttatgtctggccatcttgtctgcctacctcctaccccatcgttctcctccatcaggctacctcagataaatgcatccttgacattcaaagagttctccaaagaccagtggcatcagcatcagggagcttattagcaacgcctaatctcaggccccactccaaaggtactgagtcagacatgtttaatattcctaggtgattcatatgcacattaaagtttgaaaatcactggcctaccctagttaaattttggataatttgagtaaattatcatctctatttatgttacttcctaacttcaatagctttttattccctaccaaataatgtctagattccttagcctgacatacaaggcccctacagacagaaacatacaaggccatatagacagaaatggctgtgccttttttgcatgtcccccagtatttcatcctactccgcctttctggtcttcttgccatatactgtctcatttctctcctagcatttttgtttatggcaggttcactgctctctttcctcttcctcccactaccccatccacatatctgaatggtatccattccttagctgaacattcttctatgtagcctttcttttctttctttcttttctttttttttttttagacagagtctcactttgtcacctagactggagttcagtggcgcgacctcggctcactgcaacctctgcctcccaggttcaagtgattctcctgcctcagcctcccaagtagctgggattacaggcgcccaccactatgcgcagctaatttttgtatttatagtagagatggggtttcaccatgttggccaggccggtctcaaacccctgacctcaagtgatccaccctcctcggactcccggagtgctgggatcacaggtgtgagccaccacgcccggccctatgtagcctttctttatcactccagcccacaaaatatctttcctcttctgtagaactcctataacacttgccatattgacatatttaatggtagcaaccgcaacaccactggcaactaatatttactaagtgttttccatgtgccaggcactgtgctgaacggatcctcacaggaacatcttgggttgggctccgtctgtccccattttacacatgagggaaaagctcagagaggtctaaagacttgctcaaggtcaccagctggtgactgatggaaccaagattcaaaccgaaggaggctgcctttccagcttatgctcttaatcactgtcatattcctttctcacttcttttaacagcgttagagaccctgaaggtaggaagcatgcttttgtgtccctccattgcctagcataaacaccaggaagcaaggcctattcactctgccctaagagcattcttgatgcactggttgcatgattatatggcttttccctgttcctatgaagtggtttggtttggattgttatacttgagatttcatttgaaaaaatatacaaaaggaagctgatgcaacatttatatccatcaaactgtagaaggcattccagttcagattgctctgataggaacccatgtgttacgcatcttgcctatggaattatatcacaagaccaaaggatttgccaaataaattataaaaatcaaatatattgaaaattgctgagaggagttttatcataattttaactggagtgggagtgctaaacgaaattcatgactttctcttcataagggaggattatactttgattcacttggaagagtctttaatcagttactgtgagtttagcattgtgttttataaattccagctgggccacattatctgctcttcttctctccttggttgcaacctgctgctggagaaaatcagggcaaagcagtgattaaatccactatagacttactgtgaagcctcgtagttcctgcactcgctcttgcctctgcctaccccagcccttgaagctactgatgatggctcctttggtagactggctcacccatttcctaagccagccccaggaaaggcagaacaagtactaatactaataccctttactctcccccctactctgcctgtttatcactcacttttacctgcctcccactcatggagtttttagaattttaaaatcccaggactggttaccggtggctagacatgaatcctggactcttgtcattattcccgaccctcctcctttctcccagtgccatgtcctccacatgccacacctctagtctccttagctaccattaagcccaagaatcaatgttgacaccactttttcctccttatcttcacttaggcctctgtccaaggcccccgccctttgttctgacccatactgcagggcctgcactgttaagtgggctcaggtgcttggacctgctcttggccgatctgagatctgaagcttacttaccacttgccttctttctttaatgtgtctgcctccccatcatacattccacagtgaattagtgtttctctctctctctctctctctctgtctctctctctctctctcatcaagtgtgatgtctgagaaatctctaaactctgctatccaccttcctggatcctcttgcttagatcccctggtgccggccttgatcccagaatgggaccatgtcacagtacaggcagaaactgatctctatgtgaccaaagtgtttgggctaccagaatctgtcttctgtactcagttcccccaccctggtcctgtgtcattccagaatgccttccatttcatgcagagatctggtatgcctgtcactcaggtcagacaatacccctattgctatccaggagaaatgtaactcagctggcttcagttccctgttatagggatggcacgtagttgacatgcctgccactgacccctcctgtacctgtggctgccctcttctgcagaactcagagttcttctcagtacaataccccaagccagctcattagagttgtcatatgagatcaaatctcttgctctctctgtaaggatgtattctctgtgatggttgtaccaaacctttcccactactgtgctttgcaggtgatcttgcctttttcttcatggagaggatcatggcctcttcctgggtttactgccttctcttcatctcttttctgtattcctttaattttctttcttcttcttcttctttttttttttttgagatggagtctcgctctgttgcccaggctggagtgcagtggtgtgatctcggctcactgcaacctccacctcctgggttcaagcgattctcctgcctcagcctcccaagtagctgggattacagacgtgtgctaccatgcccggctaatttttgtatttttagtagagatggggtttcaccatgttggtcaggctggtgtggaactcctgacctcaggtgatccacctgccttggcctcctaaagtgctgggattacaggcgtgagccaccacgcccagccttcctttaattttatttctgaggaaaaggggtctcttctttttttcctaattcctctcttttgttctggtcttctctcttcccctttttttgatctaagacatttctccatcagccattcccacttctgtttataatgcctatccctgcctgaagatatactcatatccatcctagaaagctgctctccccaactaagtacctccagttgtcccctgtcctttttctcagggttcattgttgccagcttctcacagcattcacaccctgcctggagagccagtcctcgattctcgctcttccccagctttcattgcactgtattgtccactgcagtcacagtgcttcccgttcattgattaccaactacgtgttgccttacttagtccttacagtgactctccacatcaacggcatttctatccattttacagttaaagctgagagtcctttattgctcaattcaaaccaaacaactaattcgcaattattattatttttttggtcaaagaagtcacagaaccaagcccctagggcaatcagaattttttatttgattataatcatgttgctggtacttgttaatggtcaagtgttttcataacctcaaaatgttattttcttgtttagaaatgccactgcctagtaatgataatgatggagtagactgaatttacaggtagaataaaatgtctgcactcccatgttaattgcagcattattcacaatagccgagatatggaaacccatattaagtgcccaccactggatgaatggataaagaaattgtggtatgtgtgtacagcagaatattattcagccttaaaaaagaaggaaatcctgccatttgcaacagcatggaggaatctggggacattatgctaagtgaaagaagccagacacagaaagacaaatattgcatgatattacttatatgtgacatctaaactagtcaaacttggagaaaaagagtggaatggtagttgccaggggctgggaagtggggaagatggggagatgtcggtcagaggatacaaaattttagttacagggtgaatgaattctagtgatctagtgtacagcatggtaactatagttaatgtgttgtgtacttcagatttgccaagggagcagatcttaagtgttttcaacacacacatacacacacacacacacacacacacacacacacacacacacacacgaagcatgtcaggtgatggatatgctaattagcttgactgtgagtcattacacaaagtatacttttataaaaacgtcatcttgtataccttaaatatagacaattttttgtcagtcatacctcaaaaaatgtctacacagacttagtgagactcatgacatgagtcatgttaaaggatataagaaacaaataaaagtttaaaaatgcttttcttaacccaagtcttattgttaggattcctcataatccagtcatgacttcaattagaaatccttgccgtgggatatcaagactcttgtccaaggagaggaaggggcaggagggtctcactcttgttctctccttgtaaaaatttaactctgtttgcaggagagagtatttgacgaatacatgaacaaataaatgaatgaaatgaacgaaggaatagaattaatctgatcaaagtttacatgttcaaattatgtgttgaattggatagagcagctgctggcccttacttttttctgggcctatttcaaatggtcttctttactaggctttcaattggagatttagacttggaggctttaacaaatatgaattgagtacacatttgtatagcgatttaaactgctattatcacaaaattgtcacagtagttttaaactctgtcagatggcttttaaccaaaccctgccatcagagtcaaatttgattctttggatggttctttccttttttctgtctctttcacattgtctagtaaagaagtttcttcaatgaccagttttgtcatagagttggtgccatttattctgtgggttacaaatttatcatcacaagtagctagatgtacttctcatagacaacttgtatccacaaatttgttgtttttttctttttttcttttttttttttctgagccattctccctagaaaacacaaattgttttggggggaaaaattagactgttcttcaggggtatttattttcatgattcactgtgcagagatcggagttgtgccttaagggcttggctctgctctcttgatactggtatccattgctaggtgtggctcaattaaacaggaaggatggctagatagcatatatattcacatgtcaaatggcagcatccatctttgagacaggaatcttggtgggaaaagttcaattttttaacaaatgtgaaattacctcctcaatcatttttatttccggttaaattaatgtcttatataaacactgtaggctagcatagtatttgataccatttagtttgctctctcttttagttcctaattttcattgtagttctcagtgtttgctttttgagtgtgagtttatggcagaataaatcaaattaactttggtgggtagattgagttttctctgatgacctttactaaccaaaacatactttcttctcaggtgaaaaagccagagtggattattatttatttgactgacaaagaaatgcatttctaattttatttagtgactaaaataaattgattcaccgtaaattaaatatgaaataaatgcatgatcctctcttaatgaaccaaacagattgagagccgagcacctttgcagtacacctctttcaccagttggtggtgccaaaaactctgctaagaaactgattgaaagaacagaaggttaaccaggagcctttcttaataagcgttatttttcgtagtttttgaaaaatttgtactgaaaacatatgcccaaattatcgcattttctaaggttaggaagcaaagctaatccctctggtgaccagcagaatatatttctagtaagcttctgtaataatgtcattggtctatgttaatattcacatattggaaattgcaaagttgtgtaacatctgactccatcctggaaatagcctttagtgtgcttgcctggagagtggaggagcaaatgataataatgtgtacagagaagaagagtgatgttcctggctatatttattgtcgaatttaggtctttaaaaatattgacttgcgttattattactatgtgtttttttttaaccattaatatattcctgtgacagcaggaacattgcttttttgtgtgtgtgtgggcgggggcggctaggtttgtttaaccctttactgtttagccctgaaaaagtccaaatggagcagtagcctgttgcttgaatgtgtcctgagatacagtcaaaagaacccagcctttggagtcagagagatcaggttttgaatttccctacatatttcataactgtctctctcttttttttttttcttttcgagaccaaggtctcactctgttgcccaggctggagtgcagtggtgcgatcttggctcactgcaacctccacctcccagattcaagcgattctcatacctaagcttcccaagtagctgggactacaggtgtgcaccaccatgcccgggtaatttttgtatttttagtagagacggggtttcaccatgttggccaggctagtctccaactcctggcctcaagtgatccgcctgcttcatcctcccaaagtgctgggattacaggcgtgagccactgtacccagcctttcataactgtcttttaattacttatgcagattttttactgctcagtttttccagtttgtaaaatggagataataacatcttcccctcagagttggagtaaacatcacctgagataacggatgtgctgattaagtgctcctcaccctgtccttttctagtttaagcacagactcagttctttttgagcctccaccacatcccatgctcttagccagggccttaggaccggagtccctccttgggtgtgatgatgcctcatgctgcgttaatgagaagatgtttccaggttgtaaagttccacaaggattttgtaaagaactcacaaaagagatactcatattgttagctatatgtggtgttcagatatttgcccgtctaccctgggatgtttccatgttgatctgaatctgcctaaatgtttaagattggagaagggagcacagggttgctgacaggtgtagcaacagtgtccccaacagttcattcatccatttattccacaaacttttactcaacattattattgctgggtctccggcatacaaagatgaattcccagagagcctgaagatgcttctgagagctgcagactcaaggagcaggatgctttctgcttggcaggaattgataagcagccctgatctatgaaagagcaagaaagataaatttaaatattttttaaaatattattttacaaagttataagactgtaaaaaaaattttaactttgaaaaactctgatagttgtattaagcttttgatagcatcatgtttggaagaatgagcaaatcagaagaagccttcagcgtggttggtaaagtcataaaacactgttaattaggagctttagcccagtatagaattttaaaatacaactgtataaggtatatatattttttaggaatagcacaactaacatctttgattagattcgattgaaagattcagacccttaagatttagagattacggaatcatagaactggatggtggctgggactttaggaatcacatatgccatctcccttattttctagctaagaaaatggaagtcaaacaaacgtatgtgactcacccaaggttacatagacctggatcaaaactcaggtctccatgccaagacattatttttccatcctaactcctatacaatgagccattttcagtagataaatatatacttgtcccatctcaataaactttcatgctaaatatggagtatcatgtccgccctgttaccaaaatgaaaactttggccgtaccttcggcagttaattaaggtgctcctacttccatctcagagctgagctgaggggaggcagggcacaccaggcctgtcatgtgcagttctcagccagagccagtgagttccccacagaagcaggcagcgttttcattcacgcctgccttgcctgcttctcgtttcttgctagatgaatggcatcatatgccgcaggtgtattagtaatttctgagtttgttccccactaaaaatgacctcattgttttgtgcttcttttccataattatacagtaacaggaaaataaaccagctctgagtacagcccacagcagaaatcttgtgctctttatgcaagtttgatttatagacgtgtactgcagagcagagtgactatgaaacattcatcttcccattgctagttgccatggaaatcgagtacacagagcagtgtcattccagtcctggtgatgcctgcagtagtttattcctttgttgttcccgtttcttaagcaactgcctagcattctttcatcattacaattaatcatgcacacaagtttttatctttcgtcgcacatagaaagtactaaaacgtatgacaaaaacagggagaatttaaatattcctatggctttaaatatgcatttgtaattttcatcctcagtcccactggaaaaataggtcatgtaaaaaaagcatatattaatgtacagatatttcaatagagcagtatagaaatttgaaggaaaaacaatgctaactaagcccaggaagcccaggaaaccttaaggaacttcagatcctgagggtcccccagtgtttagatctaaatcagcctgggtaatgccaatcaaaaaagaaaaaaaaagcccctgagctatgtatcatcaactcctgttttgatttgttagtctccttaacggtttgaacaacctagatatttgctggatagacatgctagacgttagaatagagatcctttttctctttaaaggccaataaagttcaggattttttttttaagtgggagtaaaaggaattctagttttttcttttttcaatgaaaccattttacctcagttttaacccacatagttcatagtctatagcataccaacaatgaataaatgcttgttgattagccactgccttcttttgtggacttctggccattctgttggctaagaaagcgtgttctagaacaattctctggatctaaatccctgctgcattgcttattagctgtgagacctttgaaaagtatctcagcttgccttagtttccccatctgtagagggaacagctataaaattaagataatgacaggttgttaggaggcttaacagggataattcatgcaaattgctcagccctgtgcctggcacaggacacgtgctctgtcagtggggactgctgccgtggcagtggtggtttctattgccatgactactacaggccacaactgaatggagaactgtgctctgacctagagaataatacttggttgatctacagcaattctagccccaaagccgcaggactctgttcccagcatccaggctcacacaatgattgctggtgctttgttgtgcttgggctacatggacttgtttcatctcaagactgtggatactaggatggtggctgagaagtatttacaggggtctttttatctgcaaattgagaagagaaggctgctacaggcagtccttgaagatgcaaatttctcatctttgacctggatttgtttcttacaaggagctgtgtgcggagcacgttgggagggagtgggctgcctttacttgtcttgaggaaggttctcgtgtttgtctgcgtagtctgaaataacgtctgacctactgcctctccacccccaaaccccccttgtcactcggcagtgcctgcagcattccttcagcctttctggaattgaagttttcctaactggtggcagaagcattctttgttgaaattcactctccttggcagttctccagggcacacggcaatgcctatttatttgatttagcctttgtttggttagccttgtattttgtctgttttgctttgcgaagttcttttttccccaaattttcatgtttaaatcccttggacttcacttctatttattttactagcttgctttaaaatactgctaaaagttgtttgctttaagctctcacaaaatgagtagtcttggattcatttgtctgttttctccaagcctgatccatagtgtgtgtactaggtgcacctttgttaattattaaaacaaaatagactttatggtttgtactttgtacatccgaatattatactacattgtctccagttctctttatttagctctttgtttttttaccctgtcctccaatcattaggctcatgttaattctaaagagatagaagtagcttaacttttctgaatcttttcgttctccctcctctgccattcttcctgcttcttcccacaatataaaaacccgtccgactctcctgtcttccgagtgaagctggcaacactccaagtgacatgagtaccctaagacacccatttttttgtaagtaaacattcagtgacgaaacttagaccttctctagacatttttatgtatgtatgtatgtatgtatgtatgtatgtatgtatgtatgtatgtatttgagacagattctcattctgttgcccaggctggagtgcagtgacacagtctctgctcactgcagtctccgcctcctggttcgagtgattctcatgcctcaacctctcgagtagctaggattacaggtgcccgccatcacacccagcaaatttttgtatttttagtagagatagggtttcaccatgttggccaggctggtctcgaactcctggccttaagtgatccgcctgcctcagcctcccaaagtgctgggattacaggcgtgagccactgcacccggtcactagacattttaaatcctctcaagacccctgattgtatgtgtggccttcacctcacacttaacgtggccaaaatgcactcctgccttctctttgtcccctaatcactgtaagagagatctttccctgtgctcttttattctcaggcttatatctttctttgttttggaaacacatatttgttagaatcttctgcattgcagatactgggattgtatgaaaatgaacaagatagaaactgctctgccctttaggagcttagagtctagttgaggatgtaggtggttagaatccaagatggttaatcctgaaagatgactacaaagtactatggagaagaagaacgcttgctgcagactggggagggggcaccaaggctgacatcagagaagtgatagccggcgtgagacctggaggatggtctccatttgcctgacttcgccttagccagggaaggagggagggcatattctagacagagtgcatctgcagaggtcagcgggagagcatgaataacagagttgttacgcatagttagcctactatcaaatacacctatttttttcagtgggtgggtggaacgagagatgaatgcagagtgatgagactggagagataggcagtgccaggtgatgagggtcttgtaagagttcagactttatcctgagataccgggaagccatcgaaatgtagggaagtgaggtgatcagacattttttgttttgttttgttttttgagacagagtcttgccctgtcgcccaggctgaagtgcaatggcgcgatctcagctcactgcaacgtccgcccccccggcttcaagctattctccctgcctcagcctcccaagtagctgtgattacaggtgcatgccaccactcccagctaattttttgtatttttagtagagacgaggttttgccacattggccaggctggtctcaaactcctcgccataggtgatccgcccaccttggcctcccaaagtgctgggattacaggcgtgagtcatcatgcccagccgatgtgatcagacttacatgatctctcctagtgtagtgtggagaatggattaaaatgtggcaagaatagcctctatttgggctgatcctagggaccgttttcccaactcagccttctctttaactccacagtgtttgtccagcccagcatgcatttttctgattagcatgagggttcatctcaaacatcagctccctttctctagcttcctgtcttaaaggccaggactgtgtcttttccctagctctgggctggctcttactctacactaaatgtgtcatctggagcaccaactggatccaggctttaccattgcccagagagtctgttgttttgcctactatcttggctcccctgggattttggtgccagcttagatctagcctgagttcagtgatctcctttgacccctgaaattcattgccattcacacgttggctcttcctgctcagccagtctagaacaaacctgccgctgagggaatccctctcttttcccacttgcagttgagtatcctagatacttcacaattgatctccattgtatacctacatagaacaataccttcgataagatggattgaggtaaggtgaggagaaccagctacaggttgagtatctcttatccaaagtgcttgggaccagaaatgtttcagatttttttattttttcagattttggaatatttgcatatcataatgagataacataagaatgggacccaagtctaaacacaaaattcatttaagtttcatatataccttatacacaaagcctgaaggtaattttatacaatatttttcatagttttgtgcataagaagtttgtcttaaatacttatgtatggaattttccactcgtggtgtaatattggtactcagaaagtttcggattttggagcatttcggagtttggatttccagggcaagttacttaacttctctgtgccttagtttcttcatttataaactgcaggtattaagagaacttacaccagagttgtttggaggattaagcgagcgaatgcctgtcaaacactgtgcctggcccataactagctctcactgcttattcatgttgttattatggtgtctagacttaaccctagggaaagtgggagaacataaaaggtttttgacttcaggaatatttgacaacagacaaatgggtattaatcttgaaaggtccacccctcctcttcactgtgaataattgagagatgacagtggtatcacatcctgcccagctggggggctattccagtgagtaaatagatgtgagggagtgataaaaatagctagctgatatctagtgctcactgtgtgccaagccctgttctaaatgctttacttgccttaactcatttgatccgcacaacgaccccatgaggtggctactgtgattgttcccattttactgacgaggcaacaggtacaaagcagctgagtgacttagctaagatcccattaactgctggaatttggcttggaccagacagtctgactccacattggaaacacaaatagatacagccaccgtgtaaaggaggatctttgcctttcctttttctctctccccacaggtgtacccttaaaaagggattttgaatctctttatcaatcagatctattacagtctgtaaattttgaaggaaccattttatttaaaggcctttccagttcagtttcaatagaataaagatctagacagcatataaattttcatagtaaaaaatagagctatataatctatgaccataacccttttcatagccctaaggttggggatatatgaaaacacattagctgaattgtacattctttttataaaatgcctgatttctggcaatttggtcatacaatcttttgataaaaatatcaaaaacctcatactgcaatactgtaaaatgtgactctgttaatggccaaaaacatctgtattttttactgtcatgaactgtttaaacatcatcataataggaaacatttatgacttaaataattgaagtctacatttctcagaatccacctgctcatctcaaccttttgttagaccctcaaacaaatcacagaattgacaggcttgagtttctctgtaactctttcttctccatcatggggtggtaggatgtgcaggggctgttggtcagttcttccaagtttgaatgtcatagtcgtgggaaactgatgtaggcatctgtcatgggaaactgatgtagggaaactgatgtctgttaacctccctggacttcagtttctacttctgaaggacttctagctttaaaataccttgattctctctttctaaaccttttgtttactcactctttaaagaatattataattaatagtacagtgatctaatggtaagaaatagagaagaaaaaataatttggtttcattaatttcatttaacattatttcacaaaagttcattaagcacctactatgtgcatgataaatacttgtttcacagtccagtatactaataatgttaaattctcaaactgacttgggattttccttccctcagttttcccattgctaatgttcccctcctggctacaacattaccataaaatgttatactctttaatcttattttcatattccccaaacaaaacaaaacaaaatctttcatctcaaagggatttttagcatgttgcaaattatcattaaatcacacacaattttctgtcttcaatttttcaatgtaaaaaaccacattttaaaacctactaggttatatttcttaggaaaaaccgtagacatcaaatgttcacttctaatttagatgcgtcagctgacatactagtttcaatgagttgcagtaatgaatttgtcatagaattgaagccattttctagctataaatcgcccaaacccaaatgctataggaaatttacaaggactgccattagaataggatattttaaattatctcagttgtattgaaacaaaaccaaacctgattaacagatatatcaggtaatcatgaattgatgtgacagaaaagagttattgggctatttgtcaaatgataaactggatgatgatgatggggaaagttacctttaatttatttatttatttatttatttatttatttatttatttatttattttagtgctctaatgagtgccaggcattgtcagtatttcatgtaatcctcatgataaccttatgagatgtacagtattactatttctattttacagataagaaaactgagcttggagaggttaatgttcccaaagtcccacactttaaatagctgaaaatgtttcacattgcttgttgtcaccttgagttcaccatatttaaagtgaaagtcatcatcctcatcccttgttgttctttctgtttcgtcagtgatatcatgattttctgtttcattcttgcagtcattgatttttccttttccgtctttgctctaaatccattcaattaccaagtccctttcctcattcagtgtctttctgctgtcagccctcttctcatcacttagtgtctaggcctcccaactaaatgtacaggctaaaggccaaactccataactcggtcctcaaggctggctactctctgactcctcctcttcttttaggctctttttcctgttacttctctccagatgaactagttacctaaatactttgtgcgcattttctacatccccttatgcaaatgataactcttgagatggcctctcccctgttccctggtccgtgagccctgtcccttcctcagcatgagactgggtcctctcctgaaagatgtgttttgatcagctcattcctcagtgagtatcccttcttttcaatgcttgtgacagtaggctctatacctgtcattttgcactaagcacgtgccacctgactagcattgctgtacaactcttcatcaatgtgatctgtctctctcttagtggtggttaggactgggtctagatctctccctaacatgtggaacattgttctatacctagaaagtacaagtcttcatgcttcgtgtgcatgggtaaggagaggaatttttatggtaactatagtaaatatctcacatattgacttcattgacttaagagatctcctgtgaatcctccaagccttattattcagacccatttcactagaaagggaccacatgtactcataggatacagtggtagattgtttgcagagatggtcacagctccttccatccctgtgcatgcacctgtgtaaagtgacttggctctcttcccagcaggaggaagaatttatttcttcactccccaaatcaaagctgacttgtgacttactttgagcaaagagcatagaaaaaactaataaatctcaaaacctgaggggtggtctaggtgaccacccccaacaaaggatcccatctgggagaaaatttttgcaatctacccatctgacaaagggctaatatccagaatctacaaagaacttaaagaaatttacaagaaaacaacaaccccatcaaaaagtgggcaaaggatatgaacagacacttctcaaaagaagatatttatgcagccaacggacatatgcaaaaatgctcatcatcactggtcgtcagagaaatgcaaatcaaaaccaccatgagatagcatctcactccagttagaatggcgatcattaaaaagtcaggaaacaacagatgctggagaggacatggagaaataggagcaattttacactgttggtgggagtgtaaattagttcaaccattgtggaagacagtgtggcgattcctcaaggatctagaactagaaataccatttgacccagccatcccattactggatatatacccaaacgattataaatcattctacgataaaaacacatgcacacgtatgtttattgtggcactattcacaatagtaaagacttggaactaacccatatgtccatcaatgatagactagattaagaaaatatggcacatatacaccatggaatcctgtgcagccataaaaaaggatgagttcatgtcctttgcagggacatggatgaagctggaaaccatcattctaagcaaactcacaaggacagaaaaccaaacactgcatgttctcaatcatagatgggagttgaacaatgagaacacatggacagagggtggggaacatcacacaccagggccggtcagggggtagggtgctgggggagggatagcattaggataaatacctaatgtaaatgacgagttgatgggtgcagcaaaccaacatggcacatgtatacctatgtaacaaacctgcatgttgtgcacatatacctagaacttaaagtataataataattaaaaaaacagatatgtttgtgttagggttctctagaggaacagaattaataaaatatgggtataaatatataaaaaaaaggaatccatctgatgccatgccttttgccacattagcgcctgagtttttgttccattgtgtacatatgatagatgtggtttgagatgcttctttaaccaaagttttaatgcatttcaaagttctgcacttctaagaagtgatcttaaaggtagataataaattgtggttattcacatgccctgataccatagttctgttttatctcttgtagtttcttgaacgtagtccaaaattaacattgatttaaagtgctaatattttctcagatctatttttaaaactttgcattcttgtgttcttcatttgcaaacacccagaattgcccccccccttctcttttacccattataaggaaacaagttctctattcgtcaaatagcaaaacagcctttgcttagcagtgtatatttcacttttgtgctaaagctgtatcccagtaacattttctttcactgaaaatgaccatttcttcctggagtatataatttttttcaaatgcgtgaagttttcaaaatgaaaccatatcagacagaatgatctttggctttatgaaagtggaatattttttatagttctgtggttgttcattattttaaaacctattagttacaacaggttagcttgaaaaatgaggaggtttaaatctgagacaaaatatctcactataattagattctgaaactgtgccagcaaaattgtgtttgaacgcttcttgaatttgttttgtaaggggtagctttctgttttaaatgtgtattcagtaaaacacagttattcaaattctactagacatgtaggagagccagattcatgtgtaacgcagatgcggcattgttcatggggctgtttcctcctaatgactgacctaatgtgttgtgtctcctttttctggctgagagaaggaaccacattttagaagcattttattcagtaatatgttcacattgtgtttcacctcttgctatctcttatactacaagaatacctgtgacgtattgagatagctaatatcattgctagaaaagtacaaggtaatttggatagaaaataatgtaatagctttagtaacagaatataattaaattagtgcctagagtaaaaatagtgaaaggatttatttttagtcttgaatggcttagatcagtatgattaaaatacgtaaattaaataacagcatttagttcagtggtgttctgagtggtatcaactctctctaatatctaatcttaagtgttaataatctaattctaagtattctattttcctctgccctcccccatttttaagtaaacccaatatgaattagataaaatagggaacacatttgttatattcttggaagccttgagattaaggattttaaattgggctggcatatttttattaatctactggaaagtggttattggagcaccttctgtacaccaggggccattctggatgctgagaatagagccaccaacacagcaaacaaggtccctgctgtcagggagttcacagtttccttgggagaagacagataataactgagtaagcaagttaatttcagatagagataaaacactgcaagaaaagtaaaacagaataaattatagaaaacgtttgaatggggaaggggttgcttaaaattgggaagttagggaagatgtttttgagggctgacatttgaactgagacctaaatgacgaagagccatccagaaagaggaaaagcagttgcaaagggtctgagatgggtataagcctagagggactgagaaactaaaagaaaaccagagtggctgggttgcagcgaacaagaggcagcaaggtctgagcaaaatttgagaggtaggcagggcaagatgctgtgttagtcatgggtgctacctctttcttttatatgacggtgagtagcccttatcggaaatgcatgagaccagaagtgttttggattttggatttttttttttagattttgtaatatttgcattatacttactggttgagcatgcccaatctgaaaatttgaaatcttatacattccaatgaacattgtctttgaatatcatgtataatatcaaaaagtttcagattttggagctttcagatttcagattctggattaaggataactcaacccatattatattctgtattgtgttacattccattatgtcatatcatatttcacaccatgttgtgtatttatattgtattatatatttatgtccctgtaccttacagggaaatgaagagtcaaagaaagaccttagatttctcaagatatgtaggttttctggcattcccagtgtacaaagtcatgctagtgggttgctgtatcctggcttggggtccccagcttcttttcatgtttctttcccattgtcagttaaattcagttcaacagatattttcttggtgcgtgctgggcccaagaaacggatgagtccacttgggccattttacagatgaatgcagatgaaattgtgataggctttcattttagagtaactttcctagattatgtctattatttcaattagtgagcacctatcttttgtaccatcttttttatccttaggttacaagcagtaaaatgatcataagggccaaatatctaatctaaatggcagtgatatgtaatgttaacatagtcatcatttgtttctctccactggcgatacaagacataaaaaagtgattttgagtcctgcttatgcatcacaccaagaagtgtttatcatttgaatacctctcttctgggaagagtaggggtaagaagttttaaaaaaattagcagtttaataaaatatgtgaaagtttacaaatatatatgcttttaaatgaggcaacacagatcttctgttatgatggttatgattcagagtgtctgatttacactagaggatcaggaaataatgtagactatttcctttccccgtgtcttcataccatatgtagtcataatatactgacttaaaatttccaccgaattaaactttccagtgatttataagacgttgaaatgcattaccaagagcagttattgaatcttccttcagagataattaacgaaaagactgttattaaaaaagaaaaaaagcaataatttacctttcatgttggcaaaggtaagctctagaagtctttctgtgatttgctgatattaattccactccctggatgtttgttttgctttattctttctaactctccctgattctgtggtttaatagattttcctcctgtttagaataaaattgtagaagtcagtaccacatttagtatctatctccaggcatggccaatccttcccactggctgtgttccggaaggttctggaaaacagctgacaaagcctgaatgtgacagggcaagacattttaggcagccctcatggctttttcagctgtgcttcttattttcttatagatgtatgtgtggtatgtaagtgtgtatgatgcatatatgaaatattcaagtcagaaaatttgtccatttatgttcctcccaggttacgaaacaaaatattccattctagccatggttaaagccccctgggtagccctgcctgattgccctagagatcatcactgtcctgatttttttttaatcattcgtgtatgtctttatattttatgacatggatttatatatcttaaatagtacagagtattggtttgcttatttttataccttatataaatgcatattgctttttctcttattatattcttaggaattatccacattgatccatgtgtctttcatttattctccctactgtatagtattctgttggggcaccagggggcacaataaccagcaccttcttttcccctccagaatcaattgaaaattcgactccaagtgcaagagagtaatagatagaaatttcagctttcttagtgacatagctctattggagggattggtttgctaaaatacagcccacattaagcaggtttaccctttagagtggagtggcagggtctttagtgtattcatatcagcagttgacttgtttcccaagtggttgggccagttcacagtattaccctcagtgcaccagaattcctttctatccatatactcaccagcacttgttactgaactctagtttttgccaatttgatgggtgtgaaatggcatcttattgtgatttttaatttttctcattacttacaaagttcatcatgtctcctagccctttgggtttcctgttcaatgtcaatttcctatttatgtattggcccacataaaaaatattgcatagtctattttaaaatgatttataggggctctttacatattctgggtactaattattccttatgtgtgagtcacagaaatttttacccacttgtggcctgtcctcactttttgtgggggagggattatcttttgatatataacaggactatatattttcccagaggttttagagagaacgtgaaaaaaagaaaaaagcctgggactgtttggcatgtccaaagtctagaattttggagagcatgtgtgtagtgttacttgagcatgtaaatggggtctccctggtgattttctgcctattgcaatactcactttgaacagttgctcatctttctttttctatattagccagtttgaatatttctctaagatttacattatgtttcaagttattttacattatagaattaaatgcttactgcttaaattatgattttttagcctcagtatagttgcatgaaaaggctataccataaaacaagtgtgacctaccaaaaagcaaatttgtctaccacttggcaactctctacgtgtaacacagcttttgcattttagctattctgatggcaatgctgtattaatatttcattctctccgtagagtttgtggacattgtcatcatccgaaggcatttgagtactaaattgcatatgatgatacttataaaagaaaattgcaggccaagcatggtggctcactcctggaatcctagcactttgggagtccgaggtgggaggatggcttgaggccaggagttcaagaccagcctgggcaacatagcaggaccccgtcactacagaaaatgaaaaaaaattagctgggcattgtggcacacccctgtagtcccagctactcaggagactgaggcaggaggatcctttgagcccagaaattggaggtttcagtgagctacgattgtaccaccgcaccccagcctggatgacagagtgatactttgcctccttaaaaaaaaaaaaaaaaaaaagaggccaggcgcggtggctcacatctgtaatcccagcactttgggaggccaaggtgggtggatcacttgacaccaggagttcaagaccagcctggtcaacatggtgagacactgtctctaccaaaaatacaaaaattagccacacatggtggcatgggcctatagttccagccactcaggagggtgaggcaagagaattgcttgaagctggcaggtggaggttgcagtgagccgagatcgtgccactgcattccagcctgttcaacagagcaagaccctgtctcaaaaaaacaaaacaaaacaaaaacaaaaacgagaaaaagaaaatcacatcatgattttgctaattcttcataagaacagtttcttgtagggtcatgcatagattttcaccataaaaagagcctcaaagagcatgtggtacagtctcttattttacacatgcgaggataaatgacccatgcaaggcctcacaccttgttgggggtgaatgtgggcatggaataggattaggacccagggttcttggcccctggcacagtgtgttttccattgtaatggattatagaataataatgttattctttatttttataaagttggtgtgcatttctagatttccttagctagaattccttaggtttcacagaaacataggtttcagtgcttttagctttttgttgatgacatcttttcagtttcttagtactgaaggaactgttcatcatacttgcttaaattagctttatggaaataatgtatactgttttccttccttattttcaaccgtatttacatgctagtctttccaacaggttgtataaataagttaaatgttatggtaaattattccaaaatggcatattaagtttgcataaattaaaactatggtgtaatactatgaatcagattgtaactagatgtaaatttgtaaatgtgtatagttaattttttaaacataatttttccatgtgcgactgctttatttaagttagtgtgtttaacaataaaattaatgcagtcaacccgagaactacaatattaccattaactcacatatacccgcacactcctccatcctatcttcctgcctttttccataggaaccaatatcctgaagtgagtgtttattattcccgtgctttaaaaatacatgcacacggctgggcgcggtggctcatgcctgtaataccagcactttgggaggccgaggtgggtggatcacgaggtcaggagatcaagaccatctggctaacacagtgaaaccctgtctctactaaaaatagaaaaaattagttgggcttggtggcatgcacctgtagtctcagctactcaggaggctgaggcaggaaagttgcttgaaccctggaggcggaggttgcagtgagcgaagatcacgccactgcactccagcctgggtgacagagcaagactccatctcaaaaaaaaaaaaaaaaaatgcacatatacatatatatacctatatgtttctctaatgtttaatcttccttgtttttaaactttgtaaaaaagaatttcaaatgtatgtagtctttgtgacttgctttttttcactcaatagtgtttctaatatttatccttgttttatctataattcactcatttaaaatgtgtttagcggctgggcacagtggttcacgcctataatactagcaccttgagaggccaaggcgggaggacctgtcaaggccaggagttcaagactcgccaagcagtaagcaagaccccatctctacaaaaaatacaaaataaaaattagccaggtgtggtggcacatacatatagccctagctactgtggaggctgaggtgggaggatcgcttgggcccaggagttcaaggcctgcaggagtttgaagatgcaggagtttgaggcttcagtgagctatgctcgtgccactgctctccagcttgggtgacagaggaagatcctgtctctaaaaaaataaaatagtatagcattccattgtatggatttaccacagtttgtctttgtttcctttttctcttcttattaatactgtatgaacacttttgtgtcataattcctagtgcccatgtgcaatgcttctctggatatgtacttaggaatggaattgctaggttgtaaggtacacgaatgtttacttagatagtgctggaatatcataatgccaaatgatattttcaataattcatatcaatttacattcccaccaacagtatattctgttgatgggcatcctctccaactcttgccaggcttctttttttttttgagacagagtctcgctctgccacccaggctggagtgcagtggcacgatctcggctcactgcaagctccgcctcccgggttcacgccgttctcctgcctcggcctcctgtgagtgagtagctgggactacaggggtccgccgccacgcccggctaattttttgtatttttagtagagacggggtttcaccatgttagccagatggtctccatctcctgacctcgtggtccgcccgcctcggcctccgaaagtgctgggattacaggcgtgagccaccgcgcccggccgccagacttcttaatctttcccggttgagtgggtttaatatctcattgtcggcttgatttgtattaccctgatggatgatgagttctctctcttatctcttcacatttactagtctcctctgtgacatacctgttcatggtttttacccatttttcgattgcatcttctattgatttgaatgtgttctttatatgtgttctcagtacaaatattcggtctagttaacaaatatcttctcccagcttgtgacttgtcttttcactttcttcaagtgacttttcagacataagtaaatttagtttggttaaatttatgaatctttgtcatagttagagggctggtgtcctgtttaagaaacccttcattacccccaaagtcagagacctattacctatattttcttcataaaatttacagttttgctcttgaaaattaaatctgtaattcttctagaattgatttatgaatagggcgtgtgtgagaacccagtttcaccttttccatatggacaatcagtattttcagctttgtttattgaatgtgccctcttttctctgctgttctgctttgctgcctctgctcctgtgttttctgttgtttcactggtcacttaatctgtctctgcaccaatttctcactgtcctcataaaatcttaataccagtagggcaagtctccctccttatttttcgtctttagcagtgtgttgattatttccagctctttgttttctcataataattccagaaactagcttgttaaaaaccagaaactgttcagatttcgattaacattgactttacagatgaatttctggaaagttgacatcttaataatattgtcttcctattcataaatatatttttcattggatatttcagaaaattctttttctgaaccatcacactgctgtcaccatcataatcacattggttttcacttacgctgtatttcttatatgccaacccccattctatttgtatgcagtttttacagcagtcttttgaggtagatcctattattatgaaatattgcacataggaaactgaggcacagagaggttaatcaactcactgtagatcacacagctagtaaatagtagaggcaagattctagcccaaggtgcttggatataaagttcatacttttaattactactctatattgcacacagctttttttcttcttttgttggatttcttcctacatattttatcgtttttgttgctattgtaaatagtagcttttgaaaattatgttttttaaattacttgtagaaacaatagaaatgaaattgctttttgtatgttaatcttctagctaacaaccttgttaactttgtagatttttaaggatccacaaagataatgacatcagtggaaaatagtaattatttcttccgttccaatccttatatcatttatttctttttgctgacatatgcactggctaggacttacaggggtgatagtgtcttgttctgaaactcaaagggaaagatttcaatattttatcacttaatttgatcatagccgtaggggttagatcctttctcagattaaagaatttcttatctggtctagtttatcatgagttttttaaaaatcaagaattgatgagaacacatggacacagggaggggaacatcacatactgggggcctgtcgggggcggaggtgggggggacaactggaggcagagcattaggacaaatacctaatgcatgtggggcttaaaacctagatgacaggttgataggtgcagcaaaccaccatggcacttgtatacctatgtaacaaacctgcacgttccgcacatgtatcccagaacttaaattaaaaaaaaaaaaatcaaggctgggtgcggtggctcacgcctgtaatcccagcactttgggaggctgaggcgggtggatcacgaggtcaggagatcgagaccgttctggctaacacggtgaaaccccatctctactaaaaatacgaaaaataagccgggggcgtgatggcgggcacaggagaatggcgtgaacccgggaggcggagcttgcagtgagccgagatcgcgccactgcactccagcctgggcgacagagagagactccgtctcaaaaaaagaaaaaaaaaatcaagaattggcattaaatttcactatatgctttttctgtatctattgagatgttattttttgaaattcattaatatgatgaataacatgtctgtgtatatgtatgtatagttttaatatcaattcatcttttatatttttgatataaacccaagtttactatcctattatctttttttttgtttgtttgttttttttttttggagacgagtgtgcagatgtttattaggggatattcttgaaatggatacctgtttggggaagaaaaggaagcaggattgggcagggggataacttggctatgatgtcacaacagtgtcctcaatgaagcccacagagactgataaagttgggtttgactttcagagttgtccagagctggggcaagagggaaaggcctttaaggccccccaggagatggactttggatacgggctgccctgaagggagggcctttcccagagagtggggcaagctgaagtccatcatccagcggcacttcagcagctggggagagggttgatgggttccccagccagaaagggggatcttggtggctcatcacagtggccactgtgtgcccaacatagttgctgcacattcgtgttcatcccagcctccaacatccatttttcagcccctgggcctagggtgggggcaaacccagcaaccctgggtttgacatcacatattaatcccattcccagaatcattttagcctgaggacataaggagcctccaagccaagctccccttggaatttcccgcacctgcctttgctcatgcagcagcttcctgacgctggcttctcagtgtctgagcccaggaatgctgccagagtgggcacatcacagccaagaaaaagggagtgggaatgagagcttttgtcattcagttcacagcgcggcaggctctgggtgagcacatcctgtccactatctcattcgtggtcaccacctccctgcaaggtgggatcttttatgagccccatcgatagataaggacactgaggctcaaggacaggaagttgcacatctgggctctcaggcctttcttttcttttcttttctttttttttgaaacagagtctcactctgttgcccaggctggagtgcagtggcacagtcttggctcactgcaatctctgcctcctgggttcaagcgattctcctgccttagcctccggagtaactgggattacaggcatgcaccaccacgcctggctaatttttgtatttttagtagagacggggtttcaccatgttggccaggctggtctcgaactcctgacctcaggtgatccgctgtccttggcctccgaaaatgctaggattacaggcgtgagccaccatgcctggccatcagacctttcttttctgtagaaacccttgactctaaaatccaggaagcatgactgtgtcaggatactgtttatatgaacccttctgtcatttgtcctccagagagatactaacattccccatcccaccaggtgggctaaggctgggactgctttaaccctttctctcctagagtcaacactggcatgggcctgggtgctgcttcctgctgggggacctggggatttgggtcttgtggatgagccggacaccccccaagccctcttctagcttgatgtccccctgctgcagggcctgctggatagcatcagtgagggcgtcaaaggccaggtccacattgcagttgtttttaacagaggtctccacgaaggccatgcccagggaggcagctagctcctcggcctcctgggctgagacacagcgggtgctctgcaggtcactcttgtggccaaccagcaggaagatgaccttgtccgggccctgagtggccatgacctcctggtgccagtcttggatgtgttcaaaggacttcctgtttgtcacatcaaagaccagcaggacacccaccacattccggtaaaaggacccggtgatgcagctgaagcgctcgtggcccgcggtgtcccagagctgcagcttgacccgcggcccagcccgcagctgcagcgcgcggcggtagcactcggcgcccaccgtgggctcgggcttgggctgtggggcgccaggcgcgcccgccacgtagctccgcagcagcgacgtcttgcccaccgccgcgtcccccagcagcgcgacccgaaattggtagcggcagccctcggcctccatggccgcgtccctatcctattatctttttaatgcacagtaggattcagtttgctaatattttacttagggtggtgtgtgcgtgtgcgcgtgcgtgtgtgtgtgtgtgtttgtgtctaaaatggagctgtaattttcctttcttgttttgtttcatttcaagcttatactggcctcatacagtgaattagggagaattccctctttttatatttggtacagattttgctattttaatataaataaaatattgccttggaaattttataactttaattataaacataatcagaaacctcttgcttctgacaatacattgttttctgctactttgaaaaactctgatttctaccataatatctcaaactcttaagtaattttaatgaattaaaagtacaaaggtattaaaaggttataaacatttattaaaatcctctgttacatcttatagttttctattccctgaagtcacttcaagttatttatttttaaacatagaacctctagttgaagtctatttatgtctgcttctgctggttcttgctcatggtgactagtttccctgtaaacttgtttgtattcaactttctggagctcaccgaccttgaaaaataatttatgaggaattccacaagtccaggatgaaatcagagtggtttatgtgtttttgccaggctccttgtagcacagtcagtacaggactatattaaaacaaatccacagatggaagtttctgtattcactcaaggtatgtttagacctaggatcccagggactctcccagtgagggtcagtcaacactcataacttctcaggggtgaatgatcgttttttatttcatttttctcttactcctttgctcagcaccagggaaactttcatgtagtcctttggatttcagcttaatgtgggaaagttatcctgtgagatgatccaaattggcaaagtcctggatcttcacttctggcctcgtctccccatgaggctaccagaccgcagccccagtgcacgatgtgagtgaatgccttcagggcaaaggtggctttgggatgccaactttctttccactaacctctttgggttcaagctagcctcaagaatttggcctggcagctctttttaatttttcagtccttttaaggtggttttgttttagtgtcttatccagcatctttagttttttgcagtggggagttgatctgagtatccaaaaacagaaactcatgtgaattcttaaatactttgtctcccaaacttttccttctaaattctgctttccaaatattgatttattaggtagacaataagaattattaagtgttagaaaagagtatcacttatttgtaagagatatagaaaatatataaaatcagtaatgcatttctaaagcttagtaattctggcattttagctttactttatcttctattgctgtttaaagaatatgaccaagtatttctgaccttttattgctcttatattgaatatcatttagaagttgtaagctaaatatttattttcgtataacctaaaaccatagtattaggaaatactgatgtaatttagtgatcatgtcattgaagcttaacatttttattgcattcattatttatgagaagaaatcatgcagtgtttctgtttttatcaaggtattatatctaaaaatcacttttcttgaacttgaactcaatatttataaaagtgcattttatagtacttatacctacgacaaaataattgattaactgtgtccaagtgtgttgatgggtccccaagggccaacgctagatttgatgattcactagaaggacttccaagactcagcctacagtcgtattcatggctatgatttattacagtgaaaggattcaatgcaaaaccagcacacgggaagggtacatggggtgaagtccaggggaaaccagatgccagtttcccattgttcccctccagtggagtcacagagaacacaattccccaatagtaagctgtgaccaaacatgtgaaatgtgccaaccagggaagctcagtagagactcagtgcccagggtttaattgtgggctgatcacactggcattctctgtctggcatgtgccaaaatttcagactcgcagaaggaaagcaagtattcagtgggagccatgttgtctgcacaaacagttttaagcacagtgatcaactcttaccagttaatggtggtaggaaccttcctgaaatccaagttcccagatgccagtcaagggccaggcttgtaagcagaattgcagtcaggtctgctgtcttaacttttttctacatgtggaggtgtggctgaagttttttaagcacttaccatttggcaagcactgttctaagccctttactcgtttcatcctcacaatcaccatttcatagatggggaactgagggatagagaagttaaaaaatttgtctcatatttcacagctaataagtagtaaaacaggattcatagtaaggcttcgaatccatgattttatccaatactttatttgggtttttttgaaaattactttcattttgtctcacctcatgaataagatgttccatacatttccttaaaatggtgattaaaataaattgtcaaaaaaaggaagaaattgtcttcatacagccccttttaatcttcagtgttgtttcatggctcttaattttcagatttgaaaaatcattctaattatcatgcaaacccttcctgatctcataggcttttctctgcctctgtgtttcttctgggttggagaatttgaattgttttttccatttgtctggtccttgaccactaatttactgccatggttctttctgtatttcccttttggtattttctgaaatttagcaattagaactgcaaacagagacagtatcacagcgccatggttttataaacaaagacaggacagctgtcttagtccatttgggctgctataataaaaataccataaactgggtggcttataaacaacagaaatttttttctgacacttctgtaggccgggaagtccaagagcaaggagctggcaaatctggagtctggggagggcccactttctggttcacagatggtaccttctaaatgtgtccttgatatagtttggacatttgttcccacccaaatctcatgttgaactgtaatccccaatgctggaggtggggcctggtgggaggtgtctggatcatggggacagatccctcaaggcttggtgctgtcttcatgttagtgagttcttgtgagatttggccatttaaaagtgtgtagcacttcccctgctccaactcttgttcctgctctggccatgtgacatgcctgctcctgctttaccttctgccatgattgtaggcttccccagaagccaagcagatgccaacgccatgcttcctgtaaagcctgcagaaccataagccatctaaaccttgtctttataaattatctaagctcagatatttctttatagcaatgcaagaacagcctactacagtcttcatatggtgaaaggagagaactctagtctcttcagccccttataagggcaccaatcccattcatgggggttcagcctttatgacctaattaccttccaaaggccccacctccagccatcacattggtgattaggttttaacatatgcatttggggcaggcacaaatattcagaccatagcaacagcattttctgttttatttccttctttgtaattctcatcattgtattggccgtattatctacctcagtatgttgaacagtgacttaagggcatggcctttaaatgctgctagagggccatctgggatatagctgataactaagagcttgcctctctacaagtatactttagattatttttttagaattgaaatgagaagattcactatttgctatatccatttccaagaaaatatattatagcttcaagaaaaatgcgagtgttaacacgtgctgaaatatgatacagatgtttaatgtcttactgtaatattattttactgttcatagtcacctgcttttttgatccctgcctaagtttgctttctttattccataacacctgttcccaggaatatatttacagtctgttgtcttttctaaatggttggtacatatgtaagaaaaaggttgacttttactggtttctttcagtaaataccttaaggattccttgttatttattttcagtgttactttatttcaatttaataccttagtactgtttttacttaaataccacataaggagtcatgctatatgacctaggcatgacacttacttaaatgtttatggatagaaaacaaattatttctagttttactttttaaaaagaattccaaaacttcaaactacacatgataaatggccctgtgtttccataggcttagaaagcttatgtctaatttattactcctatgtgatcatgtgtatctagttgtttgctaccttctatttcagatctttgcatttgtagttccctgtttaaatatcacatcatcagagaggcctttcctatccaaagtgacttcactccatctcccatccccagtaaatctctgctgcctggttttatgtcattcatagcagttagcaaatctcagggaagatttttgtttttgtttccttattgtctatctgtcaggcttgactataaagcttcatgagagcagtgatgttgtctgttcttgaatacctctggatgttcaggttagttcagagcacttgttgaataaattaatgaatttattaaagactataaaaacaatctgtttatattagtatggtatttgatctttgttaattcaaatctataagattttctgtggattatttaggatgtgaagaaggtatccagactgaccttaggtttaggttataataattagctaactaaaaagttaacaatggatatatttaatctctaagcctgattaaattttctgactctttgggctgtctctgagaattgtgtatctgctgtaaattaccaaaactgcaataaatcaggagtctttccaaatatcgagatactaaatacatactttgatctctttgtgtccattagaaatattttaaacatagaaaagtatggagaataatatggtgtaacacttgcatttcagccacttccctttatcttgtcttaatatttgtcatatttgcctcagtgtttgatcaaaaaccagtcttgatatttttaagatatacttaaatcagtagatcttgagtaaagcagatcactttcctttttttttttttttttttttttttttgagacggagtttcgctctgttgctcaggctggagtgcagtggcgcgatctcagctcactgcaagctccgcccccagggttcatgccattctcctgcctcagcctcccgaatagctgggactacaggcacccgccaccacgcccggctcatttctttgtatttttagtagagacggggtttcacagagttggccaggatggtcttgatctcctgacctcgtgatccaccagccttggcctcccaaagtgctgggattacaggcatgagccaccacgcctgaccgagcagatcactttctataaggtgagagggcctcatctaatcagttgaatgccttaagagaaaacatgtaggtcccccagggaagaagcagttctgcccacaggctgccttcagatttgaggctgcaacattaactcttcccttgactctctgttatgttgcattggtctgtttgtctatctttgtgccagtatcacactctctttattatataactttgtaatcttgatgtctggcagtgtaagtcctagagctttgtgttttcttcagaattatcttggctatttttagcccattgtgttttaaaataaattttagagtcagtttttcaatttccaccaaagaaaaaaaaagaaaaaaacaagaagccaacttcaaacccaaaagttgctgtcttctttctttctctttccttctttctttcttttagttgctgtcttctttctttctttctctctttctttctttctttctttcctttctttcctttctttctctctctctctctttctctctctctttctttctctctttctctctctttctctctttttttttttcaacagagtcttgctctgtcacccaggctggagtgcagtggtgcgatctcagctcactgcaacctccacctcccaggttcaagcgattcttctgccccagcctccaagtagctgggactacaggcgcacgctaccacgcctggctaattttctgtatttttagtagagatggggtttcaccatgttagccaggatggtctcgatctcctgatctcgtaatccacctgcctcagacttccaaagtgctgggattacaggcttgagccaccacgcccgctggctgggtttttaattgaatttatattgaatctttagactagatcaatttggggagaactgacaatgccaaaatgttttaagtcttccagtgcatgaataaagtatatccttttgtttttaaaggtcttatttaactttccttgctgttttgtagttttaatgtaaaagttttacacatattttatcagataattctgaaatatttggtttttatgtagttatatagatttttaaattttattttctacttatttagatatacaattgttttttatatgctggtcttacaccagcagcatgactgaatgtcttagtctagtccgtctgttgtaacagaataccatagactgggtggcttaaacaacagaaatttattttctcacagttcttaagactgcgaagtctgcaatcagatgccagcatggtctggttctggtgaggaggctcttcctggcttgcagatggctgcctgcctggctgtgtgcttctgggtcctttcctggacatgtgcacagagtgggggatctcttgctcttcttataagagcactaatcccttatgatggtcccactctcatgacctaattacttcccaaagacaccacctccaaatactgtcacattgtgggtgagggattcgacacagaatttagagcaggagtgggcacacacattcagtacataatacaaagttaacttattctagtacttcgtcttagtaattgtaatagtatatattttatgttttctaggcatgcaatcaagtcatcttcaaacaatagtagttttatttcttcttttccaattcttatgtcattgatttctttttcttttcttactatatcagctagggtctcccacatagtgataaataaaagttatgtgagcaggtatcctgtttcttccccatcttggtggggggaggggaaaactttagtatttcacattaactatggaatatgcaataggtttttgggttttgttatgtttttaggggataaataacctttattagattaagggagctcctgctttgctaagaaattttatcatgaataaatactgacttttattaaatgctttttctgctcatgttgccataatcatatttttctcctttaccctgttaatgtgatgatgatatgcagtagaccaatagtaaaaatagaactattgtaccattagtaaatgtgaggcttagaggatatacaattgtataatttttttttgttaagggcatttaaaaattactgttttcttattattttttagagacagagtctccctgtgttgcccaggttggagtgcagtggtgagagcatggctcactatagcctcaaactcctgggctcaagcaatcttcccacctccgcctctggagtagctgggactatgggcatgtgctactatgcccagctagttttttaaaacttttttggagatgaggtctcactctgttgcccaggctagtcttgaactcctggcctcaagcagtctcccacctccatctcttgagtagctggattacagatgtaagccactgtacctgactatatggacattatttgtagtagattccacaatgctgttaaatttgtctatatctaacaggtacttgggaagaataattaaatgaacagagaagtggtttagaagtgacaggtgacttggcatttgtgtccaaataaaaagtaaatgtacatttggccctctatatcagcaagttccatgtctgtggattcaaccaactgaggacagaaaatattttttttaagttacatctacgctgaacatatacagacttttttctttgtcattatttcctaaacaatattgtataacaactgtttacatgccatttacaatgtattaggcattatgaataatctggagatgatttaaagtatacaagaggatgtgcttaggttatatgcaaatactacaatattttatagtaaagacttaagcatctatgaattttagtgttcatgggaggtcctggaaccagtccttcatggataccaagcgatgactatatttatatattcagtcaccttttgacaaagcttaatggcagtatttcttttgtgagtctgaacaaattttcaagaaactacaaaacattcctctaatatcaatttcttttattcaaagatgtactagaatattattatgttaagataactatcttagtccatttgtgttgctttaaaggaatacctgaagctggataatttataatgtaaaagggttatttggctaaaaattctgatggctggagagttcaagattgggcgttttgcatctggtgaggcctcagatttcttccactcttggtggaaggcaaaggggagctggcatgtgcagagatcacacggcaagagaggaagcaaaagaaagagtggggaggcgcccggctcttcttaacaaccagctctggtgggaactaatagagtaagaactcactcaccctcaaccccaagagagcacattcatctgttcatgaggacccacttttccacccccaggacccaaacacctcccattgggccccacttttaacactgggaatcaaatttcagctggaggtctgaggggacaaacatccaaaccatagcggtagctgtaggactttttagctctgccttctttaaattgtatattatatgtaactgagccacagactgagaggtgggtagaacattcaccaggccttttcttgttcctaagaacagtgaaaattcaaagaaggtacactctgtaggaaatcggtatttcccatcattgcttatataaatcttaagcaaccttattttaaggtgagtagatgagtgaatggatagagagagaaaaaaaagagagagagtgagagaagtcatagaaacttgctgtaggtttttcacctggatgaaatgaaacatcacagatggtttctcacagatgatctcttggcttccttttgtaggagtttctcccagggcagtgcattctttgtccatggtggggaaagagtcaaagtcactatatcaaaatgatcagtattctataacatatttgaatttagaccatctcaacatatgccgcacatacatttcccattgtgcttcacccttaacagaaacaaataataagacaaggtagtatttgaacctctcaatgaagagtttataatgcattgaataaagtcttcacagataccaatattttattcgtccctctggcacccaggaagtttttcaacactcaggcaatgcatgattgtaagattcatgttaggtaagaaatgtgcctttcttttgtaaagtagaaaaaaggtgtttgaaaggggaagtgggattagaaaaccagtatagctccacacaggtgctcttgagcaaaccagtttttggaagcattataaatagaagtcaaagttctgttaattgattatagtaatactacattgcttatgtaaccctaagcatacatgctcctatgtttaatgctactgatcttggttgtagacccaggtttgaaattatttttgttcaagtgcatgcacactgtcaacttcatacctttactctttaatgaaggaaaatttaagacaagtaaaatttagaacagattttgtatagttggtagtagaatttgaaaatatattagttccaggccaggcacagtggctcatgcctgtaatcccagcactttgtgaggccaaggtgggtagatcacctgaggtcaggagtttgagaccagcctggccaacatggtgaaaccccgcctctactaaaaatacaaaaattagccaggtgtggtggtgaatgtctgtaatcccagccactcaggaggctgaggcaggagaatcacttgaacctgggaggcagagtttgcagtgagccgagattataccactgcactccagcctgggtgacaaagaaaaaaaaaaagaatatatatatatatgccaagtcataaagtagaccaaaaatataagtagctctaaaaatagtttagataaaaattttattgatgggtagagagtggattttggagaaactgagatttttgtgtatctctaaatatgggggttgatgaagagctcagttattcagccttttacttcttttaacaaggacttattgaggcaactgttacttgcttacattgagctaggcagttggggatatggtgtgaagtagacaattttgttctgtaacattaaatggcaaaacagtatcaagtaaactaaaccaatgataacaaccatataatcaccagttgttctaaatgcaaaataaataaataaataaataaatagggtaataagaatgcagagtaattgggatagtcacttcagggtgcctgcagagaccacaggagagggtgacgtgtgtttgtgatttctgtggtaccacccatcagtggacctgatggaccatggttctgacttctatcctttccccattttatagatggggaagatgagatgcagaagcacagtaactttccatgtgcatgtaggcatctatgtaagtggttaagtgagaattcaaacccaggtggtatgactccagagttagtatttttaaccactgtgctgtactgtcccacaagtaatattagtttaattttagtgaaataaccaagataagtaccaagcagactaaccccaaagtccgctcttaacagctacactaactgcctctcaagaggtcgtagagcttatagactgacacagctggtgtgtttttatcattttttttctgtgaagtaattagtatttattttttctattttatttcgatttcattatttttcaactaattataaaacaccttcaaaagaaaagaaaaacggaagtgaagtctcagtttaggatcaatttgaaatattcttaagactcttttaatatgacatcagttaacttgagcaccttcatctgcctatgcagtccagtattcaggagaatgcagttcgtcttagtccctttgagctgctataacaaaacttcatagactgggtagcttataaacaaaagaattttatttctcacacttctggaggctgggaagtccaagatcagggcactcactggcaaattcagtgtctggttagggcctgttccctggttcatggaatggtgtgtcacatggtggaaaggaacaagggagtgctctggggcctcttgggcaccaatcccattcatgaaggctcttccctgtgacctactcttatgaaggccccaccttctaataccatcacattggttattaggtttcaacatatgaattttagggagacacaaatgttcagaacatagccgagtcatacagtaaatactaagaaaggtatactcacaacatttagaataaatggaaactgaaaaactattaataggccaaatcttaaaagaggatataccaatgctgacatgcgtacccacacatatatttggcatttttgatagaacaggtttgttctggagagtttatacgtaatgaattttgctaaaagttttctgtaacatccctgtgttgtaataggggaagaagcatcacttttctctttttataattagaaaatgcaggcttataaggttatactcagagtgggtcaagctgaatattgggtaatcttgaatcataaaccatccataccctcgtttaaaaattattgtctccatgaataataataggaacaagagtctatatgagcccagcagtgcaaattagcctacaaattaacttggtttggcaaaagtaaagtatgctcttagtcttcttcaaaaatacttattcagacatatgtaaaagaaaattatggtatatatttgtaagtaattgaagtgtttgggagtttttctgtttgtttggtccttgattttttttttggaggggtggcatgtttatgtttttttttgtgtagcttaccatagccagataaattaaatgcattgtaagtcactgaaaaatagaacaaatttaaattgaataaggaatatggttttataggattatagcatagttaataatatcactaacataaagaagaagtgtcaggaaaagaacaataacacaggctatgatgctgaaaggaaccaacatctagaatagcaaaagtgataaaaggaaaataataggaaatgaactgaatttcataaaaggtgtctttctaatgcctttaaatataaaagaaggaagtaggatcgagtacactaaaaagaaaaatagtcatatgatgtaagagtttgtccaccagagcttaacaaaaacagtggagaacagaaaaaaaaatgggctaaatattgaatacaatagcagtttagtaatgatcagaggacagggagatggggggatcatgtctcggcaaaagaaaggtcaaaacaaggcagaaagtacattttgggttaattcaaacaaggtaaagtaatagaagaaaataataccaagtagacattgttttaagataatgaaatgtatagcctaatgttatgcacattgcttagcaacaagcaattaaaaaaaagaatgaaaaaggaactatggaaaagaagagacatgtgtcttgtaaagtggtcagatacaagatgaaaatgagaagagccaagaaagaaaatgaatttagacctcaaagaagtttgagataaatgacccacatttgttattgtctcttaggtcagttttttaaaaaagttagatactgaattataataatcattaaaataactgctcaaagtagagatattgattgctatgtaaaatgtactccatattctttatatataaagctgtgaagatatatttagacattcatataattgaatattttgagaaaatatattttaatacagtatgataaaacaaatctataaaaatgatttaaatgtgatttagaagggcatttggagatgattttcatcttttattttcttgttttggatatggattgttgctttatacatctctaatactttattgtaaatatttaaatagtgggtagcatctgacctgtttgtaaagttcagaagtacctttatataaataatagcttctaaaggccagtagacgcatttaaaaataaacaagtaaattaattcatcccatacctggcagttaaaatagaatgcatttccattatatggctttagatttgactttgtaaaaactaaaagcaatacaaaccccacataccacactaccacaggggtcatctaatgaaaggattattgtctcaaaacattgctcagatcatcttttagtacgtcccacctgcaagctagaatttttctcctagtcatctgtcttttgaaatcatagaatctcaaaccttgttttttcccctatccatttgagaaaatgaccaacgttctgtagcgttggaagaaaggtacagatttaataacacacgtggaagcaattgaacaaaagtggtaataatcaggcttttattattgagttttgggacttacatgtcattacttatgataaagcttcacagtgcttctgccaatcagagttcttactgctcagtgttttgaggttgagagtggtaaattaaagtgtgcagtgcctctcaaaatagttatccaatgtcttaatatatgaaggggtgccttttgagatactctgatttgtatttaggatttacccattgctaaagctgagtgcttttaattaaaacagtagatccaaacaactgccaaaccctttcatggagtaaaataccatattttagtaaatctgagacaccattgattctaggggcaccatcatattatgtaccactaatgacagaaaaagttctgcctgttaaactgtgacacactgctaagataccaacaattgcaagatgctttgcaaatttagaaatttttaaattgtggaaaatggtattagagaagcaaggaaataagatcatgtgcaccttcgccacctcgttctgaattatctttagatttcttatacccagtagtaatcctatccagtgtactttattctgcccttttagaacctcttcttggccccattacctgatttcactgcatgtaaccttgacttcactcaaaaatacttttggttggccgggtgcggtggttcatgcctgtaatcctagcactttgggaggccgaggcgggcagatcacaaagtcaggagttcaagaccagcctgaccaacatgatgaaaccccgtctctactaaaaataccaaaattagccaggtgtggtggcacacacctataatcctagctactcaggaggctgagggaggagaatcgcttgaacccaggaagcagaggtttcagtgagctgagatcacaccactgcactctagcctgggcgacacagccaaactccatctcaaaaaaaaaaaaacttttggtcatctactctgggagtagatagtactctgactatctcagtcaaacatgcctctctgacctatcctagccttacgagaggatgtagacatcaattgtggatagtccgtgggctcattcttgccttgtaagcaggatgtaggcatcagttcatgaagatctggtcctacagccgttgtagagcttcttcattcagtgttggttgggcttctaccaggagcctggcattgtgcaggtgctccaagttacaacactgaacaagacatgtcctgcaggcaaggaccttgcagtctgggagagcagatgcataaacggggattggaattcacttaactttagccatgacaggcagcgctgccaagaggtaaagtttctcttcaactcttccttgatttactttcccccctcttttttcttgtgaccccaactgaacccttcataatatcaaacaaatgtaatctgccttgcattgcacagaagcccatcaagaattctctacaaatggactatctgaacccatgcacatgttgttttgttttttactttttttaaaacacatcttacatatataatcatgtgcacattttgaatagaaatttcccccgtcctaatcagctacccaaatgggagtaggaataactcattgtaatgatgatgtttgaccctgtcttggagatagcatgaccaagaggcccagcaccctctgaccttaggatgtgatctaaatacagcctcatctgtttaacggaaacatctcctcctcctcctctttttctccctcctcctcgaccaccaccaccactgatgctagtaatagaacccattctgggccctgccttctctctagctctaactcagccaagcttctgggaaaagtagtctgcttgttgttttcatttccccacagtctctacttctgaactcagtacagtatggctgtcacttctaccagctccactgaaataattttgctgtgctcaccaacaacctcccagttgccaaatgtaaccttcacccttcagtctttgaacccttttcaacattcaaactaatgacctccttgagatgcccttttccattggcatctgacactgctctcttgggtcgagtctgacctttaacagccaatgcttccactctcccttggtgaatggcactctgcctgcatgccctttccaattttctcttccttaccagtatacttctctgggatatttcactcacaggctccactcccacatggaggactcccagttccattcctttagctcagcttggttttctcagtgtctcacccccatcttcaactcctactgaacgtctttctctgggtatcctcaatgacccctcaaactccacatattctaaatggtttatattacctttaacctgctgatccttctccttttttgtataactttctttggttcatgataccaccatttacccagttacccataactggaacctctaaatcaacctcttttcttgaccacttataaccaactggtcaccaaattctgtctcgtctaccacccatatctgtctccatttttttccacctcaacattcttgacccgtgctatcttagttggctgtaacaaagtacctcacaattgtgtggctatatggtttggctgtgtccccacccaaatctcatcttgaattgtaggttcataattcacatgtgtcatgggagggacccagtgggaggtaatggaatcatgggggtgggtttttccagtgctgttctcatgatagtaagtctcatgagatctgatggtctttataaaagggcagttcccctgcatggcagttcttagttgatggagtaatttgtctgtttaattccgataacgaacaagactgtggcatgctaactagttacgcgaaccccgagcagtcagcatcccccaacttcttagagggacaagtggcattcagccacctgagattgagcaataacaggtctgtgatgcccttagatgtccacggctgcatgtgcactacactgactggtggcgttctgcccccatcccaaagatctgtggaactttgaacttgagagagatgatttagggtatctggtggaagaaatttctaagcagcaaagcattcaagaggtgacttgagtacttttttttttttttgagacagtttcactctgttgcccaggctagagtgcagtggcgcaatcttggctcactgcaagctccgcttcccagatccacgccattctcttgcctcagcctcccgagtagctgggactacaggggcctgccacggcgcccggctaattttttgttagtagaggcggggtttcaccatgttagccaggatagtctcgatctcctgacctcttgatccacccaccttggcctcccaaagtgctgggattacaggtgtgagccaccacgcccagctgacttgagtactcttaaaagcattccactttattcattcacaaagatgtggtttggaattggaacttatatttaaaagggaagcagagcataaaaaaattggaaatctgcagcatgacagtgcaatagaaaagaaaaacccattttctggggagaaattcaagctggttgcagaaatttgcataaataacaaggagccaaatgttaatcaccaagacaacgggaaaaatgttttcagggcacgtcagagacccttatgccagcccctcccatcgcaggcccagaggcctaggaggaaaaaatggttttgtgggctgggcccaggaccttgctgctttgtgcagtctcaggacttggtgccctgcatcccatctgtggctaaaaggggccaatatacagctgaaaccattgcttcagagggtgtaagccccaagcattggaggcttacatgtggtgttggacctgtgggtacacagaagtcaagaactgaggtttgggaacctctgcctagatttcagaggatgtatggaaacacctggatatccaggcagaggtgtgctgcaggggtagagccctcatggagaacctctgctagggcaatgcagaagggaaatgtggggttggagcctccacacagagtccccactgggactagtggagctgtgagaagagggccaccatcctccagaccccagaatgatagaccaactgacagcttggatcgtgtacctggaaaagccacaaacactcaatgccatcctgtgaaagcagccaggaggggagctgtaccctgcaaagccacaggggcagagcttcccaaggctgtagaaacccacctcttacatcagcgtgtcctggatgtgagacctggagtcaaaggagatcattttggagttttaagatttggctgccccactggatttaggagttgcatggggcctgtagcccctttgttttggccaatttctcccatctggaatgagtgtgtttatccaatgcccgtacccccattatatctaggaagtaactaacttgcttttgattttacaggctcctaggctgaagggacttgccttatctcagatgagactttggactgtggacttttgagttaatgatgaaattagttaagactttgggggactgctgggaaggcatgtttggttttgaaatgtgaagacatgagatttgggaggggccagggacagaatgatatggtttggctgtgtccccacccaaatctcatcttgaattgtagctcctataatcccctcatatcatgggagtgagctggtgggaggtaattgaattatgggggtgggtttttcccatattgttcttgtgatagtgaataagcctcacgagatctgatggttttataaacgggagttcccctgcacaagttctcttgcctgccgccacgtaagatgtgccttgctcctccttcaccttccaccatgattacgaggcctccccagccatgtggaactgtgagtcaattaaacctcctttataaagtacccagtctctggtatgtctttatctgtgacatagactaatactaatactaatactagtgtgagaacagactaatacagtggcttaaacaacagcaaaatttattttcttacagttctggaggttagaaatctgagaaagcaacagggttggtcccttctgagctctttctctttggcttgcagatggctaccttctctctgtatcttcacatattcttccctgtgtgtgtgtgtgtgtgtgtcctaatctcttcttataaggatacggtcatattcttccacatgtgtgtgtgtctgtgtgtgtgtgtgtgtgtcctaatctcttctcataaggatacagtcatattggattagggcccacctgcatgacttcacttaaatgtaatcacctctttaacaaccctatctctaattacagtcacattctagggtgctgggaggttaggacttcagcatatgagtttttgggggacacaattcagcccgtactacctgccttcattttcttatgagcttattgctcactctcccactttgtttccatacctccagtatcatctacattctgacgtatcttccatatcaccgtcagagaggttattctgaattcaaatagcagtgcagtactctccctgcttaaagccttgggtcagtggagtatctacccagacccctgcacaaggcactctttcctacttgcactgtgccccacccatgcggaagtatttcagcttccctaaaggcttagacctgcacctctgtgcctttgcgcgtgtggctttctgggtctgaatgttcttaaccctgcctccctttgtcttatcaactgaattgtttaagacccaacgtaggtggccaggaggaaacatggcaaatagcaatagaacaaatggagagaaactgttgaattattatatgagaaggcatcttgttcataagaacacaaaggaaaagaatatggtaatgtaaattaggctgttacagacttttgtcattctgtggagcccctgaaactttcttaaagggatggatgataaaatttacatcttccttttcatcagttacttagtcattagttcagggcccatctctccatatgtaatcactgcctagccttcccaaatcggagccccgtcatagggctgcagtgggatctggagaacccactgtcagcagtctctgttctttaaccctagacacaggaacaatgcagctcttccccaccttttctgaaaaatgagtacaaattgcaagaaatgcagcacagattgtacgatgtcagtacattagcagtgacatgggaaatctgatggagtcagggggaaaaggtgtaaattgcaggataatatcaaggggaggtcagtatgttagtaatgcagggaatatgatggacttaaagaaaaggtataaattactgggtaatagaaaggagaggtcagtacattagtaacatgggaaaactggcagatttgggaggaaaaggtgcaaattataggataatgcaaagtaggggcatcactgtaaagatgcttcatttcctgtttataaggaggagttggggagggacttgcagtggattcacagataattgcctagaaagtgcccgggttggttgctacctctcctccaggcaggaagacttcctcaccaatgaggtggtcagccccaggtccacccattgaaacaactgtacagagattcatcctgggttggcagaaggctctaccctctttcagataatagttatatagacagatgcctatattgagtgagaatgtagggaaatttatgatttccataggcagaaaccagagaatcattagaagtttgttttgggagatggatggtagggcatgtaatacttgttagggaagcatggtgagagctgagccatctcagtccagtccctcctgcactcttgtctgccaacttcagacccacatggagttaaaggtctcaaagattttcacaggatttaatcaaactaaaaaatccacatttcaagacccatatttggaagaaaaatattttgaaaagcaagagaatgagaaatgaaaagttcaggaaagtgattacttaagaagatgtggcacagggctcatatcaagaaggaacacagcgggagctatgttttgtttttgtttttgtttttgttttgagacaaaatctcactctgttgaccatgctgcagtgcaggggcacgatcttggctcactgcaacctccacttcccgggttcaagcggttctcctgcctcagcctccccagtagctagactacaggcgcccaccaccatgcctggctaattttttttttttttttttttttttagtagagatgaggtgtcaccatattggccaggctggtcttgaactcctaaccttgtgatccacctacctcagccttccaaagtgctgggattacaggcatgagccaccgcttccagccagctatggtaatcttgttagttttctagttctgacattgggggtgagttcacaagttttggttttattatgcttcatcatatacctattagtcacatatgttcttttgtatgtattaactattacataatacatttttgggatcagcttagggacatttataactggaattattgaattgctatgagtcatataacatctgttggattcttatatggctttagtagagtggagggtagtgtcttcccgtaaaagccctgtaatatcaaacaagaatgtctgacaggaaaatggtctatctccccaccttcctgggagaaatactggagatgttcaaggttttacctttcttagatagtagatagatcatgaaattattgcagactaagtgctctggtattttcctaatctaagattattttaaaattattttagcttaatgtctaattctagatacagttaattttcatcagttctgaaaacagatgctaaacacctatgtttataatgctgagggggcattacctgggaatttgagacatttgggaagatcttctatgtactctaccaacctcactgttcttgaggaatgaagaagccatcatatttccttttgtaattctgtcttccatctggtcaggagaaagaaggattcttcaagcctttctcaggtggcaaaactctaaggagaatcctgtgctttttgtgtcccctgtgaatgactgcagctccttgctgacagcttagcccaaaacaaggcctctggggactcaccagcccttatcacacttgcgaagagagcttgatgtgtggtctagttgttgttgggagttaggacactagattctttgtgaggtctcttaggatgttgttgtcataaataatactctctgaaggtttttaccacctactgtagaccaaatgctttctgtgctttgctttatttactcttcacagcaacccaaggtagctgttgtcaccatccccatcttgtgctgaggaagcagggcctagaaagaggcgaagtcactttttgtggcctcttaggcagagtgcacactcggtcctgtggattctatagctcatgcttctaacagtggcaggtctttgtcatttaatcctttaattctggtaacattacaggagtgtatagaattttttttaacctcatagaagtgagaatgtcttacagttgtgatcagacattatgtaataaggacaagtgggtcaagctctgtgacctccaggcaggagcccccaatacattagagattgctgagatttgactatcccttttaaagtgaattccatgctactacttttcagcaaaactatatcactgataccaagatggttaatattttctaataagtgggatttaacatttttaaagtgtgaggaggagggaccaagtacattagagatatttttatttttgtttttcttttttgagacagggtctcactgtcacccaggctggactgcagtgttgtgaacatgcatcactgcagcctcgagctccttggctcaagtgatcttcctgcttcagccttccaagtagctgggaacacagatgtgtaccaacacatctggctaatttaattttttttttgtagagttgaggtctcactatgttacccaggctggtctcaaactcctaggctcaagtgatcctcctcagcctcccaaagtgctggaattacagacgtgagctatatttctttaacatactaggatgagacctagtgtgcacacatttgtttctgtaagaaagcaggtttgcatagtattttggtgtctgttatgctcacgaaggatatgtcattttccttctgatttataattggtacctatgagggaagtcacagcacttaatgtgaaatgggcttcaaaggtaaaatatgaagtgtctttatccttagtttgctgatttgtctttatttggctacagaaaatgtaaatacattaatctggcatacagagcacgtaaaacaaggaaatgcagtgtaaaagtagccagaactggcctcctccaggtacagaaggctggccacatccctgaagacaggtactcactgggtgctgcagagaccttggacccccagttgtaatctttttaggagagctttttatagtttttctgcttaattctacggagtattttatcttggtgtattcttgtaaatgccttaatttgatggaatttcatacaaaattgacatatctttccttttaatgggaatgttttgtatctttataaactctttctgaggaccacatagtcctgtacgtaatagtggtttaaatatacataatttgaagtgcaaaccactccaacttacaaaccatatcatagcaagagaaacctttattttagcttagtcctactggtcttgccagtctctcttgagggaccatattcacttgacttgatgatgagattgcacactgttaatctatcagttaaacaggtgtttattgcatgcctattgtgggcttagttcagggttttcccctgtgcaagagacaaaggaagtacagcccccaattaagaatggattggtttccaaatgattgggaagctgaatctggaacctggaatgtggcgcccaacaatgtaatgaatggcgcttaattttccaggttcgcccatgaggcatcgttaatcgctagtgtggttcatccatatcttgatgtctaaggcttctgttagggttgagatacaaaagaaaagcggggggaactttcttctgcctttctgggtgctaagctcaccccttcttcagtgccctcctgccacaggggttcccagtgtcctccacagtcgccagctgcctcctccctgtttccccaacccagcaaaactctcatttcctcggcgtagcagatctcagttagatgttagtacagaagtattttgatttaactaattcatactaacatgtgcataactgataacttccttaatcttcccagaggcatttgcattattaaaacaaaatacttattaaatgcatattaagtcaagcaagggtagattatttagcacgtaggataaagtgaaataaaagattaagaccatgcaagggcagttgcgttggggctgcaggatcaccctggaggcagagcagccgtaagaggagcttgttccctggggctggctctccaaagcccaccctacttctcatcacctctttccttatactgtttctaaatttctggattctggaaaaggccacacattaacatgatgttggcaccagcagaagctccattggttgaggtgaggtttggggaggaccagggattggctgaggtcatccgtgactgatttttaggtttgagttgccaatacgccagatagtaataaatgtagggactgcctatataaggcagggtcgctgactaaaaaacaagacaaaggtatagcaccagtagtgaccagaaatcatggaatcattcagcagttcaggtcctatttgctgatggtgaggcaggagacctggttcctggcttcatactcagtttataatctagtcaggtaaatagactttatgtaaataattacactaaaaacaagatcaggccaggcgcagtggctcacgcctgtaatcccagcactttgggagaccaagacagatcacttgaggtcaggagttggagaccagcctggccaatacggtgaaaccctgtctccactaaaaatacaaaaattagctgggtttggtggcaggcacctgtaatccccgctactcaggagactgaggttggagtgggccaagattgtgccactgcactccagcctgggcaacagagtgagactctcaaaaaaataaaaataaaaaaaagataaataaaacatttttaaaaatgagatcattacacatttctctacctgctgtcatagaaaaccaaagaacatcatgaatgattatagcccggggcctgattgagctggagtgggggtggcttctctgagggagacatgtttcagcctagacaaggagatcaaggctgggtcagccaagtgacgagggtgtgggcccagggcttaggagagcattttaggcaagacgcatggtgtgcaagaccatggggaggaaacactcttggtgcctttgagaagtggctggtgaatcttgaagagggagaacctgcaggtgctggagggggcccttggagaggccaggaggcagctttgtcccacaggcctcgtgggccacgttttgaggatagaacctgaaaggcatggggtctgacattaggaattttaagcaggggagcaacagcttctactgtgtggccctggccatgcgtttaattggggcttaaagaagggaatctactattggtgagggcaattcagatctgaagggaacagaaggggctcttgccatacggtgtcatttaggggtgcccagaagggcccctgcccaaaaatgtctttccaaccatccctgacggtgtctaaaatcctatcattgaacttcatctcctttaaaacacaagtcctctgacagtcaagcaggatcagacaaaattgcaggatatttaaaaattttgtcaggccaggcacggtgactcatgcctgtaatcccggcactttggaaggctgaggtgggcggatcacttgagctcaggagttttagaccagcctgggcaacatggcaaaaccctatctcaggccaggcattgtggctcacacctgtaatcccaacactttgggaggctgagacaggcagatcacttgaggtcaagagttcgagaccagcctggccaacatggtgaaaccccatctctagtttaaaaaaatacaaaattagccgagcatggtggtgggcgcctgtaatcccaccaacttgggagtctgaagcaggagaatcccatgaacctgggaggtggaggccacagtgtgctgagatcgcgccactgcactccaggctgggcgacagagtgagactccatctcaaaaaaaataaacacaagccagacatggtggcatgcgcctgtagttccagctactctggaggccgaggtgggaagatcacttgagcccaggaggttgacgctgcagtgagccgtgattgtttcactgcactccagcctgggcattggacccaatctcaaaaataaaaataaattttttttagacctccagccatccttttcaaataaagtatctctctctctctctccccgcatagcatcccttccctcttcagacgcccaggactcatatgtcagtctctaaatcaacacctgatttcaagagaggctctgtcggatatgacttatatgaactttatgatgcaattttgaatcagtctgttgccttttcccaggttataatgtatggctgattgtaactccagctgctttaggtgataaaaggaattcgttgactctcacaacagaaccatgcagaagtgggactgcctctggtgcaatttgatctggcccctggccgcaggtctctgatgttctttcagccttgcccttgccccgtgtcagtggtgatcttggactgactcccaccaaggatgcagcactgactgcagcggctcccggcctcacacccgtaacctcaccaacctgagctgaaagtgctgctctactcaggacggtcacaagcccttggcttctctctaaggttgtgggacacccctgagccaattattaggtccaggagtatctaataatctgagaactagtcactgagggcatcctgctgattggtggagtataatctctggagctgtgggtggatccttctctcccaaatcacagggaccctggagaccaagaatgggcacaaggttgagtcagctctagggaagcaccaaacaacactgacgcatagggatatttgtattttaagtatttagtctgttaatttaatattaaagaaatgtggctggacatagtggctcacgcctgtaatcccagcactttgggaggccaaggcaggcagatcacttgaggccaggagttcgagaccagcctgggcagcatgaaaaaaccctgtctctacaaaaaaacaaaaaacaaaacaaaaattatctgggcatgttgacgtgcacctgtagtcccagctactatttgggaggctgaggtggaaggatcagttgagcccaggaggtcaaggctgcagtgagccatgattgcaccactgtactccagcctgtgtaacagagtgagaccccatctgaaaaaaaaaggaaggaaacaaaaggaaaaaggaaagaaaagggaaaaagagaaagaaacatgggcatcagcaaacagatgggagaggaattgtttttagggtagaccgtcaggccatccaacagttcctgaaacttgtgcttcctgtactagccttgcccatgacactcattcatataatcactaatttgttagtatggctcagttatgcaattatttttgcctctgacatactcctgtgttaaagggagtgcatttgagcttggatccaggacatttaaaattggctaagtatgtgggtgttggggatggaattccataaacatgtagatcctgtttgtttaggaccattatgcattatttagaactagttatttaaaaattaagtagtgttcctcattggttatattagaataattttataaataagcttgagagaagtggaagaagatgcaaataagggttattggttaaagaaaagtttgatgatcttttgtttgctatcttatctaagtttaaagagtttttaaaattcagaatacatgaattttcagttttaaaaatactgggattttttttagtttttacttgactagttagtacaggctgtattgaattcttcagaaatacttcaaaatcaggcaaaatgtgtagcattgccaatttttcatcctaggtcctttttttctcaaccaactgtattcattaatattcacagatatatgaacataaaatgagcatatgctcaacaaacatttatcatgtgcagggtgcatccccattgctggggatacggagaagtagaagacacacttcctttcctcagggaacagcatatgatctctttgggaagaaaagcaaataacatggaaaataaaaagtagcagttcattcactacctagtgccagcaggcaaaccaacaatgagtttagaaaagggggagcagttgctggggtgagaggagaaagcctgcagaggatgggagaggctcagatgttggcaaggaaagggagaacatcccaggtggtcaaacaagtttgcttttgcagttgaatttcattctatttttcttaaaattatggagtatgctgcttaattccaagattttctttattgtgtaatatttcctgtagaattgttaggagttggtcatatagatcacttctgaatctgactatcatcaagttggcagagttcttagctggctttctttaacattgagttgttggattattcttagtttaataaatttaggattaaacctaaaattttccatttcatattatttcttcccttttagttatttcctgtcctttactcttcattttttttttctactaagtctgtgaactcccctaggtggctgtgaattccttttagacagagatcatcaactccctggagctttggatagtgcttggcacatagaagatgcacattaaatgcttagtaaatgtatggaaacatttcacatatgagtagaaagaaataatgcagaggaaattagatgtaagtacatatgtataattgtaattttacttatgattttgaacaatctatcttcttatagcagcttcctgctagttttacctaactcagagctaactttgtcttaccttctccaggaggtaagatttagaaacctactaaagtgctctcagacatcagttattttgtaagtcagagttgttatctatgatacattaacatgtttgatgatgtgaatgctcaaattttacaagatcttttgttcctcttctgcataattcagttcttttaagaacaacttatgtgttgtagttccatgtgtgtatttcagactagtcaacacaactaaaatctgatcatgattactagcttttcaaagtcatccttcatttcccaccaggtagctttctgtcagaattcatttcccatttggaaaatatgtctctgacccacagttttctggacacaattcatccttcacatgtgtgagactgcccattgtcatcaatcctcagctcctcaggtgccaaaaatcccctctatattcagagtgataaaatatatcaaaagtgttacaggaaagaaaactaacaaaaatgtttaaaagatttttgtcccagtggtttttctaataaaaaaaaatgcttttagtatctgtttctattattactgtttaagaaattaaaataataactgttacagttgaaacaggatgtgctttctattttctttccatctttatataattaaaagtgaactttggcagagctgcaatataattcaattcaatttagcaaacatttgtggagacccttctgctggtcccgcaataccatggtttctataagagctggcttttagttgcagcaagtgcaagagagtgtgatccagatgtgactgctaaggaaactaaaattcactgtggaaggagattaggtaaggaaagattcatccaagaaggaatttcatgtttaattttggacaaagaattaaatttggtttgtgtctctgtcaattttttgttgctataactgaatacctgagacttggcaatgtataaagaaaagaaatttatttctcacagttctagaggctgggaagtccaagaacatggtaccagcatctggagaggaccatcttgctgcatcataacatggcagaaggcatcacatggagagatgacaagagcatgtatgtcagctcaggtctctcttcctctttttataaagccaatagtcctctcatgagggccccatcctgatggtcttatgtaatcccaattacctccaaaagaccacattcctaatcagtttataaatttggggattaagtttccaacacatgaaatttgggggacacatttaaaccatagcaacttgcaaaggggaatgacattgcaggtaagggccactgggattgggttcagcagggcatgtactaattcttgggcaaggaagggacatgatgagaaaggtcttcatctgtttgcaggctgcagcagataccagagaactaagtaactgaccgaggcttaagtgatgaggtcttgtttctagggtaaaggaggtagacatgtgaaggctaagtcaaatcttagaaagggaaggtcaaatcttaacacagaatcaggtagcctcagtagcttattggatattgggaagcaatgtgaagagaattgtcaaggttagttccaaggatggagagcctaggtgagtagggaatcatggtgtcatattagtataaatggatggtgagaaagagaagtgtaataggcagaggctttagaggatgtcagtggataggaggaaagccagaaaaggaatgtcagaggagaaccgggaacttacagtttcatggaagcaaagagaagacagtgtttcaagatgacaagaagaacagaaaagtcaagaaataagaggtctgagtttggttttgtttaggagaaggacaaaatgttgacctttgagtaacttcagaaaagtagtggaagtgggtaccagatggcaaaggccctgaaaatggagaagaatttgtgttactggggagactgtaaaacaagatccttcagtcacttcaagtaataaaccccttggaaggaaatttactccttaactgactagcattatgttacaaaatgccagtatattattaatacctggagatttaaaatgtacctgttttcacactgtaacccagaaacattatttttacaaaccatttggaaataatagtttgatattctttgattccactctttcagaatttcacttatccctctccaagatttatttctgggtcattgattcagattccaaaactaatgttttctataagcttattttatgcctagtagagtttaaattcaaacattttctaacagtagcaactgaaatatcttcaaagacatttttcacatctaccttactttttcttggttgattatatctttttgaaaacaccccagattgacagcatgtgaggtagtatgcctatagtaacaacacaagctttttagaatggttgagaaatgtactttggccttgttctggttcctgaagacatttgtttgtttgtttgtttgtttgttttgagatggagttttcactcttgtcgcccaggctggagtgcaatggtgcgatctcggctcactgcaacctccgcctcctgggttcaagcgattctcctgcctcagtctcccgagtaacagggatgatgggtgcccgccaccacacccagctagtttttgtgtttttagtagagacagagttttaccatgttggccaggctggtctcaaactcctgatctcaggtgatccacctgcctcggcctcccaaaatgctgggattacaggcatgagccactgcacctggccctgaagatatcttttagtcctaaaaggagccaataaaggaaaaagcacgttagaaccagagtcataggacctaggttctgttccctcctttggggcttgactgtgaggagatcaacatctagagttcctcagcaatgaagtgagaagacggtatcagagggccaatttggtctcattcaaataaaaaagctcagaatgcatggctatactatatattctgtcttccactaatcaagcctactgcatggtatgactccacatttgcagacgtgatcagagtgttcctcatgccccctcctctgcctgtttcctctgtctatgatggaacagccttacttctcccttcatgtgcccaactctcttaccctcctaacctcaggctacctgtttttttggcatacagtggcatccctggcacctagcacctctggtacagctcaggtgctccataaatatttgatgacagagtaaatggactgtgttgtattattgtccaccctggtggttctccacactgactaaacatcagaaacagagatctccaggtcctactcccctgcctttggcatttgagtttgtaggaacaggcctatacattcctactgtaaaattccgccacaggtcatgctcatgtgagaaacacaagtctctcctccgtgagttccttgaggaggcagactatggtttctgccatttcattcccattctgattctggcagaaattagatatacaagaaatatttgtgaataagagaatttaactctagagaaaagtaataaataataaatgagaggaaaatgccctttcttctgtttgcagatctaaaaccttggacctttaaagactaattcacattacccataccaagttatagttttaaataagtgaaattatgtaagtgcccaaaccaccagatctgataaaattcagagctcattgttatctaataattttggctaggactactctgctttatttgcctgatttttacaatttcgtgataagatatttgctttcattattactgccttaccataggccttattttaaattgtttcttaataagtgacaatccaccactcttttgagtcatataattctagtattttaaactacagtttctttctttggggtgagggatgtgacgtgctgaataaaggagaactagtgtgaacttcggtgttgccacaccacccactcttatgtatatcgtatttctatgctccagagaaagcaattaagataattgttttttaactaagaaaactatgccatcctgaatacaaaaacctcatcattggccaggcacagtggctcaagtgggaggccaaagcaggcagatcgcttgagcccagaagttggagaccagcctgggcaacatagggagaccctgcctctacaaaaaaaaaaaaaaaaaaaaaaaattagctgggtgtggtgatgcacacctgtggtcccagctgcctgggaggctgaggtgggaggattacctgagcccaggaggttgagactgcagtgagccatgatcacgccactgcactcaactctgggcgacagagtgagaccttgtctaaaaacaaaacaaacccttcatcatttatagcctattagcctgttgacctgcattttagttatctgtggctgagtaacaaatttccctgacactcagctgattaaaacaataaacatttagtatctctccagtatctgtgggtcaggaatctgggagtggctttgctgggtcgtcctagttcatgtcctctcacgaagttacagtcaaggtattggtcatctgaaggcttccgaggtggctcactcagatgcctgcaagttagtgcctgtctgcaggaggcctcagtttcttaccacatggccctgtcatcagggcagcttgagtgtcttcaccacatggcaagagagccaggagagggagagcctagaggtagccccattgcccacgtttaggggaaaggctgtcaggctctactcttgaagggaggaacatcaaagcatttgtggacatagtttaaaactgccacagcctgtaccattagattctgtttgctaccttagatgctttgtccagggtctgaaagcatctgtgatccaagttatttatgtagtttcttctccatgagtagaagctggatatcagaatttctggtttctactttattatttctagggcctactttctttttattctcttgtataagataatgagatacagtagtaaaaaaatcatgaagtattagaataaaaagatatcattttctctgcacaccagactacaaacttttcctgtctagaccataattcagaacttattgtttctgagaagccttcttattgaaggtggaaagaaatttaagaaagctgcccagtttctagatgaactggtgagggccaattccacagcattcacctaggattagaggagcaagtgccagatatgacagagcttcagagaaggcatcttacagttactcaggagcttctccaaaaatggaaccaatgaccatccagcattttattggtgatttttttataggaactttcagaaaaaaaagaaagaccaggtcagtaacagctatagggtgttaaaaaaaatcaacccaaaggcatttataaagtgagccaggcatcgggaaccgtgtttttacataattacctcatttcaagtaagttttctttcaattcttcatcctccaaccagtctttccgtcttcgtgcgtcatgattatagcactttttggtctgtatctgtttgccacttgactgggagtgcccaaagggcagagctgtgaaatgcgtctttgaatccagatgagcaaggcaatgcctggcccttagttgatttttattatttgtggttgagtttaacaagcctataagtaaataccattatcttctttttctctgtaagaaagataacactcagaggattggaaaacttgagtgcagcccatagttagtaagtggcagagtttgagcttcaaagccaggtctatattttctgcttcagttcacatgcacccaggagaactctaggagggaactgtgttgggagccccaagtagtatccttgtagttctcagctaggagaaattacttaggaggcatttctgtctttgcccagaatgaatcactgtagtttaagagactgccaaaaggaaacagtctgttgattggataaaagggtcttgaaaataagctggcttttgcaaaccatatatctgataaaggttaatatctaaaattgataaaggactcatacaactcaatagtagaaaaacagatagcccaatttaaaaatgggcaaaggtcctaaatagacatttctccaaagaagacataaaaatgaccaacaggtacatgaaaaggtgcccagtattattaatcatcagggaaatgcaaatcaaaatcactgtgagatgctacttcatagctgttaggatggctattatcaaaaagttaaaagataaccaatattggcaaaggtgtagaggagggaactcttatataccgttgggaatgtacattggtacagccattatggaaatcagtatggagatttctaaagaaattcaaaatacggcatggtgactcatgcctgtaatcccagcactatgggaggccaaggtgggcggattgcttgagctcaggagttcgagaccagcctgagcaacatggtgaaactctgtctctacaaaaaaatacaaaaattaggcaggtgtggtggcacgcgcctgtagtcccagttatttgggggactaagccaggataatcacccaaacctgggaggcagagggtacagtgagccaagattgcaccactgcactccagcattgatgacaaagcaagatcttgtctcaaaaaaaaaaaaaagagagagagagagaaattaaaaatagaactaccatatgactcaggaattccttttctgggaatatacccaaaggaaataaaattcaccactttgtaaagatatctgccgataattgcagcattattcacaatagccaagatatagaaacaacctaagagttcattgctggacaaatggataaagaaactgtggtgtatatatacgatggagtattattcagccttaaaagtgatcctgacagttgtcaccacatggatgaacctggtgggctttataccaggtgacataaaccacatacagaaagccaaatattgcatgatttcacttatatgtggaatctaaaaaacaaaaacccagtcaaatatacagagagaataaaacagtggttaccagggctgtgggggcatgccaggaaatggggagatacaggtcagaggatacaaagtagcagatgtgtaggaagaacaagcctagaggcctaaggtacaacatgagcactacaggtaataaaattgtgctgcatttgggattcatgtgaaatgagtagattttagctatttttgccacaaaaacaaaaaaatgggtaactgtgcaatagttagttgggatatgttaatttgctttgctatagtaaccattttcctatcggtatgtatcccatatcatcatgttgtatatgttaaatatacacaatacaatgtattcatttattgtttgagatggagtgtcactctgttgcccaggctggagtacagaggcacgatcatggctcactgcagcctcaacttcccagactcaagcaatcctcccacctcagcctcccgagtaggtgggactacaggtgcacaccaccctgcccagctaatttttgtattttttgtagagatggggtttcgccacgttgcccaggctggtcttgaagttctgggctcaagtgattctcctgcctctgcctcccaaagtgctgggattacaggcatgccaccacacctggcctaacatttattaaaaaaaaaaaaaagaagctgtcctattcaggctacaaaagaacttttggtattacctgatgttcttcattctgtaagtgggacactgaaatttcctcatgcctaaaatgctaagtaagggaaagtcctcttttttctttcccatttttccagggattctgacctgggtgatgcaagaattgaacatcgtatttagataggaagttggagctcagtaaatgaggagattgtgtatcaaacccccgaccaagctactgagacttcctgatcactcttaagaggccccaatgcaagagtctaggccctaagctaaagtagtggtggaagagcaggtgcattcaaatatttcatgtctaaatctacaggatcgtggtgacaggatgcacggtggatggacatggagaagttgaggagacctgggagcctgagtgaatggtagctccattcagtatggcaggggacaggggaggaggagcaggtgtggggttcactatgggggcaatttgggctgtgtattcaagtatttaaggcgtcttttggacaattagggaagatattttatcaagaaatgtgcattgaggttagatggctccgtgaaagagcaactgtctggggacatctgggagacagctggatcgtaggcatgtatctgatgatgtccagttcatggattgccggtactgaagagagccaactgctgcagaggactttcttggctgtgtgcggctttgttgggaatctctgctgctgtctttatagcttagtatcctgaatgaggaggggagcaatgggcagcctcttgctagtggatgtggagaggagctaccacattgccctgtatgtaggatgcgggcacctctctctgcccagctctcctatgggtcattacatggagcttgcttttactcattaggatttggcaatcttaaatgcctctttaaaaaaaatgtgtttgtatctgctttgagatgtcattttttttttttttgagagacaaccgcaaattcatgcttatcttctcgggggaaatacctctactaaaaccatagtttggctttttccatatgggtgttgaaacagatggttgtaatgagacctctctaattaagcacttgctatctgactctgaatcattttagatgtgctggcactcttgctctctctctttttgattcaaagagttgtcctgagatgtaacacatttagctgttattatagtctataaactttccattttttcatttgtagcttattctcttttttgtgctaatctgagagcataattaagatgtctgacttcagttctttccttacaaatattgcctaactcttctgtctttaattatccaaaatcattcctatgtaaacaaataacaattgcagattgtactacctacattcttttgttgtgaggatgtaagtacacccttgtttgttaaattacagtcttttaaagaaattggatgtgacatattttgtcattttgtatgatgccatagaaaacaaaggatcacttctgcatttttattcttggtatcccttttatttaatattcattttaagagccagtgtggcaggtgaagtgaggacaggctttggagtcacactgccttgaaaatctcagcctcaccacttcctagtggtgtgactttgggtaagttgcttaggtgcctctctgtgcctaggcttcttggtgcatgaaatgagaatgatggtaatattcacctcacaggattatgggcattcagtgacataatgcaagttacatgcatagcacaatgcctggcacatagtaggtactcaataaatgctaacaatatatatttttatatagtagaggaagctttcttaaccaattcatcagattaaaggaagcttccagaccctttgccgagcagtccagtgaatgcccacgacgtggtgaactgtaactggcttctctctagtatgctcaggcacttctactccaattagctgactttatttgctgccaaacctgtttatgttatttgttgcttgtgtttgttcccaagcctatttgtgccagttgaacttgttattgtaattatgtaatttaattaaatatcaggcaaacagatggaatgtaaaagtataaaaagacagcagctttttcctgaaaatgaactttgaaggctatggaaagacttaacaaaatattactcattaaggtacctgtagatttgtagagactgaaaggagaatggtggttgccaggggctggagagaaggtaggaatgtcgagttggggttcaatgggtacagagtttccattttccaagatgaggagagttctggatggggacaggggacaggagatgggtgggttgcacgatggttgcacagcaatgtgactggacttaaaaatggctaaggtggtaaatgttatattatgtatattttaatacagttaaagcttttaaaaatatgtcacattagctgtggataaaatagctgttaaagattgaggtgtgcgaggaataaaacatctagaaagagtccacatcgagattgtttcccagtggtcgttaagttttcataatttcaggaaaccaagataggaaacttattttaagtttaaaatgaaacatttaagttgtgtacgtgtcttgggctaggctcctggggaacagactcacagatggagattgaggccattggaacttgtcctcctgtgttgatcagaccttggatgtgggctgctccccaggggaggggcataacctcgaacaaggcgaacttctttggctgagcgtgagtctcaggaggttcttagctgagaacaatcagcaggtaacactccagcagctgggggatctgagtggtacactacagcatccacaacagtgtgtctccattttgtgtgtggttttccctttataacagacttttaaagattaactgattaacttctggtccagattgcttcaaataagagtatcttcactgcttatgcataatcttctgaaggtctcattgtatttgatcttctttgcatatgacagttgtcccatctatgatacaacaagactgcgttctcctgaatcctgtaaacttaatcacagcaaataaacgtgtgatgtgttggaagcacaactgatgttagggcctctgtccactcctaagtattttccagtatttattttgagattcatggaaccaacttcaggttttctttttaaatttccaaagactcttttggcattcgatggtatcctttggcaaactctccacttttgtactagagatcatcttcctttcgtgccctatgacctgtaggtctctctctgcatgttctttggtgactcttccgtctgctgcaaataactgccatccctcttccttttactttagccttttgccttagacccgcgtctctttatgatgatcccaaagctcctgacttgaatgatggccaatctccaggacgtctaaatttcattttggaatatagtcttccaattcttaaaacaggagccctgtttatatggttgttttgtttattgttagatccaaatttgcttttcgtttctctcagcttgctttgccccaaattgtcaatgctaaagtggaagtctgaatccctttgccagtgtgaccataaatatagcacaaagatcctatgattaccctatagtgtctgttttccttgagcattttagcatgtgctgaccttttagcaggaatactattcagcctcatttatgcttagcccttcatttagccaagttttgttttttccttggtttcaaattttctctctttttgtgaactgggagctgaagcccttcatttgacttgtgatcttatacattctggaagctcatacatgtaatcgtggaacaaataaagcagctggaggaaatcttttctgaacaaaacccaagtggggcatttgggtgcaagccaagatttcagcagctacagagggagatgtacaaaggctgcctatattacaaagccaataaatcacttctggccaaataggaatgtcctataggtaatggctggatagagggtaagggacctttacacatttaattacctgactacaaaataaagtgtttactgtaaccttccaagggctctctagtaagttaattcctataatataactaaaggtagatgaacactgttggctcagtggatgagcaacaaattggaattctgagtctgttcagcctgggcctaggcttcccactaaattgatgtgtggtcctaggcaagatactgagtgtttaacttcctagggctcagtttctccttccaaaattaggaattataatacagatttagcttactaaatcccaagaagccactaaccaactaactaataataaatgaggccatgtagcgtgaaatcctctattaacttcctcttttccctttttagaggtgaaagttaaatgtcctacagtgatcaaataattaagtaaaatttcactggacattttgacaagattggttattgattcatcaattcatacacacacacatacatacatatctggacttacacatacaaaagcaagggcttagaatggaggtaggtttaaaacaaatgtaaaggagtttcccaagtttttaatcatctattagttcatccaggcaatgttaacaattatgcagagcagcacctctcaaactttatgtgcataagaatcacctggaaggcctttaaaatgtccctcctgggctccatcctcagagtttctgatttggtagatattgtggtagggcctaaaattagcatctaacaagctcccatatgatattactggtgtgcagaccacactgtgggtcgcacagtctagaaacattcggaatgccaaggtaaggaagacacatggtgtctgtaaggcaggtaggattaatattaatactccatggtgtgctaatattaattatactgtatcacagtgtgtgtgtgtgcacaggaccatgtgttctaaaatcatttcagagaacatagtatgtgcagaggcttagagaattgaaactacatgacacattcaggaatgtgaagtttgcatcactgcagcagagagcatgtggctggccgggaggcagggggtagtctagtaggggtggggaggagaggaacatgtggcagaagagatgccaagatctaggtagagctctgatggtaattagggggcttgtgtactccaagagattggattgctttcctaacctgagaacaagagaaatggaacagagaaaataaaagattcactagagttctcaaggtggtagaattaatgatagcgtagaatttatctaaatataatctagttaacccattaatcctgctgaaattacacttcagttgaaagtcaatctcttgggtatctggtttcttcatttctggtcatttttgtgcaccatatgatgacttacgtgttcttaaatatgacctgttttccattattttctaggttctttttctatccagtgaatagtcagccagtaatccttgtcccaaattgattataataatgaacaggtggaataccaagatattagcaataagagtatcttaccaaaaaaaaaaaaaaaacagatttccttgttacaaaagcaatgcatacttattacggaagctacagacaagcaaagaaacctcccacaatcccactcacatttagaaaaccactgcaaaaccccctagacactaactttttagattcttttccatgtagatgtgcattcttccctaccaaaatagattacaccatctacgttttgaaaaccagcacagttcatttacataatctgccaattgttggacatttgtactcttccaatctaattcccattgtttcacatttagtctgttccaagtaatttcccatggctgatgcctaaactgaaagtgaagggacaggagtcagccaggcaaagatggtggagtggagggatagacattctaggttgaagtactgcctgggcacagacctagaggtgaagcaaccataacatttgtgagaaccgaaggatgtacagtaaagctggaccatggagggtgaagggtaatgggagtggacgttcacaagattaaaacattggaactaatagcctacagttggatatccaggggactaattggccaaaatttatttagggaaaaagtagagggaataaaagacaaaaagagaaaaaatctgcagcttatcactgaacgttattccttttcaaccagaatgctttattttcatttttatttatttattttttcttgagacagagtctcgctgtgtcacccaggctggagtgcaatggtgccatctcgactcatagcaacccccaccttccgcgttcaagtgatcctcctgcatcagcctcctgagtagttaggactacaggtgcttgccaccacgcctggataatttttgtaattttagtagaaacagggtttcaccatgttggccaggctggtctcaaactcctgacctcaagtgatccacctgccttggcctcccaaagtgctgggattacaggcatgagccactgtgcccggactcaaccagattgttttaacacagtgttgctttcaccaacttgattcggactaagttggttttggcaaatggctttcaaccaaatgatctatacccaaattaagaggatttgggggcttactggatccagtgccgtgctggagctgacttatgcaggctctcaagacatttctgcccatcttttcagtaatgtcaccttcatagcttgaaatcagcaaatgctacaaatcagggattttttttcattcaagccagttctgcagcacaccactagatgtagctgagtgagagggaagaaatccaaaataaatgtcctgggttttggcttgggaattgaacactgaagtcatatatcggtaccaaacatcataaactttggagtcagaggaccaagatttgaatcctaactgccatttttctgccatttcaagcagagtaattctctaagcctcagtttccttatatgtgaaatggggtcactaatatttaacttacaggataatgatataaattaatccttgagagagctattatgattattactgcaataaaaggagaagcatgagggcattcagttgatattttaatatgtaaagtttgagttactttggggagcttaggtagagaatcctgtaataacaacaatagctaatattattgattgttaactacgtgctttacatacattattttgtttaatcttccaaagaactgtataggtaggtattagtgatatgattgctctcattctgaacctgagaagactgagttttaagttaagtatctttctcaaggccagacagctggtaaatgcagagacaatttggaaggcaagtctgtctgaattcagagtctgcattcttttttttctttctttctttctttcttttttttttttttttttgtgagacagagtttctctcttgtttcccaggctggagtgtaatggtgcaatctcagcccactgcaacctccacctcccaggttcaagcgattctcctgtctcagcctcctgagtagctggaattacaggcatgtgccaccatgcctggctaattttgtatttttagtagagatggggtttccccatgttggtcaggctggtcttaaactcctgacctcaggtgatccgcccgcctctgcctcccaaagtgctgggattacaggcatgacccaccgcacccagtctagagtctgcattcttaatcagtgtgcatatgggcctccactcagcagagacatctgagctacatggtgtcagtttgtgaatgttctcagtggttcaagtcttaggtttgaatgaggtactggaggaatctatagaatcagaaaagcagaaggcaaggatgcaactctgggcaacactgaatttgaaggtgaggtaagaatttagagaaagaggggatgattagcagttttggatgccatcaggagatcaaaaagggtaagaatttaaaaaggttatttggatttggcaatatgaaaaggattggtaattttaacaaaagcagcttgggcaagataaggaaggcaaaggccagattgctttgggttgagaagtaaattggtaatgatgaagtggagaaaactggtataaattccttttgaagaatgaggtgctaaataagctatttggaatccagggagatatttaagacatagatgtatcgggcagaaatagtagaagtgaaggaatgtgattgaagaaagcaagacccttccttaggagataggagagatgggatccaaagcctggtagaagaattatgactggattgacgtcaggattgggctttttaggttgggtgtgatagaagatcaaggaggcagagaactaaagacagtcatcagtataaccaaagtcatggcatcgtaggctgcagactaggaagagaataagtaagatcaggaggccattcatagacttagagaatgtagaggggccaaggtcttgggagtctcaaagatgctgaagagaagttgggagtaaatgaagaactgagttgtgagtacagggagttgtgcacggtattcttgatattgatcaattaatgtacagagaagcctgggtagctgatgatatccctggccctgccatcagagatcaattgttgaagcagagtgaaggtgaattcatcagaattgaagagctgaagggactaagctctttgcactggtatccttttgagttcccaactagtaagactacatctttttaataatactttgttaataatccaaatgtaatgtctaaagaggtccttccccattatgatggaaacattcttcatggttagtgacgttctttcattggtgtccaagaaatctgatagaatcttcaactttttcttagtatgttcatcctgagactggtaggggaagtgtcctgggttcatttcttctccttccagaggatgtacagcttacgctttcagaagcataatgctaataatactaatagctgtcatttgttaagcacttactacatgctagccactgcgctaagcactttatgtggattatctctttatacacttataactccgcaagataggtgcactttctgtgtctattttatggatgaggactctgaagattagagaggttaagtcccttgcccaaggtcactcagcttgtaaatgatggagccaatattcaaatccgggcaatttgcatctagaacttgagatactaactctgtaaaactgtctgtcgatgctggggagacctaagtcagcctcattttggaggttagtgtattcctgtttgtgaaggaagaggaaagcagccaccctggggcccctgtccagagacgcaccactcgacccagtactcccgactgcacatccgtctccctgttgaccatcttcagcctgcttctccctaaagcacagaatcacagtgtcctttgggcattccatcaccccatacagtactgctcacctaagacagtgcccttcactgccaggggcagcatgagatgtcttcccaaagccccgcagaagttaatcctctgggcactccttacaagagagctgaagaatggcatgagagccgtttcattccactgttgattcttggaaataccagagggttgtttcacatagacacgtcactgtgatggctcttggctgttcaaagtgcaaggaggttgctgtgctgacgtcgaaatcttagtttgaaaccttatttcaagaatgctcagaaaagtaatataagaagtatgcaaggagaagaaagcatttctaatgataaaatgagtaacttaattttaagacctccttgaaaatcatattaatttgtttctaaattaatttgctatttgctgaaagctactttcagaaaatgataccttgtcctgtggtatgcctaactctaacttttatatttaaatgatccgtttacttggatgaactcatgatgcatattcagaaagtaccgatggaagagaaatggatgagcacatattttaaaaactgtaatatgttaggtatttctttagcttatgtttattaaccaaatgaagactttttaacccctatttgcaagagtaaaataatatttcacttcatcatgcaaaatgtaaaacaacaaaacagatttttttacttttaatgttagatatattcctaaacaatatcaatttataccaaatacctaatccttataaccccgccccctcccctcactgcctcctccaacacacccacagtgcgagatacagagctggaagtgcccctggcagtctacctcatagtgttccagaaacaacaccaaggagggtttaccttactcctgatcatggggcctgaggccagagggctgatacccaaagccaagtcccagaaggaattacaaaaatgaggccaggaaattaagttccaaccaggactttgttaaggcctaggtgttaacacccagggattgagccaaaaccaggtatcgggtgtggggatgtggctgggaggaagtgactgggaaggctgagagtgaggaaggttgggggaagtgttagccatgcagaagttgcttagcttggatttcagacatagggccagtgccccaggcagcattgtcacaggcatctaagctgggtggtgatggccttccttatattcattcatccacccagcagttctctgtatgtgatccagggccgccaggggtctgtgaggtcaaaactgttttcacaatattaaggcaccattgacatttgcattgatggtgcaaaggcaatggtaggtaaaattgtatgaattatttcattcaattttagcatgaagacagtagtgaaaaccgtagtcgtaatcactgtattcatcacccccttgtcctcacagtttaaaacaattgtcagtctcacttaagaatatttcaaaggaaatattaaaaagtattaattttattgtctcaatccccaaatgcacatctttttaatattctgggaagtatccatacagcatttctgttatacgcagaagcacaaaagattgtctccaggaaaaggatttcatgattgtttaagttgaaatcagaagtggccactgttttactggtacaccatttttatttgaaagagtgactgacagacaaactactgttattcagcctttagtatttggtcgacattttctcaaaactgaatggagtgagcctgtcatttcaaggaaaacaactgacagtatttgttgccaatgataaaattcaagctttcaagtgaaatttagaatttgagaaacttgtattcaccactgtgagcttgacagtttctcaatacatgaaggcttttctgatgagttcagtggtgatattaaatatggtttttatagtgtataatgaaatgtgctaacgtttagaagatccgtttaagtcagtgaataaacattttttgatgaccagtgtaagatgttacaaaatcatgaattttgcttggataaaagatccattgcaagtataagatgccccaatatatgttaacgtaataaagtatgaaaagttaattgatatgttttcaaattctacactgcagctagtctttaagaaaataccacttactgagttacagtgtagcacaagagtatctacagtcatctgaaaagactatgaaaatactcctcccctttttaactatgaatctatgtgaggccatatttttctttatatactacagccgtatctctacaaaggaaattcggaagcaggagagaatctagctataatttattagggaatacacataaaagacttacaaaaatgtaaaatcatgatattcttcttacttttgttttgcaaaatgaattttcttaaaaatatgtttatgttaaaatacaaataacttattttaaaatgaattaatattttaaatttttctcagttttaatattcatttctagtatagtaaatattgttgacataacctatatgaacagaagtttctagagttctcagtttttaagagtataagggaatcctgaagccaaaaagtttgagaaccaccgttctggtacatagagaatattatatagtgggcttgggctggtgtagagatagcattgtgtactagacaggagtggaccttgcccatggagctaagtcatctacagctaaatagataagtcccataaagtgtggtaagtgctgtgataggaaaagcgcagggtgatatgggagcacctcaccctgtttagaaacttccaggacgaattagtgtctctctgctgattcttaaaggatgaataagagttatccaggcaataacagagtgattcctctgggtatatggaaaatcatgtgcagagggccccatggaagagatcatggctccactgcagaaataagaggagtgtagcttgagcacagggtaaagggggatggtgtgacagaagctgaactagaggacagcagccacatcacgaagggctgtgtgagttcaggaggcaggacctcctctgaggggaactggaagatactggggcgttttaagacacgagagggacattatattatatcatatcatatcatatcatatcatatcatatcatatcatattatatcatattaatttattttttgagacagtgggtcactctgttgcccaggctagagtgcagtggcacgatctcggctcactgcagcctccgcctcctgggttcaagtgattcttccacctcagcctcctgagtagctgggattccatgcttggctaatgtttgcatttttagtagagaagaggtttcagcctgtcggctaggctggtctcaaactcctgaactcaggtgatccacctgcctcggcctcccaaagtgctgggattacaggcgtgagccaccacgccccgcccagattacattttagacagatccctctggccatagggaatggatgtctagaggcaggggagacccactaggggtcattgtggcaatcagagagctgatggaacctggactaggatatggctgaagtgttggagagacatgcatacacttcagagagaggtgtgtggagaagtttacagaactaggtaaatggttgggtgtggctagagggaaggataggtaggcatcaagactgaatctaggtttcaggttcagcacctgggagtcatgatactgttcaccagcagagggaacacaggcggcgcaggtttagagagaaggaggaggaatctgacttgagttcctgtagggtacctaggaggagctgcccggtcagcactccgatgcgttgttctgaagctcagaaagagcatctggactagaggcacagaggagagagccgtcaacacacaaactgtaactgaagccatgggctgagtgagaaccctcagagggttggaataagaagagaagactgcctaagagacaaccctgggggtaccaacatctaagggataattaaagaaaggagagtgtgcaactgtccctgaaaaacagtaaacagtgcccagagaagtaacagaatccagactatgtgagcactgaggcaaggggaatagagtcaagaagaaaggagggggcggggtcagcagtgacaagtactgccaagaagtacaaggaggattaagagggtctttttgacttagtaacgaggaggtagttgttgagtcattgactgcttccagaacaatatcagtagaatggcacgctccagtaggttaaagagtgagggagagaggatagcagactgggggtgcggcggggaagaagagagtagttgagggggaggggagatgaaggcagtaggggagagagaaaggatggggagagagggaggttgagattactttcactcaatgggaaggaggcagtagagagagaaagctgaagacataagagagaaggggaaattgttagaatggggtgttccagaagagtcaggcggtgaaaggattggggaaaatatggagagaagccatgtctccaacgaaaaaccaagttccaatcaaggcatgaggtgaaatgagcattagctgagacagatgaggatgtatgatagtttaactagcaaatggaaattccatggtactcagtggaaaggttcaggaggaggaaagtagtaggaatttagattaaaggagaaaaagcacaaggcagtgtgaggaagaagacacgggagactggaaggccagaggggctccccagagtgcccaagcatggcagttttgtgaggagacaggtgtgtacagggagctgtagcttattttagatattggtaacttaattacagcagtctcatctttttacacaatgatgcattttatcacaacctaaaatttattctcaacaataatattctttttaaccaaaacatcattttctgaccaattcaaattattcttatgtgtttctgttgtttacttttatgttcaccaggttaaatcttcagttacgccgctgccattaagagatccctatgtagaaaaatctattcattatgaacacatttattgcttcattgaattgcctatttaaaatgcagagaaccacaaattaaatgtagtgcttttccattttgaaaaaaagcagatgaatgggtactattttcttgaatacatcatgtttgtcttacataattaacattccagattcataagccaacagatgccaatccttgcttattttgatatttgttcctcaatggtcattactgaaagagatgcctcctaagacttgaacatgctgtgttctgcatcagaggaaatgataaggcaaatgtaatggagattattgcttttgggggatagttaagtgatgtccaaaatctatttctctaaggttaattatgcaaagtacaaaacaatttcttcattgcaattgtaaaataaaatatctcaagtatcttcagtataagcctagtctataaaatacttctagattccaagtttatagccctctactaaatatttattgtatttaagacatgggtgtttgttctagaaacatgctttaatgtcatattgcagtttttctagatttctcatattgagaaacttgaatatacttgtgttgaatatgtgtaagcgtagactacagtatagtacaagggcacttttaagtggcaaatctatggggaatgcctagtggatctcatctggaggtcagacttcattttgttgccttttgactcaaccaggccatttgagctgtgatagggtttgggtctgcccaaatctcatctcatatccagttgtaatccccagtgttggagatggggcctggtgcgaggtgatggttcatgggggcggtttctaatggtttagcaccatccccccttggtactatatagcgaatgagttctcacaagatctggttgttacagagtatgaagcacctccccccttcctctctcttccccctgctccagccatgtgaagttctggctccccctttgcattccaccatgattgtaagtttcctgaggcctccctagaagcagaagccaccatgcttcttgtataggctgtggaactgtaagccaattaaacctattttctttataaatcacccagtctcaggtatttctttatagcagtgtgagaattgactaatacaagctgcctgccaaaccacctcacttgtttccctcttgtttttattcttcccatcatgaccccaaagagacctcatgttccatttcttaacacatataatggatcctcctgtaagtatctgggctgtggcagactaacagagagacctccaacctcaacaccagctaatgccccaggctcacagtctgaccactctgttagaaaaagaagcccctctctctggttgtcccatccccattctactttgctctttatttgttctcactcagcctccacctttttcctctctcaaacttgtgaaagatgttcctggaatcctatttttatagtaaatacacccacctccttaactggatggtagaacattgtacctgccttcttgccttaactgaaatttgactcttccctgagagcttttcccaggtgagagaatcctgctccagaagcacagtgctgttcggagtccattgtttcccactctgttgtagaccctactcttctgatcatcctgctatctgactgatttgtcctctgtccataatactgtcatccactaacctcatagtcacctatgtcacatatagcctcccccaaaactcaaagccctgccatcatcaaaactactcagtcctttagattttcatttctttcacatcatcaattctagtgaatttatctgtgttactttagccgcctgcttccttagctataccctggatcattaccaggaaacacatctttgctaaaatatcacattgaaataactcttttttatgagtcaggatctctgatataatgttgggtagtagaaattatagtggacatccttatgtgcttttagcctttttaaggaaatacttctaaagtctcaccatttagtatgatgttgctgtagggttttggtggaagcaaaatgcgtttgtattcccaatctgctcaatttttccattataaatatctgttgggtttctttgaatatttttctacatatgtgaaatgctgttattgtttttctcccttaatctgatatttgcagcattaaatattttctctccttctgaaatttcttttagtttaatgttagcactttcccttgtgtcttctgtgtttttttgactttcctttcagggtttttttggtttttttttttcctttttatctctctgtagtgcatattgggagatttccacagttatacattccagttcatcaaatctcttttcagctctgtcaatcctgctaattatataatttttcattctaagactttcagttggttccttttcatttctacctctttttatttcacaactttctgattttacaatcttgctagtaatctctattatgactgaggatttttaagtctttattcagagtgttctgtagtacatatttcctcggatatgaatctcctcattcattgaactgcttttaatcatggtgcatatccttttgtaattttctttaattaagagcttaacttccctacagatttgccctataaaggttctctttgggaattgtctcaaccccaggcctatgaattcctcagctctgaaacaattcataagttaggcatagcttgggaatcctactgcagggaagtgatttctatgcccatgtgaaatgcagactcagaagctagttatatataggtgtcttatcttcatctctaatcataggtaatttggggccttgaccctcactgaaaaaaaagaaactgatatcacccccacagctccccgccccacccctagatttatgtggagtcatgctcaggattcatattcttttccctttgcagatgtagaaacctcagaccccatgtcttttcagcacctgcccctacctccaatctcacaatggccatagtcttacacgtcactaccagcatgggtttattatcgttttttattcacagagacttttctttcttgtttttaaaaatggttctatcagtcagggccccagcagaaaacaatgttattcagatacctaaattcaagagatttgaatgaagggactatttacagatataaggccaggaataaagcatacaacaaggtcatttgaggtgcccagagactaagaacagcaggctctaaagggcaagggaggaaatgttattacaggagcccaagagagctggagctattgagaagggctgcctggtagaagctgtatctggaggaaagtagccattaccagaaggaagcagggaggctacaggaaagaaatatcccatcctctcttctcccacactccagtttcttggtggaacttctgttggccaaacctaactggaagggagcccaggtaatgtgacccagaagggcacagggcaaggcagaaaattgattggatggatatgcaaatagagaataaatagtataaggcttatgtggtttaaataaatagtgtatctgttatttctgtatgttgcagaggcctaaggattttcagcaagtgtttactctgccatattgaccagaagtctaaaaacccctcctctggcctcttagcagctgactccatcattcaggcacacccctcacctgtgcagattctcaggcaagtgtatcgctctgtcgcccaggctggagtacagtcgcacagtcttggctcactgcagcctccacttcctcctgggttcaagcaattctcctgcctcagcctcccaagtagatgggattatagacgtgcgccatcacagccgcctaattttttaatttttagtagagacgaggttttaccatgttggccaggctggtctcgagctcctagcctcaagtgatctgcccacctcagcctcccaaagtgctgggattacaggtgtaagccactgtgcccagccatgtctatatatttaaacattataaatcaaggtaaactattaaataaaatctgttttatctttctaccctgacagatgtacattaataatgagctagaagggagaggttttatttgggattcatcaatttcctggaggttcatgtggaacatctatggcacaggggagtactgacgtctggtccctagccctgctccccatggtgaagagccttacacactgtgtggacacaccgcccccaacatccatgcttaatccacatccccttcaaacaaccactctgggcagaccctcaggaagaggcctgcaaaggtactaaaagcagcctcagggctgtgtaggaaggaaattctagggtcccaggtacctggaatgtggtctaaaaggtaatgggtatgagctttggatggacatatctcctggtccaatagagtccttgctccatggaaggactctagagcaaaagatgagactgagcctagtcctctaaaatgcagggcccagggtagggtcgcctctgtcctgagtcttatgctgggccccattacacttgattttcatcaagacctgtagtcccttgaccatctgtgttttctcagactgtaaacctcttgtggtactcccttctttccctgtctagcctggagcctatggcccctcatactcctagcaatgccgtcaacttcctagcacccttgtttatccgtcactcctgcctagcaaaatcttagccctgggccaacctgactctccatcttcttgctttacgcttaggttgttgagtgtctgcaataaaaatatacaggttgggccaggtgcagtggctcacgcctgtaatcccaacactttgggaggccgaggcaggtagatcatctgaggtcaggagtttgagaccagcctggccaacatggtgaaaccctgtctctactgaaaatacaaaaattagctgggcgtggtggtggacacctgtaatcccaactactcaggaggctgaggtgggagaattgttcgaacccgggaggcggaggttgcagtgaaccgagatcactccactgcactccagcctgggcaacagagtgagacaacgtctcaaacacacacacacacacacacacacacacacacacacacacacacacacacacacacacgttgagcatccctaatctgaaatccaaaatgctccaaaatctgaaactttatgagagctgatctgacgccacaagtggaaaattccacacctgacctcatgtgactggttgcagtcaaaactttgtttcataaaccaaaattgttgaaaatattatataaaattaccttcaggctatacatatgtttataaagtatcagtgaattttgtctttacatttgagtgccatcccaagatatctcattacgtatatgcagatattccaaaatctgaaaaaaatcagaaatctgaaactcttctggttccaggcatttcagataagggacctcagcctgtatcagcagtgtaaacatgctgggcctctgcctccgggcatcctgctgtgttctctcaggcagctctttctggtttccacagaagcactttcaaacctttgccacttttctcaggctcctgccccattttccctgtcactctcagcaaatggccttgcctcctatatctccaagaaaatagaagtcatcaaagcataatgtcttttactttctgcttccctctgcagttactatacactgttggtaaggatgagggtgatgggggatgatggctaactttcttcagcactaaccactgcccgcttcattctggtcacaatggcaggggtactatttctcctatctcccagccccagacaaatccttccaccatagctttggattctgcccttttctacttcctctggtcctaactgcatcaattatcttctctgtctgaagctctgcattaagctgcagtcacttctctacttctcatatccaaatctctttcagtccactgtgattttatttctgccccagtaactctgctgaaactgccttgaacctctttgttgctatccgtgggtacttcagtccttgcagtattgggcactcttgagcctaccttctaagcatgctctttgccctgagatccatgcaccttcctactttcccgaacagctttccaagtctccttcccacaaatgtcttccgcagagttctgccggaggcggcttcccttctaattccttgcactcccagtgccttgcctggagaaggggctcagtcagtatcaaattacatatgcagatccaattgccggttgcaagtagactcacaaatctttagaagtttaaacaaaaaggttttttttttttttttttttttttttttgagacggagtctcactctgttgcccaggctggagtgcagtggtgcgatctcggctcgctgcaacctccgcctcctgggttcaagcgattcacctgcctcagcctcctgagtagctgggattacaggcacgcgccaccatgctcggctaattttttgtatttttagtagagacggagtttcaccacgtcggccaggatggtttctatctcctgaccttgtggtctctatctcctgacctcgtgataggcccgcctcagcctcccaaagtgctgggattacaggtgtgagccaccacacacggccacaaacttttctttaagggatacacatttccaattataaatgatgtattacttattgcaactggagtccactgaggggaaaaaaccataatagcttatttcagaactaatatggctatatgttagcaacagaagtggtgtagctattttattagaaatacaataaagagattacttagcagctgtctccccacaccatcatttcattttgctctgtagttcttggcagagagtctagagagaaagaaaataaatttaagccacacagtgttctcctagactaaatgatttctgcagttctgagaaagaaaccttaaaaagacaatggatgttccatgattattgaaaagaacattttcaaaattttttccctggataaatttgattaaacattatagccttttccctttcatatcttgtagtaaagcttctcttacttagttccatgttccatactcagaacttgagtgccacacaccagcctaggggccatattagatcttgacactgaaagaattcagcgagaactatttaaggctctcttttcattgaaatgaagaaatgtcacatatagaacattcctttgtttattcattcatcattcatccgacaaataattatgtgaacagtcactccaagaaatcttagagtggatattatgtaatatatgaaaagatgcctgccaaaatatatgctgaatttatgactttattttggctttacctgccagcatttcttgtcctagccttcagactgtgttactcagaagtacctactttttgcacagtcacgagattccaaagatcatatcatttcattccatctgttcctgccacagttactttaataacaatattcatcatgtgacctttatgtgctactctctacttaaatagggaaaactcttgtcggtccagagaagaaagaattgccaaaattaaataaaaagtcaagattccattacctgatgatttgtgtatttcacgttgtttgcaacgtaagtaggaactttaaaaatgatatggtaacaattttaatttttattgttgtgtaagaaaatggatatggctcaaaggaggatagatgagacatgaaaatgttgtggggaaaattctgttaatgctcttgatcttctggcattacctatgccaccaagacagtataaggcagaatttcatacaaatggtccgtgacttttaggatggttcagcgttacagtggtgttgaagagataggcgttgagtagaaaccgtactttgagtacccacacagcctttctgtttttcattttcagtacagtattcaataaagtacatgagattctacactttattataaactaggctttgtgttaaatgattttgcccaactgtaggctaatgtaagtgttctaagcacatttaaataggctaggctaaactatgatgttcagtaggttcggtggattaaatgcattttcagcttacgatatttacaacttacaatggtaaatcaaggaacatctgtatagtgctgagcccagagtaagaattcagtgcttgcagggctggaagagtcactgcctacagaaacatacatgtgcgacataggcgtcatgcgaaatcatgaggagtggtagagcttatggcaaactggagagctcccaagttgcctaaagacatccacatttaaaaatttaaaaacactgtgctagccaagcaaaaacatggccagagatcctgtactgcccctagcttgagtttgctgttgttttgaaacggagtctcgctctgtcacccatgctggagtgctggagtgcagtggtgcagtctcggctcactgcaacctctgcctcccggattcaagtgattctcctacctcagcctcccaagtagctgaaattacaggtgccggccaccacgtctggctaatttttatatttttagtagagatggggtttcaccatgttggccaggctggtctcgaactcatgacctctaatgatcatcctaccttagcctcctaaagtgctgggattacaggtgtgagccaccacgcccagcccctagcttgggatttagatctctaagttatgcctgccccttgcctgccattcccctttctgcatgccttctttctctcttctactcttcaccaccacccgctccatatcttagaccacttgctgcctcagataaaagctgcaatcaaaaaatgctacttcatttcaaagaacaacctcggcaaaatgtgcttgtatttgagaaaatttgcttatatatgaagcaagcatcatttcaaacactttttaaaaggtttcaatcctttcaatctttgttaatttgtactaacttgtaatacatgctctttctttaaaacttctaacaatatagaaataaagtacgattttttccttccattcttcccttcaccattctcattctccaggtaaacactgctaaattatttggtgtctatagatccaaatttttctgagtatgtaaactaatatatacatgcacatacatacatagactatatagagatatctaattaaaatgctgtcgtaccattcagcaacttgcttttttatatagacaacatttcatattattgtagtgatatcacattctttgtaactcctgttctttcagcagtcatatcaatgtgccataatttcaccagtccctattagtgacattgaaattgtttttatcttttctgcgagtattctactctaaactctgtatctgaatgtgagatagacatctccatgttcaaaaccagattcctcatcttctccccaaaacctgcttttcccatggttttctgccatcttaattaatggtaactccatcctttgtgttgcttgtgccagaaacctggaagtcatcccaagttcctttctttttcttaccctccacatccaagctgtcaacaaatctcgactctgaccacctctcagcacctccactgtgtcacccagtgcaaacctccaccaccatctcagcctcttacccagctccaggattctgcctttgcccccatcaatctacttcaggtctcttctccacccaataaataagtccagcaatgatccttgtaaaatgtacatcaggaggggccttctcatctcacctatgataggtatggagttttttcttttttccatttcacctgtgatgtatgtttgtgacctccaatatgtaaccacttactatgttgcttttaaaatgatttttaaaggtttgtttacaaccatagccactatttgcaattatgagtgtatagcactaagcatgagaactagatctgtgaaattttttgccagtttcattaggtgacctctgtaagcatcaaaacctggcattgattgaggttgtttcaggctcaactagtactgttcaaaataaagtaactgaaagcaagtctggtggtagaaggtactttataagctaactaatgcttttcaaagggatatatattgaaggaaaggctcgttttatattacatcctataaggcagtgcttcttaaactctctgtggaaaagaaccactttttataaatttccagtctgttgcaaaccgatactttgtaaaaattaataaaagtgaattactagaaaaatgaaatttttgaaaaagacatataaaataaaagttgtaatttttagcaaacaggaagttatattgcaaaaattactggggtataggaaaaaagatacaaaaattgttcgtgtttgttcattgaaagtatgcgtgtaagcaattaataggctattgcacttgtaagttttcttcattttaagggaaaatggaattcccatattaaatgtctatttgtacactttgaacacaatgtggataaatatttaaagtttttaatgtgacaaatgggattgcttcctacttgatactttacctaatctaggtaaaattgccaataaggctacttgtagggaataaggtatatctaaataatttctacgctttattttaataatgatacaaaagaaaccagtctcacaatggaatggagggagagattttagagcaattttcagtgagctcagtttattcattttaaaattttatctaagatggagccagagccactatgctttcaaagtcttccaatccctcaacagacctgagtgccagcaatatatcctgtaaattataattaaatataattatcttttggtgaaataaatggatcctagatccatggattttttagacatagatcttcttttgatggaaaataaaattcaaaatgctttatcaaatttaaggtgtttggtgtttgctcttcattgatgtgcaatatcagaatcatcactatgtcatttaaaattgttacattttggaacatgtgtcatagcaatctgcagaaactgttcttccaagctttgaactttcatttttgccatttgattctacctgtcattgaaaaacatgttgcattaattccttgcatggaagtattaagatcattaaaactactgaggatatcagatgcataaacaatcctctttgtccaattcatatcttcaacaagttggggccaaattgtcttcttattttgcagaaacatttaagagttgttttgtagttcaaactttctcaaacacagcctattggtcatcatcgtaccccagcatgcagcaacagctggttatgatctgcttccatagtatcatgcaacacaagagaataatctaagatttaacgcactagcctttacctaattcataatttttagtacaacattaagcccactgtttagttccaccaacatttcttttcatagcaggacctcctcatgagagaaacaaaacatagatttacattctggtacaagctccttagtcaggataactcctccagaatatttcctgcaccgtcagaacataccctacacaaaatttaaactccaaaccacatttgttgacaatataatctttcatagttttatacagttcagacttagttatgtatgtcagcaacaaaattgaaaaaaagaactcttccttcatatcaccatcatgttccaattgcacataaacaggaatgtgagtgcaattatcatgctgcaatgaaaaatacgttgccagctttaactgctccatgggttagccttctggatcgttagccagtgcctggatatgctgagctatggtggcactgaaaagtagtgcttgagccaccttctttgctgcagattcacccaatatttccaagtaaatacctttgatacagtcttttcactaatatctccccaactgtatatggatcttaattttggcaagctgaactgcttcttattaagcccgtaaagccctaatgtttatatgtaaaatattgaacatctgcttcataagctatttaatccaatattctttctttcaaaaaattcttgtggtttttaactgaatttttgtaagtaaacaccccataagttctgatggtctcattgcttcatagccagtacatacaaaaaaccgaacactatgtttttagcatgtcaacatcgattacagctttaaactgaactcagcatgttagggatcatagttctggggaaaagcactatgaactctttgggtcttggtttcttcagaatcacttccatgtcatcatttggtttctacccctgtcatactcagaaaagtattttctcacgaaaaaaagtccagtgaagcttgtttcacctccataaattgagggtgaaaataacaaatattattgctctaatcagctaataatgttaaaccacaaagttaaaaattctgattaaaaattaaaacgtataaagtcagtcataaaaataaatgcttacattttcataggtttttatacacttttagggtacagttaacagaccagtcatatcaatacaataagtggttatatattaattagagatcacaaacatgcatctcaggttgaatgaaaaaacacacctattataatgttatgcaaacggctactaaatggctttaggcaaaaatttctactgtcagtactaagcatggaatcaaagtcctgtattccagataactcttccaggtgccctggaaaagagttttatgtctcaaaaagtggctctggtgatcatgaaaacgtttatatgaagatgcatgtcaagagtgaataaaaggccaggcatggtggctcacacctgtaatcccagcactttgggaggccgaggcaggcggatcacctgaggtcgggagttcgagaccagcctgaccgacatggagaaaccctgtctctactaaaaatacaaaattagcggggcatggtggcacatgcctgtaatcccagctacttcagaggatgaggcaggagaatcgcttgaacccgggaggcggagggtacaatgagccaagattgcaccattgcgctccagcctgggcgacaagagcaaaactccatctcaaaaaaaaaaaaaaaaaaaaaagagtgaataaaattgcttcatgaaacatggtcatggaaaaagcagtgcatgttggtccttcaactgtctctgggctccaaactcacccttctatactctgcatggtggggccagacctgcctgacaaaccacatctctcgtttcccagctgcttccctttaggtcctgtcctccggagatacagaggctaccgggcggccagagaagggagaggcgagtgttccttcctgtcctcttgcagttcctgtgaggctcactcctataacagttcctcactccagttgtctgcagttctagtttcgtgcgttttcctatggtgtcctccctcagagacagcagcttcagcctctagcaccctctccaggggtctgggttccagctccacaggaccttcctgcagcctcctaggttctaataacctcagtctcatccctttgtttcttcagccctgaggatggtagaggcttcatgtgttttaatggttactaccttttaattgcagaattcctcttttgccttttttgttcttcaatacctgtctaacctatttcttttatattaaattctctcttttaaaataaccactgtggtttctgattttctaaccgaatcccaactgatataataaatggtaccagaagtggtcccaggtggtctgggaatggtttgattgtgtctttggcccaaaatgcagtgctgagcagcttgtcaatgtgaaatggaatgttagtaatcgggtcatgccgtggcatcatgattaatcaaactatcccctgtggttgattgtgaagaagtgcctgaagctagtaacttaagggaccaagtggcggctgcacttagccattatagtagtaatgatgatgtcagaagtgtggaatgggaggctattctgcctttagtggcattcttatggaaaaaaaaaatgacaagctcaagtctttaaacactcagctcaagtcatatctggcaaatctcaaattatttcacttctttttatctccacctctaccatcctactataagtcatattttctcaactgaagttttgcgacagcttcctgctctccctttcttacagtccatttcttagagggtgaccaagataccataaagccaacacctctgcctaaaacctccaatgacatcctactgcattaaaaaaaaaaaaatctaacctcttcaacttcgtctcaaaccatttcctcccctctgtgttccagtctttctagctctctctggcctgggagttcccacatttatagttccttcttcttagaattcatttcccttggcatgtatgactgttacccatccttcatatttcatattccctaggtccccaaccctccctatttaaagcaaaccttcaaccctttcctctagtaaatatgttatcatcatgcattcatttcttacatagcacttgccactatatatatatatgatacatttcataattataacagggtcaattaatcaagaagacataataattctaaatgtatacatacataataacagagcttacatatatatgtatatgagagagagaaagagagatcttatttgtttgtctcccccaccaccctgctctccattagggcagaaacctgtcagtcttattggctactatattcccaggaccctgctccaatacctatggcatagtagatgatcaatgattatttgttgattgaatgatcctgggaagtaattttctttcaattaacttactattttagttataaaacattgcaagcatacagaaaatattataacaagcatccagatagctgccagcaaaatttaacacattttgacatatggccatacttgcttcacatctcacacttgcactcgctctctttctctctttctctttttttttcgagaaataaaatgtaaaagaatattttcatctaaattaaaaattattagcacaaattacatatactatttccttatgatatttttaatgactctaggctctaactttcagttgtgatataggtgatttgtgggttttcttctcccctcccccatcagtctagctcagggctatcaactttattaatttttttaaagaggcatcttttagtttcgtttattttctctatgattttttcattttccagttaattgacttttgccattgttacttgttatttcttatagttattttagttgacttgctctttttctgtcttcttaaggtggatgttttgatcattgattttagtcttttcaaatgtaggcatttaaaactacatatttccatctaaggactgctttaactgcataccacaattctgatatgttggattttcactgtcatttaattccaaatactttctaatttttcttgaattttcttttttgacccatgggttattatgaaatgtactgtttaatttccaaatatttgaaagttctcccaattttttggttattgatctctaatttcattccgttattcaatttcaatcttttcaaatgtgttgcaactttttttttttttttttttttggtcccagcatctatcttggtaaatgttccatgagcacttgaacggaatgaatatcctgtaggtgtcaggagtggggctctataaatgtcagctaggtcaagttggttgatggtgttggtcatattatttttactgatttcctgtctctgtgttctctcatttactgagagagaaatgttaaaaataaccggctatgataatggatttgtctgtttctccttttagttctctcgatgttttgcttcatgtatttttaagctctgttattaggtacgtatacgtttagaattattatgtcttcttgattaatcgaccctgctataattatgaaatgtctcttattatctccaccagtattttttgttcagcagtaatattgatgtggctattctttctttgctgtgattatcattttttattcttttactattaacgtatctgtgtctttatatttaaagtgaatttcctaaggacagcatacagttgagtctgctttttcatcttttctggcaatcctgatttttaattaatatttagcatatttacatttaatgtaattatttatatcattgggtctaagtctacatcttcacatttcctatttctctcatttgtcatttgttttcctctatcccccttttctacctttatttccagtacttttctttcccttttgtagatccagttttccatttcgtattattttccataagcctaaggaacttccttaaatttaatgtctgctggccacaaatttttatcagtttctgtttgtctgaaaatgtttctattttacttttgttttgaaatatatatatttccacactttaacattgtaattctaactggttcccatggtgtctgatgagaagtcagtggtagtttttatatatttttttctctgaacaagtatgtctttttctctgcttttaagatactgtctttattgccagttttcagcaatttgattatggtgttgttttttatagtgttcttcattatcttacttagagttcattgagcttcttggatctgtagaattttagttttcatcaaatttgcacaatgtttggccatcattcttttgaatgtttttttcttcttcctcaaccttctggtactccaattatgcatatgttagaccacgtgatattgccccacaagtcactgatgctcttttcattcctctgttcgtttctttttctctcagatttagtttggagaatttctatttctgtgtctttacattcacagaagttttcttctgcaatatttaatgtgacattgatcccagtccatgaattattaacttcagatattatgtttttcatctctagaagttccactgggtttttaaaaatactttccatttctgtctttactatatccatgccttcctttaaatactagagcatacttataattaaaagttcttgtcaactaattctattggctttgttgtttctgattctgtttccattgtctgatttttctcctgcttattggtcacattttccagcttcttagcatgtatagtaatgttttgattggattctgagtattattatattagttttctattgctgcatgacaaactgccacaatcttaacagctgaaaacaacacccattttcatttcacttatgaaggtccgcagcatggtggactcattgtttttgcttagggtctcaggaggtcaaaatcaaggtgttggttgggatgggctcttacctggaagttcatgggaagaatctactttcaagctcactcaggttgttaatagaatccagttccttgtggctgtaggtttgaggtactcattttcttacaggctgttggccagggtctactctctggccctggtggatgcccatattccttttcatgtgatcctctgcatcttcaagcaacaatggtatgtcatattcttcttgggctttgagtctcttcgacctcctcttttactacacactggagaaagttctgtgctcacaggtttagattagtcccacctgggtaatataacaatcacaggagttatagctcatcactttcatatgttcaggatgtgtaatcttgggggttattcctaggaattctgcctatcacaattacaaccattatgatggccaagtagcaggattttgatgtcttcttttaaagagtattgcgatgtattctggcaggttctaagtttacttgcaaatcagcttgatattttcaggctggtttataagctttgttaggatagttctagaatagcttttactccgtgactgatttagccctatttctgaggtatggcctttgtggtgtctattgaataatgtaggtattcagtgaggtctccactctcagtagtcagaacctcagcatgcacaagccctctgtgaagtcctgtggccatccagctgatctgtacctgtaagttcttttcccatgggtttggattctcacactctgtgtgtccatacaatatttgaccagactcaaatgacaccgaggccaatttctggagctttttttctgcacagctccttctcttgtactctgccctacaaattctagactctcagcctctcccaaccagtggagtgccaagggtggggtgggaggaccaatccaacctaggtgctgaaaatttaggagtatttgtctgaagagaattttaaaacagtgactcaaagtctatcttcttttatcaccatgtttctaaatacctactcctgccaggggaagaaaacaagcacgcttatacgcctacattctaagtaattgctgaagttactctgagttttaataatacatatataaactttaaattgtacacttttatttcttagttttaattagcagccacacttgctcattttgagaatacatttataacagttcagaatcatttgaactggctttaggtgcagttagtgttttcatctctggtcgcaccagaagctccagtgttttaacaatagattcggtgtaaacaatgataacacagtggttgtaaacataaaaaaaacctcgagttattaaattttatctatatgactacttcagagttttaatttgtgtttaaaatggaaaatagtgagaaagtgggaaatgtcatgtgtaatgtttatgtttgttatgtgtaaattgtagtttacacctggatgattttactaaatttgaatgatattttgtaaagtgatatttattctcctttttggattgttcatgtgtgttttaaaaccagagactaaatcaagaaagtcatgattattgctcattattacatgagtgttgctgaaaatagttttgtcacatagaggaggaggtgtttaaaaagggtgtgctcctggtgtgaaataggttaggttctctgttttcaagtttccctctcccgcacctccatccaaacggtgcctctaggcagaaagctaggaccatcccagggctcacttcatttgtttttcttttcagggaccacaggccttactctctgttgtccaatctctgaaagtgatttttaaaaatatatttttcattctttatggcagaagggctagtgtggtaccctccacactgggttttattatttgtttatattcctatttcctagatttgcctgagttttataagcataggagccatatggtattacagctctccagagaaacagacacaataggatttatatacataaggggagaaagactggttttaaggaactggcttgcaggattgtgggggctggcaagtccagagttcatagggaaggctgccggctggagactcaagtaagagttgttaccgcagtcttgaggcagaattgcctcttctttgggagatctcagtctttgcccttaagaccttcagctaattgaatgagtccacttacattatggagcgcaatctgctttactcaaagtctactgattgaaatgttaatcactgcccagcacagtggttcacaggtgtaatcccagcactttgggaggccaaggcaggaggattgctcaagcccaggagttggagaccatcctgggcaagatagtgagacccccatctctacaaaaaataaaaaattagccaggcatttgatcccaggagttcaaggtggcagtgagctgagatcaggccactgccttccagcctgtgtgacaaagagaaaccatacacatataaatatatatgttattatgtataaaacatataacatattttatatatataatatctaaaaatctaaaaattaccttcatagcaatgtctagactggtatttgatcaaacaactgggcatcatagcctagccaaggtaacacataaaattaaccatcatacatctattactcatttttatacccctaaaactttgagtactgcataggaattaaggaatagcaaataagaggctgcagtttgggaataaggaaataatgtttaaataaggctgcaagtagaggttactgtagctcctgagagactttgtgaaggagttaactgtattatgtgggccgagtgggagtcttctaacgttttgatgagggaaatatgtgatgtcgcctgtctagatggcagtgtagggactgaaatctagtgtgcagcactgagatggtagctaggggaggaatgagaaggacctgagtgagacagtgtccagggaaaggccaacggtgagagtggtgggggcggtggaatggagaagagtggaaggagagaggaaaaaggcaaatgatgaatattttgctggggaattcagcatttaaatttccttaagtttctttgtctctttggtggcaggacttcccaactcctttggagagagctttagaaagatgttattaaacctctaaaaaacaagcatgctattctttgtgaataaagaaaaaaaatcgacagctctgcacttaaacacctgtaatccctttctttactatgacaactgttaggtttttctatagcctcttccagtctttagccttatgtaatcctaggcttttgtatagctgtaataatattgtatatgtggttttgtgtcctactatgaggaagtttatgtctatgtggtctttatatgtattatgtttaataacagaaaagctttatggtaaattgatgagccatagtttactgagtcatattcctattgttggattgggatttcctaacagatttttaccattgtaaaagataatggtataaatgattttttatctaaattattttttacatttttattgtgatataactgatgtgtaataaactacatatatttaataatttaacatacttgaataatttttggtatgtatacacatgaaatatcactacagtcaaatattgaagatagccatcaccattaaaagtttctttggggctgggcacagtagctcatgcctgtcatttcagcactttgggagatcaaggcaggaggattgcttgaggccaggacttcaagaccagcctgggcaacacagcaagaccccatctctaaagaaatgggttttttttataattagctggacatggtggcatgtccctgtagtcccctgtagtcccagctactctggaggctgaccagggaggatcacttgaacccaggagttttaggctgtagtgagctgtgaccatgcaactgcactccagcctaggtgacaaagtgagaccttgcctggaggaagaaaaaaaagatagaaagtttctttgtatccctttgcagttgctcccaccctcctaccccttcccacctccctgttcccccttccctcttctcagataaccactgaacagctttctgacactgcacattagttttcattttctacaatattatataaatggaatcatataatatgtacttgttttggtctggcttctttgaccctgtgtaattattttgagatttatccatgggataccatgtatcaacagttcattccttttccattgctgagtacattgtaacaatgtaccatgttgatgggcgttgggtttgtttccagtttgggggcattaaacaaataaagcagctgtgaacattggtgtgcaagtctgaatggatatgtgctttcttttcccttggatacgtagctaggggtggaatggctggaccgtgtggtagatgtattatatgtctagtttttttacaaaactgcctaatttttccgaagtggctgtacctgttttcatttctaccagcagtgaatgagaattccaggtgctctgcatcctcactaacactcgatctttgtaaatttagccatttttataggcatgtagtggtatctctcactgttgtttcagtcagtatttttgtaatgactaatgacgttgaatatcttttcatgtgcgtattttccatcatatcttctttagtgaagtatctgttcaaatctctcacctattttttacgtggtatttgctttattattgagttttgagagttctttatgtattgctttatcaggtatgtactttgcaaagatttttcttctaggctgtagcttgtctgttcattgccttacctgtgtttgttgaagagcagaaatttttaaaatatattttctttggatacattttcagaaataagattaatgggtcaaaaacctaatcttttcttctttccttcttccctcccttcctccctccttccttcccttcttctccctacgtcctctttccctcttgcttctttcttttgtagttctacttacttgttgtctgtcttccaaagaatttgaaacactatcactgaatcatagtatgttgttccctggaggcttgccaactctggtctttctcacttgtctttacttgctattttggtgagtgtaaagtgcgacattacagttatatttcacttcacttacctggcaagttgaacatttacttaaatttggtatttaaaatatttttccttctgtaacttttaaccatttgtcattggtaattttgaattattgttatagagttataagagcttttcatgtattgtagatgtcaacatttacatataatatttatcacaatttcatatccatatttaccttttatcttggtttactccctaccccaactgcaattttttatttttatttatttatttatttatttattttgagacagagtctcactctgtcacccaggctggagtacggtggcgtgatcttggctcactgcaacctctgcctcccaggttcaagtgattctcctgccacagcatcctgagtagctgggactccaggcaccttccacaacacccggctgatttttgtatttttagtagagacggggtttcgccatgttggccaggctggtctcgaattcctgacctcaagtgacccacctgcctcagcctcccaaagtgctgggattacaagcgtgagccaccgcgcctggccttgcaactgcattttacttgtaattttctcgtgtgttttaaatagtgaatctaaatacctacctgggataaatatattattattttcgtctacctttgggaaattgtatgttaaatttttctttacaatgtatttattctgttttatggtataaagtaagcatctaagtttatatttataatttttttttaagaaggagtctcagctctatcacccaggctagaatgcagtggtacgatcatagctcactgttatccagaactcctgggctcaagtgatcctcctatctcagccttctgaatagctaggactacaggtacatgcctagctaatttttttattttttattttttgtagagacagggtctcactgtgttgcccagtttttggctggtctcgaactcctgacctcaagtggttctccccccttggcctcccaaagcactggggttacaggtgttagtcagtgctcctatttcttttaatgtgggttgctttttgatacattctgatctctcttaagttgccccttattgtcccagttaatgtctgatatgaacttcagaatttttacataataaaatatcctattattattttatttagaaatgtattaaatctacaaattaccttgaagtattgcctattttcattttttcttttataaaatatttatacttttattattggactgatatattctaccttggtttaattaccaagtaggtactcaataaatgtgtattaaatacagatatattttttccttgttataagagaaatctaattttgaaacaaaaagtttgatagttgttgttgaaaagcaatgttattatttttagagcatgttttatatgataattatccttgcattattttacttctaaaattcttagtagagccctttgagttttctgggttacataatcgcagctgtagcaattaatgatgtttctttcctattaatttttcttttttgtttttcttgccttttcaccgtggcaagaccctcttctagtttactaaataaaatgtaaaataaagagtatctctgttttgagtttgctttaggaaacatgccactaatatctgtatctccactaagggttttgctttgtttagttttcagaagttaaagattaggaatgtatgctttattttataaaattcccttttaagccttttaacatacaagtaatggtgagggccagcaaagtgtgctaggagtgaattaactgtattatgagaagaacatatttcttttatggttactttgcatgttagttcacaaatttttaatcttttgctctaatgtttcaaagactttctttttaaggaaatgttggtactttgtcatgttcctaaaggaaaaagtcaaattatccttgtttgctgacaacatatttagaaaaacctacagactccaccaaaaaactattagaactgataaatgaattaagtaaagttatatgatacaaaatcaacttacagaaatcagtaccatttatatatgccaacagtgaacaaactgaaaggaaatcaaggaagcaactccatttataatagctaccaaaaaaaatataaaatacctaggaagaaatgtaaccaaagaaataaaaaatctctataaggaaaactataaaacactgataagcgaaattgaagaggacacacaaaaaatagataccccatgctcatggattggaaggattaatattgtgaaaatgtcagtaccacccaaagctatctacagattcaatgtaatgcctaccacaataccaatgacattattcacaaaaataggaaaaaatgctaaaattcttttcttcttaatttttatttttccagttgaacccgagaaatgagtcaaaaccctaatctttaggatgttccagaagtactcactttcttccatcagtttatttcctcaccattgcccaaaactcaaatttacagcaatctatatagtactaattagaaaggatttcggccgggcgcgatgactcacgcctgtaatcccagcactttgggaggccgaggcgggtggattatgaggtcaggagttcgagaccatcctggccaacatggtgaaaccccgtctctactgaaaatacaaaaattagccagcgtggtggcgcgcgcctgtaatcccagctactcaagaggctgaggcaggaaaattgcttgaacctgggaggcggaggttgcagtgagccgagatcacaccactgcactccagcctgggcgacagaacaagattccgtcttggaaaaaaaaaaaggatttcataatgaaattcctttaattatgataccagtgctcctattaaaatcaggttttgtgaaagacttttttcttaagcccaacccagcctccgtggggggaaatcctaactaagaacttaaacaaatttttcacatgtacacttatgacaacatttttgaaacactaatattttgaaaagtttttgtgccttcttttcccacccccaaattgtggggacgttctcttgggctattctgcagggctctggggaggatgttcattgtgatgtcataattgccgcatattccagggacagatcttcacgtcttattcagcccctaattctgcgtgactgtgaaaagtttaagctaactgcacaccaaagtcatcctaatcctacagtttatcccatattcccacataagctggaaatgatcaagcagttgaaatggggagtcccaatgtcttgttcttggtactgcttgcagtgtgtacacagctttgagttggcagtgtattacaaattggcgttcctttctttgtccaatgggaccagcctgggtttttggcaaagaccctcaaaatctccgaaagcccagagttattagctgggcataggactgtgccatgaatccagagacctgctctgctatgctaggtaggaaagcagcttcgtgcatctgagcctccattttcccatctgtaaaatgaaagagtggggctgggtgatttttttttttttgaaagggagtttcgctcttgttgcccaggctggagtgcaatggcgtgatctcagctcaccacaacctccacctcccaggttcaagcgattctcctgcctcagcctcccgagtagctgggattacaggcatgcaccaccacgccaggctaattttgtatttttagtagagacggcatttctccatgttggtcaggctgctctcgaactcccaacctcaggtgatctgcccgcctcgccctcccaaagtgctgggattacaggcatgagccactgctcccggcctgctgggtgatttttaaagtcccttgaaggaaaaatgactacgtgtcgttgttctggggagaggcttggactctggaagcatggtgggcaggtcagtagagccctttgtcccagcggaccagaccgtgtgttgctggcaggcggcaggtctgaagccctcaccacagatcccttcagcgagggacagaaaagcaaagggggaagaaaagaagacatgaaaagttctcacttcaggacatttgttctgtacagtgctctagaggttgtagcgctgaacaccaagttcagagttattttatacctgtggttcgattcaaagtggaaaaaaaaaaaaaggttagttttttttttctccccccagggagctattttcagtaaaacttccatatggggatatatttattactaaagagtgtcaaacgagtcaaatagtcagaccatgtagtcactgaaagagagcagcagccgaggaatgcgcgcagacaccgggcaccctggaactgcattccttctccgcagaagtcaagcacggttgtttctctaaaagttctgcccgtaacatcttttctttcattcctttcttataaactcacattatgtaaactctcgaagtgtgaaatggttttccttggttggccatcactcacaaaatgattttatcaaacatgaattttccctcagctatcagctgcacgcaatgggaaactcacaaaatagagaagtggttgtgtgctgagcacataggcattttatagcgggtggagggtagaaggtggggcagggggtgggaggtggacggttgggaggagatctggctgaagtaacaaatgctcctcatagaatatgttggaaatagagaaaggtctgaagaaagaaaaacaaaacaaaacaaaacaaaaaaacaaaccaaacaaccatattcataccaaaccaaagataattatcattaatattttggtattgattcttccctgtttctctctgtttttgttaagatgagtgtgagttttatataccatgcttttcaatcattttgccattttcctttataaataaccctacaataaacaaatttgtcttcacttttatcttcttaggagctgttcctagatatcaaggtatcgtatcagagagtatgaagttattttatcatttttacagctcctggttcttcttacccaattgcctaataaacaaattctgctcccctcactgtatatgcccttctcgtcctgttctcaccaatgaccgagtattatttttcaaatgtttacgaatctaataggtggaaagagtatcttatttttttatttctccaattgctaataactttgaacatttttacatgtttattagccttttctgttctcttttctgtgaattatctattcataccatttgcccattttctcttctatagtgaaaacatttacttgtttctatttttattacaactgtttttccagcttattgttttcttttattataatttttgatgtgcaaagattttaagttttcatgtattcaaatctctgatcttttccttcacaatttcttcaattgcttttgtactaagaaaattttccttgcttccatattcttggttggtttgaattttaggacaatctaacatgttaacgaatttggaacttattttggtatatagcatggggtgatgatctaagcatttttgtttctaaatagccagtttttccatgatcctttgttaagtaatccccatttatatataatgcctttatcactttgtgctgtactgattccttttacatacaaggtgacctttccaggacatttatcctattcccttggtcagcttattcttactccagggacacacctttccgcccctagttctgacaatatgttctaaaacctggtgtttcttgttgtcaaatttgttctcagctcttcttgcctgtttattttccagatgaatggtaaaatcatttttgtgaagttccaagaactccctttggggttttgatgaaaattgcattcagcctataaattaattgggaaggatctggcatctttacaatgttcagtcttcccatccaggaatacacacgtggcttgtccctgcacattttcaaatatccttttatatgtctcgaaggaattctgtagttttctttatataaattcaacacatttcttattaaggtatttctagttatttcatattttgggtactttttaaaaatggaatcttttccccctttagtttagatcactatttttaatatcactttttccccacggattgccaaattctgacagaaatctaagtgaaaagcatatttgttcctttccaggcttataagctcagagatttagaactggaaccaaccttaaatctattttctttttatatatgataacactgaagtcacgaaaggtaaaataaagatcatattactcattaagagagtggctgtagatgaataatacttccaatgtccatgttctttgtgtcaaagacttgtaaaacttaaatatccgaaactaaattcatgatcatctcctttgtattagattcctattgccacaataacaagttgccaccgacttggtggctttaaacaacacaaatttatcatcttacatttctggaggccaaaatccaaaatggccatcattgggctaaaatccaggtgtcagcagggccacattcctgctggaggctcaaggggagaagccatgtctactgtttccagcttccagaggcccctgccttccttggttcatggctttttctccatcaacaaagctggcagtttagcgtcttcacatctctctggctcctctgattcttgtacgccctctcctgcttttaaagtcccctaagattacattggccccaccttgataacctaggataatctccccatgttagagtcagcaaccttaattctgtctgcaaccctaattttccttccccacataatacaacatattcacaggtgctggggatagcacatggatacctttggggcggggtgttattaagcaaagataaacttccaaaatttatatcaagcacatcggcccccttcttgaagcactttgatgacttcccatcgctctttgcatcacgaccaaggtccttacatagacttccaggacctgaatagttccagcccatgcatcccagagcctcatttggctccatgctcatcctcactctgtgcctggttacatttgccttctttcagttccttgaatgtaccttgctctgtcctgccacaaggaccttgcacatgctgttccctctgcttggagaactcttccccacctgcacctctcttattagctccatgcttctcagatttcagccaggtcctgcttccctgacctgctgcccagttctcgcccctatgtcccaccctctcctagaaccttctgtcactccttcagggcacttagtacactggtaatattattttgcttgtattaatagaattatttaattttgcttatagaattctctcccaggattggataaaagctcaaagggactcttgtcttttctgctcacccatttatcttcagaacctactgtgcgtggaccatagtgggctcttagtgtttgcctggtgaatgagtaactggactcaggaatccatttctttttttttttttttttgagacggagtctcactttgtcacccaggctggagtgcagtggcgcaatctcagctcactgcaacctttgcctgtcgagttcaagtgattctcctgcctcagcctcctaagtagctgggattacaggtgcccgccaccatacctggctaatttttgtatttttagtagagatggggttttaccatgttggccaggctggtctcaaactcctgacctcaggtgatccacccacctctgcatagttactcaatgtgttcagtgatacatttataaaagtgaaaagactggattggctccaaagtccaacaaaaaataatttattataagtccatttgataaaattgcatatggccattaaaaatgaaaattataaagactataacaatggggagaaacatctgttttacatttaaatagcaggatccaaatgttcttatgctgacggaaggaaaagtgccaacattttcacagcaattggtgtaagatcatagggtggtgagttctttctcccgtctccaaactctcccactcacatgctcgtatgttcagccgatacttattgaacaccactgtgtgccagacactgtgccaaatactgggaacagcacagtgaacacgatataggtggcctctgcccactgcaagttcataggcaggtgaggaggaacactaatcacagtcatattgatggtccagcattcatgggctgcagctgtattcaagaaaacatgggttccttcaccatagtgtgtaccataggctacagaaaatacttctaaaatccgggtcatcattattagggtcctaaaattttaaattgtggggggaaattgtagggttaatatacctgtttcctttagtctttaggccttgaaggagattttctaaattgtctctgcagtctttaatcactgtttatcctcttttaaagaggtggtcattgggacgccattgacggggggagggaggtagaaccctttccctgcccaattcattctctttctcagacatttggaggttccccggcccccacttctaagaactaaaaatgccgagttgtctccaacataaattcacttagttttgtcttcttacacttctgcacttggtgactgtgcgtctgtgcttgagcataatgtaaatacttaatttgtttaataaatatcctgaaatagcctctttgagttgttactagaagggcacgaaccttttaagtcacttagccagcacagatcaacacttaatgtctttaatgatgagcgtgatcttttttagtggctgaaatgctccgtaatcaatgatgtggccctgcctggaggcaggagaaactagataatgggcagaaaatgtcttgctggattgggccagtaatttgaatccctgaaattggtattagtgtggcaatttatgggagagcagtttcttcccaagggtagggagagctccccaacatcctaatgtcccttagtgatttacgcattattgaaatccctcgtggccagtgtctgttcctggcctgaaacctctgaggactctttgcctccccaactcactaaggcaaatggcacaccagtttcagcacaacggtcacctgtcttgggagtaatgcttagtgctgggcagagggagagaggtggacagggtcggggaatgaggatgtcatatgcaatttgtaagacctccctcacggtatgttcctttttcttctcccatctccataccaactttgagaattaatgcagggatagaaaacaaattctaactgttagctgaagaagcacttccaggtttgagtcctcaaatgtcccctctgaactttcacttggagtccctgagttttaatcctaggatttgattgatttgcccatattcacactcctcatgcatttcataattttctaaatgcttgtatatggccctctgaacctttatctctttagactgaaattctcttgttaaaagcccttttggtcattccatttggtgtgacttttttattgtgagtggactccattaatagagtgtttttgataatttgagggaattgtttcattatcaaatgttattcattttttatgtcatgtattattgtccacagacccagaggttttaaatgctaggagcatgttgtaaatgaaaacataaataatttattatagtcatgctgaactaaggccaaatttcctagtggctcagtgatgcacatcgcatcaatgagaaatgggctgagatgtaaaatcttattttcccaaatggattattgaaaattaaagtacaagctgttaaaagcaaatcttaatttttatataagttcctgcactctcatttaatggaaaaaaaaatctatcttcacagaattttaaagtaatttttctataaccaagatctatacagtaaattactcacttactggtgagtatttgctaacactgtatgagaatatccttcaggatctggccatgtcacagcccctagggtgattataaggtcctatacaggccttagaaatattacgcttttaattagatggagcaatggctagtcttcgttcctatatcattatattattaacattcattgccaggactcccggttgcatctcattgcaagggaggctgggaaatgtagtctagctgtgttccccggaagagagggaagtaaattttgttgaacacaaagcaggctctaccatggagtcaaactccacccatccccagatggatagccaattatcccggcttcttttcctgccaacctattccatccccactcgtttgaattgcctcatttgatttttgcagaattcctatatatacatatttctggacattattcttattgattcctgagtaataatcatactcttttaattaccgaattgaggatttatcttttgttttgataacattgtttttaaaaatattttgaattttatggcatatttattttcccagataaacttttgatttatcaaatttcccaaagaaagtaaacaaaaaactctacagtccttctatcatgtattattaaaaatatatcccactcaaaatattatactattaaaataagcattatttgacaactggtattttctgactctgaggaagtatgctttttaaaaggcaagcttccgtctaaacaatggctaacaatgtaattaggagggcatttacaaatggcttgatatttatagttcacatttcaacttcaactctatttgttgcattagcaaaatgaaactcattaagccttattcttttagtccatctctccaagcttctgaacccactaatactcagctttcttgtatggaaatatgtaatctttcctacattacacttgaaagttcagctcattcctaaacctccagtcaaggagatgaacttgttgctttcagagaggccacatctgtgcactgagccattatgccatctgttaaagtggtcagagttcattttattgcctcctttgtggaaggacttgtactgtaaaaagcctgtgttattgaaaacataattttcttcatcattatgctttctttctagccagatcataacctgctagaaatctattgagcatagagggaaaagctcttcagaatagctgttcttaagagattaaatgattgccatctctgtcccatttcttttatctcataatcaagttcaagatgatactgggtatctcagctgaagtgattatatatttgaaatagaaatggctttctctccattcatatttcatattgttgatggtaggatcttttttctttatatttatatatgcttatgtttccttataaatgtccacggggtcaaaggttcaaactacttttttttaaaaggctaaacatggctaacaggagttgggttacattttccaattttctgcatacaaagatactagttgtataactaagatctggcttagattcatcaaaattgagaactgaaccaaatcttagcaatcatctagcctagccattcagcttgacaagtgaggagcttcaaagtcatagcagttgagaaacttgcccagggcttggcagcagcctagctgagcagagagctcgctcctggggggtttctgctggaccacactgtctccctgccatattcagagtgggcctgtggtagttgcatatttacggcatggggggaagaatggaagatcttagtgactcagaagtgtaggaaacagatttgttatgattagttcaaagatgttcactttgacttttgtactttatcctgaaaactgtctgatctgtgctgttttcttacattgtcatttctcttccagagaatcaaagttagaaacacgatcatatccctgtttattagcagctctgttaaagcacttgatagagaaggaatatcaaattatttcctggaaatatagcccagggccttgggctatatgttgattgcatttatccacatgtctacaagtagtcaataatccgaaatgacatactgaaattatattttcttccttttaaaatatgtctagctgtcaatgagattcctcattcttaaaatttagtaaataggaaaaagtgagtcattatttatggttagtcactttggtaagctgtgactgtattttacatccatttttccttttttcttggactggagaatttattccgtcacttgttagggaaaatatatattagttccctcaatagcctcttcagtgcattaagaatcacaaggcaccataaacagaactttctgttggatacagcaagcaagttactctttagattgcagagctgaggagaataatccagaatcttgagctagcatccgaggagaaatctaaattatttatggtttctttaaaatggaataatcatttcaaaaatactatgttcattgagtatctgctgtctgtccatcaagttccaaatactgcaaggtttggaaaagatttcagacagaatcctttgtatgtcaggatgctttcatttccaagtagcagaaaatccatttcagactgccttaaacaacacagggaatttattgggtcagtgactaagagtcttgacataggggaggcttcaggcatggtttgtttaggctccagctcactgtgctgttctctgactctttccctcattgtatatagctccagtctcaagctggtaattaacacttaaaagcctgtgcacaaattatcgaatcaatgtaccattggagcatagaactgttgtggaaattgcacccttatggtaggaaaaggctgttggaatagcaagcctcacctctgcatctcagatgtccacattgaaagagcttctcaacttgcaagcaaaattcctagacttcattatgtttgtaccaattctttaccaaccagtagtagccaggggaggaatgacatgtgttaactggcttaagccagtcaatccttgagccagtcactgtggtaaggagagtgggattacagtcattggttaaggccagtgagctcccacttctagagcttggggtgggggtctgttcccccacaatcacacagctgctacatggcacagagcaggtaagatggaagttggggaagacgcaaacaatgtccatggaattgttaggctagtaggctgagccgagtgctaatgaggccactgttttgcctggcttatgtcgttctttattcctggcctgatctggacattctcttacccttcacagttcatcctaaacagccaggtccaccacttgcttatggtcagatgataactatacctctgcatccaaaaggaccctgtaagaatcttatattcagggataccttgtcctcactctgaaggagcacttaaagtccaataatactatttactattaatggactaaatattattaataagacatgtatattagacagtaaaaagaagactgctgcagtgttttttttctggttaaccctggcattttaattgcttggaacttcaaacttcagagctcttcttaaaggcaatatttaatttcctcccaaaaaaagcattttgcaagtagaggaatagtctgatctctttgaagtagtgagatctcttttacttgagtgagaatctgatatgacgtgctattgctgatggcaatttaaatgctctgtgtgaagtttcatctctcaaaataaactttccattgtgtcttaacctgggttcttcttgaaagcagagcctgatgggggcttgtgtacaggttgttgtgaaacagagaatgagggaatgcaagtgtctgtcaccaagctcattactactatgagcgattggagcttgatcccaccagaacctctgatgagccaagagaatgacctcagagttgtctacgtaaagcttggtattttcctgccataaggatgcagtcttcacaacagtcctgtgctcctttggtacattgattcaataattcgtgcacaggcttttaagcgttaattaccagcctgagactggagccgtgcaaaatgaaggaaagagagaacagcagagtgagctggagtgtaaactggtcaaggggttctacctgctctgtgcatgaagaaggccttaacactccttttcatgcttccacgtttggggggtagggggtgccaccccaggtgtcagagcagtcccaaacagcaaaagatactgctactggctcgggtgaggctttcccagcaatggctggagtcaaaggaggttgcatagcgtgggacgggcacaaagggaccccagtacacaccgaagagaatgcagcacatctgccaaagtcatgttggagcctagaaaagaccagaaatcatctgcatatctctttagtctttcctgtatatccgaatggcttttcttaacacatgtctttaaaaaggtaaaattaataaacacattaccagctgaattgctgtagagccctgcaggactctcatcaacaaagaggcaagcacgccagtgggaagaagcagcgggctcctcagaagagaaggctgcttgcgggagaggctgtcatcattacatcttcaattggcgggtcttctcatccccagcaggggctccttgcttggagggtaatttttactttcactgttcagtcagtatgacagctttgtccctaatgtagtggcagttttgactttggtttaaattattccataaagaatcaaagagaaaaagctgctctctcccttttcccccaccccaaaaattccactaagaaaacttttctcacttaaatcttggcctccacattaaatttctcattcacatttcaggtgcatcaaatatggcatcaactttcaaaatctcatgtgattatcacagtgactcaaaataattactatctgtcagtgcgtttgttgggaacacagatatgtctggcacacgccctattaccaccagcaagagtttgcctctccagtggggtcttctctgggctcatttcaaaaccttagagtgttgggacaatcatctgcatgatctgagaaacatgtgcctcagctgaccctgaaatcattttctttttaaagaaaaagtctttaaagcaattatattagtaagtgtagatttagctggaatgttcaaaaggattgccttaaactgtgattcctctggctcaatggttgtcaactggggtgattgtgtcccccaagggacacttggcaatttctggagacatttttggctgtcacgattgggcatgaggggtgggagagggtcctaccaacatctagcaggtggaggccagggatgctgccaaacgtcctgcaatgcccaggacagccccctctctgctatatcagagcattgtctggtccaaaatatcaatcgtgctgatgttgagaagcccagcgctagctgttgtggatttatacaatttgaaataaggccaattgtttggaaaattcagactaaattgaaagaaaatattttttcagttgaaaaagatataagtaatattaaggaatatcttaagacagaattacccaaaaccctaccatcttcataagacaagtttctgcgtagcatataaccttcagcttctgcccaaaagaatataaatgtttataaaattgcaattatgggtccgaccgcagtggctcacgcctataatcccagcactatgggaggccaaggcaggaggatcatttgaggtgaggagtttgagaccagcctggtcagcatggcgaaaccccatctctactaaaactacaaaaaattagccggacttggtggcgcatgcctgtaatcccagctactcgggaggctgaggcaggagaatcacttgattctgggaggcagaggttgcagtgagccaagatcataccattgcactccagcctgagtgacagagcaagactctgtctctaaataaattaattaattaattaaaattaaaattaaaaaacgaaaacattgcaatgatgatgcgataccattctgtattcttgctcccacttaaaaatatcactttcatagtctttatgtcattttaatagaaaagattccatcgtttcaatgtagtaaaatttaaaccatttcctttttctttctttttttttttttttttaagtaacttgggtaaaagcaagtactctagtctgaagcctggctttggagacttagacatggggtactcctgaataattttacaagaaaaatgattttccaagaaataaccactttcagaacattctaagaaattgttatgatgtcaacattttcatacaagaaacatttactccttgtgagaaacattgactatttacattttttttttttttgagacagagtctcgcactatcgcctgggctggagtgcagtagtgcgatctcagctcactgcaacctccagctcctggcttcaaccagttcttctgcctcagcctccccagtagctgggattataggtgtgcgtcaccatgcccggctaatttttgtatttttagtagagacggggtttcaccatgttgcccaggctggtcttgaactcctgacctccagtgatccacctgccgcggcctcccaaaatgctgggattacagtgtgcaccactgcgcctggcctataaccactttttaatacaatgaatcaaaatatttttacttttacaaatttgaaaactgttggaattcaactgaatggactgagtccagttctgcaaatttggaatgtatcctgtgtcatctgaggtcttcctgtactttgaagtccatagagtattgcctggaacctccattctacacctgggggattatgaagcacttcccaagattcttgcaaattcctagcaggcttatggctctgagttctcatttctctgagagaattcagtggatggatcatcctgcctttcccttcttgcttttcctgctctctgctgcacgttcagacagagctcatctcctgactcaatcttcagcccctgactcaacactgacaccccaaagtcaccatcccccacagtgtgtgtgtgcctggcactcccttggtgaagataggggagaggttagaacaggtaatacaaacagtttggaagtacataggaaacgtaacagtcaattgaaggacttttgatcatcgcatcattggggaatttcatgactgttcttatatggcatctccctgtgcctgtaccctctcttgtcttggcttgtcatctccttcctcccagatggccctaaattgttcataccaagtaatacagagcagtacttctttttttttttttttttttcttttttgaggtgggatctggctctgtcacccaggctggagtgtgaactcagctcactgcagcctccgtctcccaggctcaagtgattctcctgcctcagcctcccgagtagctgggattacaggcacatgccaccacgcctgtctaatttttgcctttttaatagagatggggtttcaccatgttggccaggctggtctcgaactcctgacctcaagtgatccacccacctcagcttcccaaagtgctgggattacaggtgtgagccaccacacccagcccagttctgctctcttgagtctctactcccaaaatcaattccaggtctcccttttgcatctcaaaaacaaacacaccaaaaaagcctttaatttcattgggcctacatttctagaagcagttgttgttagttaattatcctcttttacatctgcataaactttaattcctttgaaaagccatttctgagatagtctgtatatgtgtctatacctacgtccctgtgtctggtaaaaggggagctgcttaactggattgaagtgggtggtctttgactatgggttagaccatgtgtacccagtgttctgcattggttcacaatttcctgcttcttaactctaaattgttcagcctgacattcagggggttccctcgctccactgccccatgttttgagcctcattttccacagcttgtctctcatgtggtctcctctgtacctagtctatgttttgcaaaatgtggttgagcatggaaactgtaatcgacttacttacgggtccctgaatgatgggtctaaggtgtttctcaggcgtgcgtttgtttgtttgtttgtttgtttgtttgtttgtttacgagattgagttttgctcttttcgcccaggctggagtgcagtggcccgatcttggctcactgcaacctctgcctcccgggttcaagcaattcttctgcctcagcctcccaagtagctgggattacaggcacctgccaccatgcctggctaattattgtatttttagtagagattgggtttcaccacattggccaggctagtctcgaactcctgacctcaggtgatccacccgcctgggcctcccaaagtgctgggattacaagcatgagccaccacgcccagccacaagcgtttttagactcggtaaaacaatgaggtgatagtttctttctttaattccctagtacctcctgggaggtaatagattttctataatattatcagctgtttcctcagattcatttgttccacaaattcattcattcgacattcatcctctgctgtggggcaagaagtggggccacagcagcaaagaagacaaaggtcttgccctcctaaagtttctttcgagtcagggttggggggtgggaggtgctgaattttttagtgctgagggtttgttgatgacaccaaaacaatgcattctagtttcaaaactagagcaaactcacgttagggttgaatgctgtaacagaaacaagagggctttttaacctgatgacatttccttcctctcctcagccagtcactaattctacccacggtacatcttctctgtcacagtgatttgagtgtgggtgctatgagaccttccttcttcagaataattctgtctgcaatgaaaaacagtatttgttagcttttaaaatgatagctctgaacttgaatttcctctgcactctccgtgagatgaccagacctgcttgtatatatgcgatgacgacgaaaagtcagaagacattaagtatttcagcatgtctcatttgaaatatgaatttaaaatgatgatgccctgccattcattatgtgaataaaatgccaccccacacgttatgaataaactttccagttttaacagtgcttggttttactatactcattttatgatggaaagctctagcaaaggcagcaagaaaaattaggagttaatacaataacaggcggggtacaatggctcatgcctataatcccagcactttgggaggccgaggcagggggatggcttgagctcaggagttcgagaccagcctcgccaacatagtgaaaccccatctttaccaaaaaaatacaaaaattagccaggcgtggtactgggtgcctgtagtcttagctactcaggaggctgaggtgggaagattgcttgagccggagaggcggaggtcgcagtgagccaagatcacactgctgcactccagcctgggtgacagagtgagactccatctcaaaaaacaaaaagttaatacaataacaatgaggtcgtttactgagaaagtcaggcaaagggatttgcttctctacaagcattcagcatctcaataagtgaataagcacactcgcacacacacaaaatattatcagaagcagtttattctaaacattatttttctaggttattcacttaactcaccctctgagatttatagttcaaccataccagttcagagtggaaagaaaaaaggccgtttatctaatccaattccttgggaaaaaatacttaggcaatattaagaatcctcaattatctaatttaataaaagggatgatttatattctgtagttagtaacgtgatactgattatttctaatcccttagaagagatctgacactatgcttttggtcctgtgtagcatgaaatcatcatgtatattttaccaaaagaagtaacaagaataatggcctctgcagtctgcaatcattttatatgaacacactgcaacatggttttgccctggggcagagaagtagggatttttctctacttcaaaagaatgaaaaattatcatcactctatccagaaccattatagacttcagagactttggcatgaaatattcagaaagtttattttagaattcaatattttaaaagcctgctttaaaactattacagtgattagtggctctcttgcttgggccagtctttgctttaaaaagtcctatgtcatggttgatacgaatttgatgtttgaacaaaatataattggcatcaactgcagaagctacttgtaaggcattgttttagaatgcccccaaagaggagttgggaccactactcaccagttatgctttcaaacacacttttttttttcttaattgagatggagtcttgctctgtcacccaggctggagtgcagtggcgtgatctcggctcactgcaacctctgcctcctgggttcaagtgattctcctgcctcagcctcccaagtagctgggattacaggggcccaccaccatgcctggctaattttttgtatttttagtagagacaaggtttcaccatgttggcctggctggtctagaactcctgacctcaggtgatccacccaccttggcctcccaaagtgctgggattacaggtgtgagccactgcatctggcctgcatatgtttttgacatatcacagaaagacatgtgtaagataattagaaagagccgtttctttttttcttatataatctgtgtatttggcttcatctctttaaatatgtggaatatattatttctgtaagttttaataaataccctttctttcctgcaaacctttattatcaatgaaaaaacaggcatcaatctcagccttcaagtagataaaataggttcctctctcacacagacatgcaaataaataaagattctaatgtgctctcggtgcataggtgttaacgagaataatgtgtaaatgactttttgtttcattttccagggaagtagatcgagattcagatggtcacgtcagctttagagactttgaatatgccctgaactatggacagaaggaagcctaactattgtgaactacttttggtaactctggggagatcaatagattgtaatgtcagcagactcgactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcatgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacatgagcaagccctctcgggctatatacagaggaagaacagggtgatgagggtactgggggcaagagacatgtttgcagaaccctttaggatggtctaggcttgggagtctcactgtggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcactttgtcacctaagctggagtacagtgcgcgatctcggctcactgcaacttccgcctcctgggatcaagtgattctcctgccttagcctcctgagtatctgggtttacaggtgtgtaccgccacacccggctaatttttagtagagaaggggtttcaccatgttggccaggctggtcttgaactcctgacctcaagtgatccgtctgcctcggcctcccaaagtgctgggattacaggcgtgagccaccatgcctggccaataaaaataaagttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaaaaaacaaaaaaagattagctgggcgtggtggcaggtgcctgtagtcccagctgctcgggaggctgaggcaggagaatagcatgaacctgggaggcagagcttgcagtgagctgaaatggtgccactgcactccagtctgggcaacagagcgagactccctct

SEQ ID NO: 37989 - DNA, 202683 bp, Homo sapiens
atgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacgtaagtcgcccgacccggggaggtgcgcgcggggacgaaggcgctcccgggtcaggtcccagcggctctgccgcggagtccccccgcagcctgggatccccgtcctgccgcctgcccggggtcccgtccctctccccgccaccagccccttctctcccctgccatgctagatgtgccttgtgaattttgagctagagacatgccacttgcatagaacacgcaagtcctgggtgttccaggtaccaagacgcacgcatcctacaaaggagagaacaggacccagaagacccaagccagttaaaaccgccaccacagcgaggtctgtttatgcagagtctgtaaccattgcgtctgggcgcaagagctgtcggctaccagcagctgggctctgtccttggcttcctcctaccccacccccttctctcatctcactgtacccacagagctccacctagagaagcaggaccgtttgcattcttgcaaaccaggttgcggacccccgtttccaagaggaaatcaagtttgacagtcggtcctcatcataaatacgttcatgccctccacgcctgccccagtgtccccgggcaggaggttacagagactgcattgcatgcgcacggttttgtggcgcccaaagagtgactttctccaactcttttgcagagcgagtgtcttggtgggggcgcccaaagccaacaccagccagcccgatatcgtggaagggggagccgtctattactgtccttggcccgcggaggggtctgcgcagtgcaggcagataccgtttgacaccaccagtaagtgagatttgtccttctaagctgtgggcctgggtttggaagaaccagggccatcccagaggcgacttcccgctgtcttggtgtgctgctcgtttagcttgtctgatatgtccgtattgtgggctatgtgggtctctagagaaatcagttttttcaactctcagttaactgaaggaagacgtttagtgaaccctagagaaaggacactattttgaccctgagtgttcggatgcatcctggcaactcctgtttctttacctttctgagatgagcattttcagggtgagtggatgttttggagaaatacaaaaactatgtcctaactttgactgtggagagaatttggttgcttctcaaggacagatctggaaaaagagagatccttagcgtttccagtgcccaagctcgggaggcaggacttagctgctgcagacccagacatcactccgcgttgctgtttaattctttacagaaagaaagaattttctttcaaagtattagacattgaatgcaaactagtgcaggcagagtgtggatggattacattcatttccaaaatccctagacagatgtttcttatttaattaaagggaaaatacattttaaacaattcagtctggttacgtttcctctggtgttttctctttagagcctgagaaaataatttaaatgcgatgctttcaaaaacattaacaccgaatgctttaatttttaccaccaaaactttatgaattcaaaaggtatatattatcagaaagcaaatatctctttccagaaaaatgcgaatatgtcagcttgaacaatggtccttgataaataatcgtttaaaataccttgtgtaccacacaactattttatgacatacttgatttctttgatttttaattgtttgattagtgcgtatatggaatttatgcggaatattttcacagaatttcgatgaaattggctggatgatgtttacttgttactataatttgtatcttttatgttaaaggagaaaacaatttcagtttcataaatatgaaaatatttcaaagcaaaacagactatacaagcattaccttgaattatgaccaaattaggaaagtattttataaaagcattggaaaattatatttttatcatgcctgtctatatatggtcacaatagcttatcattttattaaatattctgttattttataccagtttttataagcttttacttttaaatttgagtattagcaaccaggaagattaaaccttttgatgttaatttgtgacagaaatcttttaattagttattttatcaagacttgagacactttctagctactgctctctagtttaagaataagcttcgtaaaccaaaagaattaaacatttaaacacaaaattaatgccattttaataattcatatccgaatcatttgtatttttaaaagtattttaaagcaggccaaataaagacatgaatcattaacattatttgaatttacattaaggaaagtatattttgagacatggttgatgtgttttcaccaagaagcaatttatggtcgtggaaaagaatttaataatcttcttgtatagtctcataacatcaaatcaggatctgattagtatttttttcttttgataaaggaagaatcaatgtctgccctgataagttacaactgacttactttgtaagtactcatcccaatagatgtcataggccaacagattaaaaaccagagaatccagatgtcaactatgaattcaaaaaataactgaccactcctaactgaaaattttcaatattaaattacaataggtaggccaggcgtggtggcttatgcctgtaattccagcactttgggaggccgaggcaggtggatcacttgaggtcaggagttcaagaccagcctgaccaacatggtgaaaccccatctctactaaaaatacaaaatcagccgggcctaagggtgtaatcccagctacttgggaggctgagacaggagaattgcttgaacccaggagggagaggttgcagttagccaagattgcaccattgcactccagcctgggcaacaagagtgaaactccatctcaaaaaaaaaaaaaaaaatacaataggttatattttccaagttcattctaaagcaattgcttgaagccttgaattcactctcccatacagaactaatgctgaaagatgtgctttggtttccagaatagcccacaggaatgcatttaacccttattgtagctgaattatatttgcagtaaaacagtaggggacaaactagaacaagttggcaattaaacagaaaaataatgtccagaaaatgtcagtgttacttggagaagacaatgtcctcttttgtgtaggttaggaaaatgtctagatatctcaaagggctttagagattgatgctgctcattccacactatgtcttattttacttccaaatatatagtggtttacttgataaatagatgaatgcactaatcctactattatacttatcaactacaatcataataatttcagaattcacaaatggaacaaagtgagagaaagaaaggggaagaaaaatcaatgttcctgaaataattgaacaggaaatttaaaaagcaaggcaggaaaggctacacaagtttgtgagaaatgaatggtccatgacagaatgaacaaggctgtgacctgtgaaagacagggaggtcccactggggaggagaaaggaattgttgggaaaagaaagttccccatgtcggccatcagggggtactatgggcccagaaaccttgattgccagtgggaatggcctgaaaatgggtgtggggaaggaatccacagggtcacagctcaggtgtttgctaccaagtggttgctcaccctctatacctcatctgtgccaattgctttgtccttataccctcagatagtggaactggcagtggcagctacttgatgcaatgctgtgcaagtgaagaaggcacagcagatgccagtgtagctatttccattctgaacatccacttcgtggacaaagtagaatgttaaaacgaaagatgaaaggtggaaacagacatcactggctctgggtcctgaagtcagtgttgccagaggcatcccatttacagatcgctactatgtaccagacacggtacacacattgtttctactacataaaacaaatcaaaacaactatgtaaaactcattctgtaaataaggaaactgacatcaaaggtatacccaagaccgtacagtggtaggtggtagaggcaggactggaatagaggtctgcccagttcgcagcctgcttgttcccctcaccttccttccagaaatggggagaggattgaccctgatagactgcaagttcaggattatgactaagcccccaaggagctttggaaggctatatttgccttccctccctctcctccattcccctactccagcagtggctttacaattccattttaaattattctccagagaggggttggaaaggataaacagttttggtggaagcattgtagaagcagggtttgtcttggtgggaatgatgggtcgcatatgcccctggtttgctcagactcccacagaatgccccttcatggtctctgataagctgcctcctgagttactctctgctcagtgccagtaacgtactgttctcccccgaaaaaaaggaagaaaagttctctgcttaactaagtagtggccccaaattgacatccgcataatggagtgtgatgtgtcaggcataaaaatgtatattgcaaatattcatctgtcaagacatcagtgactttcctggtcttttaccctacttttactacgacatctgaattcaagacatcctaagtaaatttgacctttcaatgaagttgtttcaacttgttcaggtccctggggtgtctacaattgggtattctgctctggtaaccaactaaattctctcagcttagactttgaaggagacagccctataactgagtcccagagtccagttgagatcctgttcctccatttatttaaggtcaattgccattttctaaaaactgcctttcaggttttttttcatgaaataatcattatttattttatttttaccttatcatataacttgattttctttaacatttctcatgatgaatacaaaaatagaggaagcttgcactaggcccagcacttcaaatgcatgaatactagaagcatatgctggtgggggagatgcaaagagtagataattttcctgctctgtacagaatcaaggggttccaaaaaagcacttctctgatctcccttctgtctttccctctttacttcaatagaagaaaattcctcctatcaccaaattggtttctttcacttttgtctcaggaactctttaaactatgccctatgtcttaaagagtttaaaatatcacatctgcctaattcatgcctctcgcttctgtgtctacttcaaggttccctttcttctttttcctacattttctaaaccaatgcatgggttaaagaatgttaggctgtaacccttctgctaaaagggagaacgaatgagacaatgaaatggactgtcatctttggaataatgaagagcaaattgcaacatagttccaaagtatagcatacaagtatttgattgttttaaatgctcaagtaaaatgtttgaggaaaaaggtgatgtgtgctaattaattatgataatcatcaaagcactaataatgacagagaagcaatacagctgggaaccagtcacagttaggagcccacataagaagttgacaggaagaggtaggaggtgccattgagatttggaagtcatctgagaaagaccactagaatttgcctggcctcaacttagtatctctgtgttaaaaaataaaaataaaaataaaaataaaaggaaaaagaaaaagaaaagaaaagaaaacttaaaatggaagacaattggattaggatatttcaaagttctggatgacaaggtttttgttggaattgcgggagaccggaagcctttgttttggggggtctgttttattttgtgttgagtgatcccacaatgagaagcagcttaaagcatctggttctgcaactggcttagggttgtttttttatagtgttcggtgtgccctttttctcatgtgagggttgggaaacatattggctgcataagtcttgcctttctagtttccccggaaagaaatcagtttttgttcaggaacaaagaaaagaaaaatgtaggttagagctacccaagtaaatgacagaggaaataacataaatgtgataggacttagggacaggagaaatctgtgctctaatacgttcacttggaagattacaaaggtgggggaagacggaagcccaaagataacctcctcttttcaagacttaacaatgagagtaagttttgctactcagaaaaaaagaagcagtgtgtgcacacaagcacacaccacaatatttgcagaaatcttcctctgctaagtcctgatccaactgagtcatcaaaggtggtttagctggatgtcttacttattattctagaagcaattcatgatggctactatgactggatatgttggcatgacagaggcaaccatcatccctaaatttctctctgtttgttcagacttcatgcaacagaacacaactgaaccttggtatgagaagggaggaggcagcggtccctacagcccatagcaactgaggaagcaattagaaaaaggaagtccttgaaactccaactagaaatgggaaacagatctgctgtatggctagttgagcagtatgagcattaggcacctattgcttaatctgcaaaattctttcaagaagctggaagtctgtgtgagggaacaggcttcaaggttcttggcaggaatattccgtgtaggctctgcagcatgctgggagaaatggcttgaaattatcttgaaatagtcttgaaattattctgaaaggaaaaacacacttttacatttaagctgacaggttgagatgtgcacattcgaactttccttcttagtgtataacgagtcttgtatctgggaattgcattgatggagagagttgccaactttacgaaaaagctcagctcaggggtgccctgatggataccatgacagtacatgaacatggacttttttattttttattttatttttatttttttgaaatggagtctggttctgtcacccaggctggaatgcagtggcacaatctcagctaactgcaacctccatctcccgggttaaaatgattctcctgcctcagcctcccaagtagctgggattacaggtgcccactgccatgcccagctagttgtgtgattttttgttttgttttgtattttcagtagagacagggtttcaccatattggtcaggctggttttgaactcctgacttcaagtgatctgcctgccttggcctctcaaagtgctgggattacaggcatgagccgccacacccagccattgaacatggatttttgagcaagatagctgaaagactaattattggttttattaaaaaaacactcattcatcctttaatcagcaagcatgttgaaagcattttaaaataatttttatttttcaaaattcagcttaaatacatgtttacaaagaacatatttattgcataaagcaaggtgttcctccataatgaaatcctaacatagattaaagtaatttcaattccaggttacatgataaggagatttaagatatgcaagctaattgtgactaagtgatttatacttaaaaccaaatacatctgatacaccagctatggactgctatagaattcaggtgagcaactcttagatgaatgtcactagatggtctggaaggagtggagctccacctcaaccctgctgaaaggccagagtttaggtctgtggtgtttagtgtattggcctgaaggtctgcaaattgagaaactttcctagacccataaacactgaagaaagtgattatttaccctttctttctttttttggggggtaaaattaaggtatagattacaaaaataagtctttatagaagtgatttccaggcattgggagtggaagagatgagttgactccaaaggtgtaatagcagggaatcttttgggggggaggttgatggaactttctatatcttgattgtggtgggggatacatgactgcctgtatttatgaaaacccatgatgctgtagatcaccaaaagtggattttataaatacgtaaataaataatctatattaatatgtaaataaaataaatgtataaataatatgaacaaaaagatgaagagaaaaaacctttatggagaaggcaagagagttacatatttgatatgatgattaaatatggttttgtggctgttgctctgagcccatggtcaataagctcttaggctatgggagggtctgatataacaacacctgggggtgtaaagacaaagatccctgagaagcataggccaccgctcctaagtaaggctgaacgattggtcagatcatcatgtaggaacttcttcaacattctttaaataaaggatcatatgttccgaatgtgtttgataagaagagtgtgaatgcaaacacgttgcataagaatatctatgcaatgaaatgttgttccttgtgtcattcctatatccttatgaaattcaggcacaaaatttcctcactggtagtcactgaagagagctcactttaaatacatgattgtagttatcaaaattagtataatggcactgcagggtatttacttagaaacatttggtcagttttcttcttcagctctgatatttgacataaggacataaatttgaatatgatattgcaaaaaaccctgtatcagtctgccctgacttccaggacatactgacacgagagagaagggcacacaccactgcaacaggaataggtttattcaaagacctgacccggcccacgctatacgcagcatctcaccccaggtacagcagtggaagccaatctcctgtggccaggttgtagttctattccagttgtctcagttgtcagagcctatgatttccccagatgtctcctatacctgccccctcttgcctcgctagttacacaactgatctctttgtcacagtgccacacagcacagtacagcttgtctctctagagcacagcaaacaactcttgcatacacacgtgttgccacacaccctgcaccatgtcctcctgcattcttagccacccaggacatcttgtcttccagaatgattttctgatacttcaggcttctctcctcctatagttcccaccaggatacatgtttcagaaattaattctaaagtagctacaaatccttttttaagaagaaagaaaaggggcacaacactaaataagtaatgtttttgaacagcctatttgtgggtagtcaatcaaattagggcataaaagcacacaattaaatattatataaccattaaaaatgaagtctacaaagaatcaagattaacatgagaagatttgtgtttcagtggtaaataaaaaacataaaagtcaaaattgtgtctacaacttcttgaaaaatataagaaggaaattgtaatgagagactatctttgggaaatgtgattaaaactgtttttttctcatgcattttttttcttgttttcaaaccatgaacaagtatttatttatgatcaggaaaaataatgaaaaaattaaacacacaaaaaaattctaaatgaaatgattgagttcactaaagtgctgtaaagattaacaataaaagatcagaattaaagctctggattagaagatggcatcttagttgttccctctcttgtcttgggagctgatggttgactggtttagaaatgcatttatttatataaagtacctaggttctaaaatactaaagatcaagggtattttcagtaacagtatgtgtaaaaataagaagatacagtgtaagtctcacctgttttcattctagattaactttaaagatagaaatacagacctgttctgacatggcagtttcaagagctgtttgtgtgcggaatagcttttgagtgtgtctgagtaagatgagcttaccagaagttaattcacagtctatttatactgcaatcagttcacaaaacttgttataagagcccgtaggaaagaaatcaagagtgaccataggtccagataatcccatagaccttaaaatatggaaggcattggatagagtcaagacatccagataaactcatgaagtagtgtcaaacatcatagcatgaattggtgtttagttcttgctctgttatgtataataatatttttttcctttaaaacattatatatgatgagttataaaatctacctagagcatttcttctggggtgcgccattctacttagtcccaagtaaggtttataaatgttctgtaaaggtgtgtctgtttactaagtaaagagtgtgtcaacacacttgccaacaatcttggttgagcagagaaaagtgagaagtttcggggaggagaactgacagaatgaaagctggagcagcgtttctgaaaatctcttgcacgttattcttttgtacgaaaatgaacagaaaaggttttatgtcaactgagttggtaaatggctgcatctgctccctttctatgacacttacaatgcatattctcttagaaaaggcactaagaattcacaaacgaaatcaacctattggattcataggatggggcctttgttaacattcattatttctcctcacatttatgaggtcaaagcagacccaaatggctgtagaaacaacctcgtatctttggcttaaagcatctaaggtttatttcttgctcacactgtaagttcagtgtgatttgatagggaggcttggccagttcaagccacacagggacccagcttcatggagactccttattggcacgggtgtctgagatcaccctaattggaaaaggggtgtgtctaattgcacactgtctgctacagcttccacctgaaattgacatttattatttaacatattttgtaggccaaaccatgcctaggaggtttgctgtgccaatttgtttaactatggaaaactttacttaactgcacctatcgaaattgtatctaccatctttaaaagagcatgagaaaggaaatgcacacaaacagattgtctttgggaaatgtgattaaaactttttttttaattttgcaggacaggtttttaggacactcagttcaaatatacagttattgggggctacagtgtcaaccccttcacttatgaatagacacatggcaaggagaggatgtttttgtgaacagattcaaagatatgagtgagacgtttataccaacactcagtcccccaacctgttccacctggtctccactggaaattttttttctcttttcttttcatttctctattcctgtgatagattatccattctttaccacaaagattacctgggaagactggatgaccttcttcctttcactctggttcctcaggtgacatattattaaatcattacacactttaacacacttttacttataaaaatgtcatctaaggggggaaaagagagttgaaaataaagcttagcattagcaaatggtaaaattaaatttcaggggctactatttgcaaccctgcacaggcagatgctgttcttgacgtggagtacgtccactaacaaagcctaagattttgtcccgtcggatggggttcataggaacagccagcgacaagtggaagaaaagaaagcgaaggtcaagaggacagagaatggtgtgtgtgtgtgtgtgtgtgtgtgtgtgtgtgtgtcggtgtgtgcacatttattttagcttgggcaggccatttgctttccattgctactatgacaaattaccacatgcttagtggctttaaacaacacaaactgattatcttttttttctttttctttccttttttttttttttagaaggaaactcactctgtcaccgaggccggagtgtagtggcacaatctaggctcaccgcaacctccacctcccaggttcaagcaattctcctgcctcagcctcctgagtagctgggattacaggcacccaccaccacacatggctaatttttgtatttttagtagaaacgggatttcaccatgttggccaggctgctctcgaactgctgacctcaggtgatccacccatctcggcctcccaatgtgctgggattaaaggtgtgagccactgcacctagccttgattatcttatagttctggcatccaaagtctaaaatgggtctccctgggctagcatcaaggtgttggcagagctgcattccttctggaagctcttgggagaacctatttatttccttgccttttccagctcctacaggtgacccacattccttggctctgggatcctttcctttgtcaaaagcagcaacatcttcttccactgccctatctctgggtctccttttttggcctcttcttccacctgatagtatccttatcattacattaggtccaaatgtatgatccaagataatgtaccattttgagatcagctgattagcaaccttaattccatttgcaatctcagtccagtccctctttgccacgtagcctaatatagtcagttttgggagattcagatgtagccctcttgagcggtattattttttgtaccacaggtggtcacaagaactttcactgaggaggtgatatctgagcaaggacctaatttgagtgaggaaaggagccaggtggtatccaagggagacatgttctaggttgtaggagtgtcagtgttagagtctggagatgtgggtgtgcttgagaaatggagaaaggtcgctgagctagagaaaagcaaatcggggcaagagtgataggaaattaggccagaaggccaggtataagcaagatggtatagtatcttcatggccagggtcaggatttgggattttattctaagagtggtgggtagccaatggtgggttttgagtaaggaagtaacataatttgaattatgttttttaaaagatcagttttggtcagtcatgggggctcacatctgtaatcccagcactttggaagaccaaggcaggaggaccacttgacaccaagactttgagaccagtctgggcaatgtagcaagatcctatctctacaaaaaagttaaaaaattagcaggtgcagtagtgtgcacctgtagtccagctactaggaaggctgatgtgggaagaccacttgagcccaggagttagaggatgcagtgagctataattgtgtcactgcactccagcctgacagagtgagtgacaggagggaaaaaaatggatcagcttagattttgttgaaaaacagactatagacaaggaagagcagaagcaagcaagcaagcaaggagactaggtagaagaccgttccctttccggtgaaagggaagtatggctgggattgagtggtagcagttagagctgagaaatgggtggtttggggctttatttggaaatgcaattagtaggttatcattatggatcagatgaagagtgcaaaaaaagaggaaattttggcctaaggaactgaaggaataagacttagagaacagtgggtaaggagcatgtcttagatgaaatacccagggttgagtccagatatgtgaaatttaagatgcttattagacctcccaacagatgtcgaatgggcacttggataaataaactgagagctcaggcaagatgtctgaatacaaagataatatttaaggccatgacttagggagtgagtgtggatgaagagaagaggagagaggcaaagtgaggccaagacacaagagcagaaaagaggtgagaatgagtttgagattgactcctggggcaccatgacatttacagaaataccggggatttgaggaggatgtgtacaaaacacaaggaaggagccaccagttaggtaaaagaaagccatgaagccaataaagaaagtcttgtgaggtgaagtgaaatgaggatggaaatttagaacatttgatttggcagctgaaggttattgatgactgaaaaatccagttacagtggagtgtgtcaagagagaatgggagatagccaatgggagagagtaagtgtgtgtagcaatttttaaagtttggctatatatgggaccagagaaatttaatagttaagaaggtattatagcttgattatagtctaataggaattatcaagttcagatgactgtaagagagagagaccatagtcaggaaccaatttctgagtggagggaaatgcaggggattcctctacaagtggaaggactggccttagagcagcagaaacgcatttcatctgcagtggcaggagggcaggcagagtcaggaaacaactgaggatgagctgctggattggatggcaggaggaagaaaatgatcttttctcattgcttgcattttctcattgaaacaacaagcaaagtcaccatctgaggttgaggaggtcaaagagaaggttgggagcaaaaggaaattcagagtagtggcagaatggcaaagtggagtcatgaaataataggattaccagacaggaagttggataagtaaccttttgcctttgttcagcctatagcatggccctacctgtttaggtaggatttaagaagatctcccatagaataatttcctctcgagtgttaatcttccctaaggataaattacagacacagaaggtttgaattctggggtacctattttgtgtaacattgggaatggtgactttaaaaaaacaaacaacaacaacaacaaaaaccataatacgaactgttctgttaggtgaatggttgggaccctttactatatcttttggcagcaggcatgagattcttagaaatataagaccatgtaacaggaggcagtgtaaatacattttcaagtgttattgggaggcaaatttatacagccttcatcgtgaaacccaatcctatcctgtatttaaaagcactcctttgaggtcatattgaagaaatttatgtcagtgagtcaccttcctgagatgcccatgctgagaggttttcattacttcttgaagcaaataaatgattgggtactaaacagaagcatgctgtgttcctggccatcagaagttgacattgaagccatattgagagttctcatttccccagctgtacctatgactacgatatgtgatcctaggtaattattccaagtgtgaaaaaaatctagaggtgaaagaaagtatgaaagattcaagtacgaagaaagctgaaagaaaaccatcgtggttgagagtgacaaagatgatactgacaggggaagggttttgtaaacctggtttcgcatttgagaaaagttgagatttgagaaacaactctggaaagaaacaactctggacaatgtagcaagaccctatccctactaaaaaaattagcaggtgcagtagtgtgcacctaagaaacaggtgcatttgagaaataactctggcttcaggatagagaatggatttgaaggtggcaatgctggaggaaggcagactggtcaggaagctgtcacagcaacagaggctaaagaaaatgttgaccataactagggaagtggcaacagggatggaaagaagtagatggatttgggagataacaaaaggaagcatcaacaagaattgatgactcattgaaatatgggagtgcaagattggtgatcgtcaaggatgcattccaaggttctggcttggttaatggggttaccattatattaggtaaaaatagtgagcaagacagacatcctctgatctcacaatattcaactttgatgagatagtagtgcctggcagttctaatctggtcttaagtgctgtaacagcagaaagtgaagaaggcttcaggtgttcaaaataaggactcatgtgcttgaatcaatggggggcttttgtgttttgggggaggattttcagagagtacaacataaaaggttggagctgaagaatggtgtgtctgtgtgtttgagcatgcctatgtgtgcgtgtgtgcatgtctgtctctgggatggacagatgagagaaaaaactgttccagcctctattggatgtagtgaagtcagttgcagaagatgaggtcaacgttgtctcagtcagtacaatccactgtaaccagctctgtgtgtcacactgttgcatcatacttgggggttttgtttttgtttttaatctgatctggcacagataacttatcatttcccttggaagagataattctttcatttctcaactcccaatttcccttgcattatatccaaaatattatttgcatcgtataatccataggtatttcctgaccaaatcatacatactacttagtcaatttatatgtgaaaaacattctgaatgatagtatgtgatgtggaaaagccattcatatttactaccaagcaactgtctgaagaacactggctaggcactattggttattcaagacaggaagttagaaatgtgatctctgttcttaaggaagacagtctagacatgaaaataattacagcagaaaatttatattctcatccggatcaggaaaactatacaataggcagactaatataatctgtactgttgctattacaagcccatgtttatgaaaatgattattaaaactctaaaagcatgcatttagctcacttagctttgttattatagtattcgattatatatgaaacttaatatttaaatagcgatatgaacaaataatttaaaagggaagtttcatgatttccaggaaagaatagtttatttcactatgaactagaggaatagtctacaagcttcttaaattctgaatgagtttaccaaactgaacagtgactaagtccagggagttgtattctaatggcctttcacttgctaccttatacagttctctatacaagttttgttactttgtactgtttgaaaattttgaaacaataatctcaaagaatttcaatttgaaaagatagttttgagccctaccttttaaaatgggcttttaaggagtgatttgaacaagttggcaaacaaggaaaaaaggaatttcaccaaagaaatgtctgaaagaaggccatggaatgagactcaacagggaacagaaagaaagttaacccaaatggaaaggaagcccaaccaatacctagagctcaggctgtggggtcaagatcttcacgtgggccacgcgcggtggctcacgcctataatcccagcactttgggaggccgaggtgggtgaatcacctgaggtcaggagttcgagactagcctgaccaacatggtgaaaccccatctctatcaaaaatacaaaaattagctgggcacagtgggggccacctgtaatcccaggtactcgggaggctgaggcaggagaatcgcttgaatccgggaggcggaggttgcagtgagccaagatagtgccattgtactctagcctgggcgataagaatgaaactccatctcaaaaaaaaaaaaaatcttcaggtgtggagggcagggtatttatatttgatctatcaggtaaagataagaaaattatttaatgtgcgtgtaagcatgcacatatttgtatatagtatgcatacgtgatatagatcataaaatactcatttaatcaaaataacacatctctcgaacatcgtaaggaaaactgtgatattctttaaaggtttttcagagtggttttggagtattgggagccatacatttggaagtttaattttctgtgatataaaaatcaatccaggtccttttcttggatttgtttcttgtagacaaggagttctctggccaaggctgttttattttgaattatacatacgagtattccctgttctcagatgcatcattccaattagaaacttttatagcataaatttgactatgataaagattataaacaaatggttaaggatttcttctacccttttcatgattaaaaaggtctggatagctcctgcaacagctttaagaaaatctccaaggagacaaacttaaagtgatgactgaaggttgtagggaaacctactgttttctctactgggtcaggggctttataaatagttttcaaaaattatcctgtctgccaaaatgtttggtcacacctgtgtgagttacaactcttctcttctgtcccagggcgatctctcctcacttcgtgtaattcctctcatttcactaggctaaaagattagaaaaatctgcttacagcccacgtgtccaccatattccacatcccctcactcctgctctgaaatgcatattcccatgaagaaaaaaaaaagaaccaaaagctgccaatttcagagagatagcttcaaaggccagaaatggaggatgagtcaaatcaattgtattgataccacccatctaaagttcccgggttgacttatacatcttttcagtttatctttaggttttccccttttcagatcacagatgtactaatactcatggtaaaggctcaaacgattcagaaatatactccatgaaaatataaaagccaatgacacctgtatattccttgctttcaagataaccatcactcataggttagtgtcaatacatacacacacaagcacaatcacaatcacacatacacatccatgcatagaatatttgacttttaaagaaaagtgggatcatactgaacaatgtacccttgacaaatttttgaatgaatagatgggaacttggttattcattcatcaaacactgatgatctactatgtttttggcactggaaaatgcagaggtgaagcagacaacatctctgtggaatctatgtatattctcaaagggtagataatacctatataaaaacatagatttttaactcctatatagtattgtatactattgcagtaaacatgccaatacgatcatctcagatagtggtaagcactatgaagacaatgtaaaggggtaatgggagagtgaatgacaatgagtagacagaactggtggcttagggcttgtgtctctgaggatgtggtactggaactattcatgtcctcagcccactttttgatgggattgtttgtttttttcttgctgatttgttcgagttctttgtagattctggatattagtcctttgttggatatatagattgtgaagattttctcccgctctgtgggttttctgttaattctgctgattatttcttctgctgtgcagaagcttttcagtttaattaagtcccagctatctatctttggtttggctgcatgtttactgcatgcgacatcttatttgcatgtttactgcgatagcatacaatactctcatctgagtaatgagaagaaggcagccaagtgaagcactgtgggaagagcattccaggaagaggaaatgcaatggcaagactgaaaatgctgggtgtgttcacaggacaggaagttggtgtgtctgcaggttgaggagcatggggaggcaggagatgctgagattggagaagcaatcaggggccagacaatgttggtcccttgggccaagtcaggttttattattgcagaggtggaactataaatcaccgggaagaaatggattgctcagtaagtgctgtgggggcaagtggcttttcatattgaaataagaaaagtatctctgccactgtataaacaagaataaattccagatggacaataatcccaattaacagagttgaaagactagaaaaatattggaagatgatacttgccacatttatgtgggaaagagaatcagtaggcaaaaatatatgaattatgaatcaatgaaactaataactaaacaagagaatgagcaaagaatataaactggcacttcacagaaagaaaaaagtgaatggtccacaaacaggaaaggatgatcagccttactaaaagtcaggaaaatgcaaatgaaaacaaaatgaggtaccattccatggtcatctagactggaaaatatttaaaagtcctcctgtaataacaaaagttgagaatccctcactcctccactgctagtgggcataaaattgtagctactttggagatcagttgccatgtctaatcaaaagaatatgatcattctctatgacccagcaatgtcattcctagtttgggtgctggagagaaacccttgtacataggcacatggaggtggatatatgaatgttcagagctcagagtagaagtgggaaaactggaaaaaaacccacaaatgttcatatgtaaacggaatggataaataaaatgtagactattactcaatcggatgcaatgctatacaggagttaaaaagaatgagctagactgatctatgtatgtatgtatctatctatcatctgtttttctatacattcactcatctatgtttctatatatctatgtatctagctagctagtcatctatctattcatgaatatttctcacaaacataaaactgagggtaaaacacaagtacaaactgctaagtacagaaaatataatgccatgtttttgtttttttgtttgtttgtttttgagatgcagtctcactctgtctcccaggctagagtacagtggtgtaatcttagctcactgcaacctctgcttcccaggttcaagcaattctcctgcctcagcctcctgagtagctgagactacaggcatgtgccaccacacccaactactttttgtatttttagtagaggtgaggtttcaccatgttggccatgctcgtttcgaactcctgacctcaggtgatctgcctcctggactcccaatatgctgggattacaggcatgagccactgtgcctagccaaatgccatgttttcttaggcaaagactttataatcaagaacccaaaagcaaatgcaaccaaaacaaagatagatatctgggacttaattaaactgaaaagactctgcacagcaaaataaataattgccagagttaacagaaaacccacagagcgggagaacatcttcacaatctatacatctgacaaaggactaataatatccagaatctacaaagaactcaaacaaatcagcaagaagaaaacaatcccatcaaaaagtgggctaaggacatgaacagacaattctcaaaagaagatatacaaatggccaagaagcataggtaaaaatgttcaacatcgctaatgatcagggaaatgcaaatcaaaaccacgatgtgataccacctcactcctgcaagaatggctataattaaaaaattttaaaaaaatagatgttggtgtggatgttgtgaaaagggaacacttttacactgttggtgggaatgtaaactagtacaaccactatggaaaacagtgtagagattcctgaaagaaataaaagaagatctaccatttgatccagcaatcccagtactaggtatctacccagatgaaaagaagtcattatatgaaaaagatactagcatatgtgtgtttatagcagcacaacttgcaatttcaaaaatatggaaccagcccaaatgcccatcaatcaacgagtggatcaagaaagtatggtatatttatacaccacggaatactactcagccataaaaatgaatgaaataatggcattctcagcaacctggatggaattggagaccattattctgagtgaagtaagtcagaaatggaaaaccaaacattgtatgttctcactgataagtgggagctaagctatgaggatgcaaaggcataagaatgacacaatggactttggggacctgggagaaagggtgggaaaggggtgagggataaaagactacacattgggtacagtgtacgctgcttgggtgatgggtgcaccaaaatctcagaaatcgccactgaagaacttactcatgtaaccaaacaccacctgttcccctaaaacctattgaaataaaaaataaatttaagaagaaaatataataccatttttctttacttcacaagactgcaccaaagactactctatcaactgtcggcaaactacaactaaaactggcccaccatctgtgtgtgcacagcctatatgctgagagtagtttttatatttttaaatggctggatatatgtttttaaagaataatatttcatgacacataaaagttatataaaatttgatttccatgttcctatatgaaattctattggaacacagccaagcccaagcccattatttaacatactgtctatgggctgcttttgttacagggcagaattgagtagctgtgacaaagattatacagtttgcaaagcctaagacatttatctagtcctttacaggaaaagcactgtagaccacagccctgtattattcatgacattatttttcaaatggccagaaacacatacatttaattcctgatggtggcaacctctggacggggaggagggaagaggaatggaatgggggacaggtgtcaaaacgtgccgtaatgtttgtgaatcgcaatttaaaaacattgtccattcttcacaattattgattcttcctggtgagaatacctgtgtttcatgtattaaagtccttatatttctctgtacttttaaaaaacctcagaaaagctaaaaatacatgtattgtgtaaacatttttctgtatcagtgcatacaaatcatatgtgtataacagttgaatcttagtctatcttatagatagcagatgtttctttttgagtcccttatttataaacatttaagttgctccagtttttggtgtcacagtgtagcaatattttcatactatttcttgtgtgtgtgtgtgtgtgtgttttagagacaagagagtacttactctgagactttagagacagaatactcttactctgtcacttagactagagtacagtggcacgatcctggcttacttcagactctacctctcaggctcaactgatcctcccacctcaggcatgggctactatgcctggctaattttttttttttttttttttttggtaagagttagggttttgccatgttgtccaggctggagtgcggtggcactatcgtagcttactgtagccttgaactcctgcctcaagcgatcctcctgccttggtctcccaaagtgctgggattacaggcatgagccactgtgttattatttctactgaacaaaatactgaaacaattttttgatcagaaggaaatatacatataaaattaggatatgtggtgccaaatggctgttccaaacttcagcatgaaattattgtcttgaagtagagcaaatgttattaatttggagccagattggtaagtgacaagtggtaagttattactgctttaatttgaggctcaggttgtctctctgaattttcaggctaatttatttttacctgtaatgcctgttcggatccttagaaatttttttctattgaattttagtctttttctcattgatttggggactcttacatattacatatattcctcctattcttgaaaaattttcactttggttttcgtttattagttttgttaatcaccttctgccacttagaaaacttgacattgtatgcagtcactataaaagcttttctgagcttttgcctttgctttctccgtagtttgtgatatgctgagaggctcgcttaggtaactaacgggctccatcctctcccggaaccactggtccttttgcgttctgtggggttgacagtcctcccggggtaacccgatgccttccttctgcttcagacgacaggcggccctaccctaaatgcgttgtcccatgtcagtcagcaggtttggttaggaaaacagaaagcacattgagtattacaactaggaaggaatttcacgcagagtctggcaggctttcatggacgttggcaaggatagggtgtgaaagtctggaaagttgctacctgcagatcaaggaatttggaagttcagggatcacaggacttgatctctgctgtccaaaggactaaagaggtgattgtcaggaggatatgtgggagctgctggaagaacatcacatctgtcaccgctgatgtccacatgcttcctgaggctgtcaccagaaaaccatggcttctctttctttccctgttctcaaatctctcctgagcctctcattcattcagaatcctgctcattagaaagtctaggaaatgtattttccatactttcagtccttgccataaagagaagagactggaagggctaacacagtgctgagtattgacagacattacttggaagtagttttcactaaaggtcagatcaaattaaatcaaaaacatcctccatgcatcatagtttcattgagcactaggttgacatagtactgagcagtgtgtcagcttatttggcatgaaagaaccttgcttagaaaagagaaataagaaattagggaaagcgcaccttcagagtcaacccatatatatcttacttatttgaaattttattcaattacaatgttaggttcaaagtcagataatttattgaaataataaaacagaattttagaaaggtgatttgttgacttcaaaggtcaatgagaggaggacacaccagattaaaaactcgtctcagtacatagagacctgggacagtgcaattctgctctgttataatccctggattggatatgaaattaatgaagcccgttcatttgtacccttggtccagaagaaaaatattactgccaaattgcccagttgacacttgcaatcaagttattacacagttcatcctataatggcagaaaggatatcttgggaatcacacaggcagaattacataactttaactagcaaaggaaggtcccgttcagagctggcttattttttcccctagaattcatttccttcctcactgaagtctgctcttctgaagtccttctgcgatctcctttaactctgtttgaatttttgaggcactggtctccttttcgtggttagtaattttaagactactctagcactttctccctgtgtttaatctaagccacattgacaatgttgtgaggtgtcataagttcattcctgagtgccacaagtcactactaacaacatattatacttttgtgtctggggggttcttttgaattcttggacttaggttgaatttctaggttcctaagagagaaatacatatgtcgacatatatatatatatatatatatatgtcgacaaatatagatataatatatattaaaatatattatataaatatattaataaataaaatatatttactatattatatatccattttatatattttatatattttatatattataactctataatatattagatacatttttatatattataaatctataatatattagatacatttttatatattatagatatattttatatataatagatgtattataaatataaatgtaagatatatcatatatatgatatattatctgatatatgatatattatctgatatgtgatatattatcatatatgatatattatctgatatatgatatattatctgatatatgatatattatcatatatatgatatattatcatatatatgatatattatctgatgtatgatatattatctgatgtatatgttatcatatatatgatatattatcatatatatgatatgttatcatatatatgatatattatcatatatatgatatattatctgatatatgatatattatctgatatatgatatattatctatataatatagatatatgatatataatatataggtatattataaatataatatagatagatttttaaaaatatgtatatattaaagccattgaccttcatgtagttgtaacgctgcaagatctctgtagtacaacatcaacatcccagcttaaggggggataccttaagctggtgataccaagctgtgataccaaaacacagacttacgctgtcttcaactatcttaagctatctgtcattaagagatttaaaaagaaaaaaaacctatggaccttcagctgtattgctacaagatttctgtttatgacttcccaatttacaaagaactttcacgatcacttatctcatggaaccttcgtgactttatgaccacctgtgcaggagaaggggaatatattctcagcctcattttatagaagaaatcgaaactgcaaaagattaaatgaattgcccaaggtaacctagtcagagatggcaagaaatcttcagcttcaaattctatcatcttccaagcttcctagacataaatagaaatgtctatattttccagtttaagctacaaactgtaagatgctgtaattctttgttagtcatgtgcactttgggtgaggatttccagaacttgttttttaaaaacatctggaaacatcaaaagcataagatttttaagagggaaattcatgattttctactaacatgtcaaaatgtaaattttaggttaagattgagtatgtataatttattctttaaacagtctgtaatcataagtaaactcaattgaaagtttaattacatgtttattttggcctcacttaacaggaataaaaagtttattttgtaatgtatttttataaagtcaaggaagaaaaaataaaatgcaaaccacaggaaacacacaaataagatgcccttagtacaaatgtcttttgaaactcattagctattactgataaagctctagttaaaactgtgcaattagaaccatgtgtgaaatagttgaatgtgcaatcaagagtgaaagaaaacatgcatgttttgctttattttattttattttattttattttgagacagagtcttactttgttgcccaggctggagtgcagtggcacaatctcagctcactgcaacctccacttccaggttcaactaattctcatgtctcaaactcctgagtagatgagactacagatgtgcatcactgcgcccagctaatgtttgtatttttagtagagacacagtttcaccatattggtcaggctggtctcaaactcctggcctcaagtgatccacctgccttggtctcccaaagtgctgggattaccggcatgagccactgcacctggccaagatgcatgctttttattaagaactaaagtgtgttataattgggttgagtttctacccagatggccccactcatgctgacatctgcaaagtgtatgtacaattgtgttgaggtgttatctactgtggctgtgtagacatgtgttactgagttaaaaaccaagactttggagtccctcatgctgattcctgctaacacatgctgggaagcctctgttattcagagtaggcagaatcccatgtgtttcactattgggaaagatttggaaatatttagagcagttataaatatatggtcttcaatatgaaatcaataactgaagtgtagattcaaggataccagagtctacactaagtttgcaaaacagttacctctgaaatgcaaatcttaagaaaatgcttcttttaagttgtgaaatgtcatggttgaatacatattttcatgtcatatttatctaatgggagtcatgctcttagacttaaacaaagagaaatccccctctatatgaaaattggtgctcaagttttttttttaattgacaaaaactgtataaggctgggtacagtggctcatacctgtaatcccagcactttgggaggccaaggtgggaagatcgcttgagttcaggagttcaaggccagcctgggcaacatagcaaaaccttgcctctaccaagaaaaaaaagccctgcatggtggcatgcacccgtatttccagctacttgagaggctgagatgggaggatcacttgagcccagagaagtcgaggctgcagtgaactgtgatcgtgccactgcattctagcctgggtaacagagtgagaccctgtctcaaaaaaaattgtatatatttatcgtgtacaatgtaatgttttgatctatttatacattgggaaataattaaatcaagctaataaacatattcattacctagcatggttgccttttgtgtatatgtgtgtgtatattaagaatgtttaaaatctattctcttggtcacctctctgtacaataaatctccataatttactcatcccaactgaaactttgtaccttttgacaagcatctctccaatcccttctgccctccccagcctctggtaactaccattctactgtttgcttctatgagcctgacttttttagattccacatataagggagatcatgcaatatcggtggttttgtgtctggcttgtttcaggcacaaaattatttgtgccttagcatgatatcctcaggttcatccatgttgtagcaaatgagaggatttcctcttttaaggcaaaattgtgttccatcatatacacaccacattttctttattcatccgttgaaggacacctaagatgatcccatatcttggctcttatgaacagtgctgccatgaacatgggggtgcagatatattttcaatatgctgatttcctttcctttggatatatgcccagtagtgggattgctggatcatatggtagctctatgtttaattttttgaggaacttcctttaatgtttttcataacatctgtactaatttatattcccaccaggagtatgctaggggtccctttcttcatatcctccacaacacttgttatcttttgtctttttgataatagccctgctaacacgggtcaagtgatgtcttacagaggtttaatttgcatatccctgatgattagggatgttaagcattttttcacatatacctgttggccgtttgtatgccttctttcataaaatatctgtccaggccctttgactaatttttaatcaggtgatttgttttcttgctgttgagttccttatgtattttagatgttagccccttatgtacgtatagtttgcaaatattttctcccattcataggttgcctcttcactttgttggttgtttccttggctgtgcaaaagctttttaggggattggttgggtagcgtgcattggctctggttctaggtgggtgcagtagtatagtttctctgaagcttcttcagctgtgattaacatcagtgatgacagcaggatttgtggacacggtggtggcaaagtaagttgttaggctttttgatagcaagagtttcagaaatctttctgttttcatttttcctacagtgagaagacatagccaaggagatccctctttgtgttgggtccaacatggactgcaggcagccacggggtgctatgtttcaggcacaggtgctcagagtggctgtggaactggggtcctgtttttgaactactgtagcccctgtgacgagggcacaggttcactcttcaggtgtgggtagatgcagctctcccaccaagccaagggctgtgactgcagcactcacctgtagccgaggcccaggaggcagggatggagctatgacagtgatcctgggtgtgagggtgcagcgctggcatggctctgcagaggaagaggtatttcagaggctcaggccctggaaagtagggcacagctgcaattcaggttctggagccaacagggcatatgagaaaaaataccacaatgttgactttgaaccctggagtgctggacacagcagtggaccaggctctgtgaggccgggtgcgaatgttggcttcactccccagggaggtggggagcctcagcagctcatgcaatggaggtctgagctccagcacttaagggaggtgggtgctgctgccatttggcccaatagttgggtagtacagctcagagaaagctaagtttcccggagagggtgggcaaagcacgggctcgagtgcagagtcacagctgcccctctgcaccaaagcatcaattccctgggaccaaagctcccttaagtgctggagctcagccctccattgtatgagttggttctggcgccgaaggggtgcagctcctctgtgggtttggattcagcttttctgctgggcccacactctgagtagctggcagcagggcacagtggcaactgggatgggcagatgaagggcccagagcgtagggagctgcagcaggttggctggggattggtgcacgctgtgtgtctgtgtgaggatagtgaatgatggcagaacctcaaggatggagggatgcagtggctagtggcccccagagcgggatgcactctagcagtggctcctgtttccagatggctcagtgcagtagctgctctggtcacaggagtggggtacaaagtgagctccgtctctggagttgtgctgctgtgtgaaatgcaggtagctccccagctgggctcagggcttgtgaggactgcagaattctcccgaagcaaagactgcaggtgtccacgacagtgatggggctcaggaggcctcctgctcatcttttccttcctggttctgagttcatcctggcttaggagatgaaatggtggaggcgagagggtggatcacttctctctgcggccatccggagtttctattctcacagggtttttgccactcccttgctgttctccagcgatctccttaagttagtctggttgcaatgtagttgtctgttattgttttggtccttttttgtaagggagcaagtgttaggcccctctagtctgccatctggctgatgccatctgtcctaagtactttttaaatgctattgtaaatggggtttttgtatgttgattttgtgtcctgccattttactggatttgtttatcattttcaaatagtttcttggtgaaatctttagggcattctatatataagactatgtcatctgcaaacagggacgatttaccttcttttctgatttggatgtcttttatttctttttcttgcccaactgctctggttaggacttaaaagttctatgttgaatggaagtggggagagtgagcatttgttcctgatcttagaggaaaagatttcaacttttcactgctaagtgtaatgttagctgtgggcttgtgatgtatggctttcactgtgtgtaggtacattccctctataactaacttttaaagagtttttatgttgaaagtaaattgaattttgtcaaaggctttctctgcatctattaagatgatcatatggtttttgcccttcatctcattaatgtggggtagcacgtgtattgatttgctatgttgacctatccttgcattccagggataaatcccacttgaacatgatcaatgatacttttaacatgctgttggatttgagttgctagtattttgttgaagatttttgcacttatgtttatcaaggatattagcctgtaattttcttttcttgtaatgcccttgtctggctttggtatcaggataatgctggcccttggattatttccttctcttttatttttttgagacagagtcttactttgtcgcccaggctggagtgtagcagcacaatctcagttcactgcaacctccacctcctgggttcaagtgattttctcatctcagcctcccaagtagctgggactacaggcataagccaccacgcccagcatttttttttttttttttttttggtattttttggtagagacagggtttcaccatgttgcccaggctgatattgaacttctgttctcaagtgatcgtcccgcttcagcttcccaaagtgctggaattacaggcatgagccaccatacccagcctcttttcaatttttttggaggagtttgacaaggattggtattagttcaagtatttttaatgtacaaatttattatgtgttttaattggctgccacattttacaaattattaactcttcctatcttctttgacagacaacagaaagatcagagttaatggaaccaaagaacctatcgagttcaaatccaatcagtggtttggagcaacagtgaaagctcacaaaggaaaagttgtggtgagtatgagccgtgggcttgtgctgctgctttggagtatggtgtgcactggaatgttttcaagctcatgtttaggaaagctctttcctaaaggaacatgttagactttcaacgataaggctgttggcattttaaaagcaactaaatgcttaaaattaaagaatgtattttagtgtttaaagctataggaaataaagcctgttttccagaagagcagttaaatattttcaaatatttcaaaaacaactaagaaaagtaaaagctacatcttaaagtggtaaaatattatagtgcttaagactgacttaggggctacttaaaatctgaccagaaaaatgggactattcccataaggatgctaagttaatctgctgtggtttcattgatcctttttacaccgaaaggaaagctgtctttcataataatttttaaacggctaactgcatgattctctgagttcattaatactttttaaagtaaaaacactcattctcaaatagataatctttcagcttcaaagtgctatgacttaataattctattattttattgttctgagcaatgatacatgtctaagttaccgagaagaaaatgactattgaagtaatctggaagtcttttttagtttggggattttttcaacctattggctttaatttccttacaacaataaagcaataactttggcttttaggatttgttgaaatctacttgaattatgatttaataagaataagtatctaaaggaaatgccttactttatttagtctgttaaccccaaaaagattttgacataaaacaggtaaggtataaagagtatacagccctctccagttaagaaatccaacattcacaatatagtttttgtagagttgtctttgcattaatataattttcacattccagaatttgtaagaactttttaaggtggtatatgccttatgggaattgctgttgaaaaattaactctgtaataactgtttggggctttaaaaatcttttggatactgttttgatttttttgtgtgtcttgaaattttagctgtaacatataatagttgcatatttattcaataactgtagaaaccctcaaaacaatggaaactacaataatacaccgtgttcataataaaaaatgattaatttttggcatgcctgcattttctaaaatacgtgatgggaaataggataatacagagtatatttcaagctaaattttttgagtgctgaaacttagcagaatgaacatttaaattctttcctatatggtataattttataactgcaaaatcctacctccagaagtatcatttttgtatatccaggtaccatgggtatacatagcgggtttgggtcaaagcctaaatatgtcccatcagtatgtttcacatcaatgtgaaactgagcagattgaaagagtaactttttagagctaatatcaggcaaacactagaaagaattttcatggcatgaaatgccttttgatgaaacagaaggtgaggccagttggagaagatcaagctacacaagtgaatgcttcatgatgtagacttccctgtgctttcgcatctgcaccttatgctgaatttatgaaccagataacttggggaacctagaagagttagagagttttggggtattggccaagactttacaatatatagagaggcaaaaccaaacaactgaagttgtagaagggtaatttatttgagactaggagttatctttactaaaaatagttatacattgggccaaattaccaaggacagatttggaagcatagactactttcaaattggaatcttttttcacttctctggaattaagtgtgataccatactatcaaattagaaggcaggctagcagctctgtgttctacgattctgtctttagagatgagtatttggagaatcaggtacaatatttacagaaggttcaggcaagaaaaacagaagtccaaaccaagctaatgttttatatgcatttatttcctctctcattcctaacaaaatgttatttcatttacttgacgaggatttctcgttatttcatttacttgaagaagatttccatacagtgctcttgtgagaatctaaacttctaaaaaagcagccagatcatttcatgtttttcttgctgttgtttcaatttatttttgccgataatgtttctgatattaggcaaactaattcagaagcagttccctctttttaccataatgtaattctaaaaaggggtcataggcaatgacataaagtatgtcttattttctctaaagcaacattctgaaaatgaaaaggcatggatgaggcatcaaatcagtttctgatatgacaaattataaatcataaaagcaaatatataacaacaaatgcataatcatttggtattgtaaaattatgtttcaacttctatctgataggcatgcatttaattcaacatgttatacatctattaatcaagttttatatgcaaaccttcatatataagtcctgtgggcagttaaatcaattccaaaaaaggttccaaagtatgagcaaatatttgtacagtacgcaacattatttaatttaccactctatatgttagctggaaataagcataggacattttgtttctaaccctttggttatttgccgccttagaatggagagggcatttatgaaataatttggataactctcctttctcaaaaagattgtctgagggcactggagtttatctcgataaatttctccataacaaggagggccagagacttgaattgcctcacctgtggtgtttaatgccttggaaatgcttgtagctcatgaacatgctctcttactgactttgtgatcatccctgataaaattgctaaaacaggcataagatgcttctactttcagttttgccatgaataaaaaccatgaagtgaaaaaccaagccaaaaacactgtgaaaatggagaagtgcgtccagatgaaagtcattgtttaaaagtcataagatgcggcttccgtgataaactagggggcgtcacaaaacagaggtttactagcttgtttgcatcctttaatttgaaagtcatcttttaaaagcaataattagacacagaaaggaacttgttctcataagacatcacactgattaattcactgtttacatgatcatttgcttttatgtaggtccaattaaaaagaaaagaaatatgagttattcgcttttaggaattaatttctgcttgcttcttcgggcaaaaaaaaaaaatttaatttctatggggcctaggtgctgtggctcttccctatatttccagcacttgaggaggctgagacaagaggatcacttaagcccaggagattgagaccagttggagcaacataataagattctgtctctacaaaaaacaaaacaaaacaaattagccaggcatggtggtgtgtgcctgtggtcccagctacttgggaggctcaggcatgaggatcacttgagcccaggaggttgcggctacagtgagctgtgatcatgcctctgcactccagcctgggtgacagagcaagaccttgtctccaaaaaaaaaaaactattgtcagaaaactcatttttttttgcatgtatttaattttcaccaattctacagtgtgttaacattaaaaattagttttggaagtttaattacctctgatgaccaaggcactcattagcatgctagaggccaattaattcacccaataatttaacagtttgttataccaataattcaaataaaactgtagtatgagaaacctacatcaaaaatgtatttttttgtctttgatgtttcctaggcctgtgctcctttatatcactggagaactcttaaaccgacaccagaaaaggacccagttggcacctgctatgtagcaattcagaacttcagcgcctatgccgagttctctccttgccggaacagtaagcaacttttattccttgaaactgacattagctcaagtgcttttctatcgtagacaggagtgcaggtaggctcaaaacaccattgataacttacagggttgcaaggaaaaagcttcgggggtaggtaaagatttttgtcagccttacaggtgtcttgatgtgacagcaagtcaaaagcgtggaattctactgatcttctgtgttttagaacatttctgatttaagatattttgcagaattgattggttccttattttaggccataaggtgtcagttgctgttcaaaattcacgttccgtgtcctaaagaatgctgactgcccactttatttgtttattgccaaaacggtgttagctagcatggttggacctgggcatatgttcaacttgagatttctgtctggcttgtgttctcaatggctgtttcttctttaccagctgtgtatgcagattgtctgcatgatatgcctttctgcttaagatgtttaatcctttttttcaaaatgactctgtatacttagagttcaaatctcatctggcagttctaggaatcttgcagccaagcagtctttaaagcaaacctgggagtgtcatctttggggcattgtgttttaatcactttatctctgttgaataccccagacttgggatagcataatggatggatggatgggtgggtgggtgggtgggtgggtgggtggatgggtggatggatggatggatggatggatgggtggattcatctactcagagtcctttaattaactcctccagttttcagtgtgccagatagatcactaggatttgttgataagatacctatggattttcattcttgttgataattcacaagaccatattggagggaaaatgtagtagaaagaagattctaggactgatttcaggaaattgacttaaagaaaaaacactaaatcccaaattagcttgagctctaaaatgtaaattttcccccttttgcctgagtgtttttaaaatttcaggattaatgtagggaagataatgatcaaatgccataaataaatgaagagaaaaaatcgattagtgatattagagggttaacaaagaggctgctgagatttagaagcctaaataacaggcagtagaaatttttttttttttttttttttgagacagggtctcactctgtcacccaggctggagtgcaatagtgtgatgatcatggctcaatgtagcctcgacttcctgggctcaagcaatcctcccacctcagcctgccaagtagctggggccacaggcatgtgccaccatgcctaatttttgtattttttgtagagaggggtttctgccatgttgtccaggctggtcttgaactcctgtgctcatgcgatccatccgcctcagcctttcaaagtgctgggattacagtcgtgcgccgccacacctggcttgaacatttaacctgatggcttttagtgaggatttttaacaaggagaagattattgctttctgtttaaaaatactgaggtaaatcagacacttcttcagattacaacaaatgtcagctgaatggatagtccatggaataaggattttattttaaatagctttaaagtaggggttctttgtagttcatgggactcaattatttattcaatgcaggatttctttaaaaagaaaaaccacacattgagcagtaaactaactcttctatgtttaggaaattcagcaaagaacaagagggaaaaagccccctgttcaaggaactgcctctagacagtaaacatgtaaataaatgtgtttatgatgcaatgtcaggcagtgaaaagtgctacaaaaaaatacagcaagacgagaaagaagggagagacctgtgctggggaagccaggggaggagcagcattttagacaagacgatagaaagggattcttctagcaaatgattattggaggagagaagagagaaacttcccggactcaggcaacaaccaacatgaggcatagtttgtgtcatgttccattcaaagtgctgtgctcttgggtttattaagaggtcagtattgttatgctaaagataaaatcccacaaacaataacaaaggatatccaaaatatatcagaaaatgaatggtagtggagagattcattattgaacttttcatcaatatttacacctgtccatatcctatactccatgatttgcccatgttcctgttctgtgatattgaccatatgctcatggacaagctggcttgttcaacaaacagcaaataactgtaactaaagacaagaccatccttcatatgccttttgccttgataatgtaggttattcttccaactgccttgaaggatgatatttataaaactagtcactccttgttctgcctttttgccagactacctgtgtgggatgtgagggctcagatcaaaatacagcacatgaaatgcagacttgtaggggaaaagtttcagagtgagtttgaaccatttttttaaaaagtacactaatgtacatttgcatcttaagctacatggacacagtagcctaacagctcaacaaagacagaatggagcacatgttgagttgcagaatagctcaataaattgccatgaattatttcctttgtggtgtatagccacagttttcacatcctcctggtctccctattcctacgggtacttcttcctcctcagatcatccaagaagcagacttcccgtcatggccaagaagttcacagatcattaacacaaagccagcttgttcatgagcatatggtcagtatcccagaacaggaaacatcagcaatattattttcaaaagagaatttaaagaagctcctcatgttaatcttataccgcaaacccgctctgctgatattgttagacattacctgctcattcatattgatgacctgcctatggctctcatggtcattcataattcaggtggagatggttcatacacacacccttccatttgttgggtaagacgtcaacaaatagtagcaaattatccacatgcttccttggattcctgagttcactctaggacataattatcaagttcacaaatgctctgaagtcccaggaagaaagagtccttcagctctcataaattatgattcaacaaggaaaaaaaaaaagactttgcaatggaaagaacctcacactctattataattgccacttacaataaacatttggagctgattattttctcagtgtattttgtaaaaaaaaaaaaaatgaatgttttctcttaatttttttcagcctgctgttttaaagcaatactttcaaagaatggtcatgtttcttccctttcgaataatttacaatcataaaaataaaaagtcagggttgaatttaaaagggatttttaaaaggcttgtgcatggaaaaataaatataaaaacacatatgaacacatatatgttcagagtaatatctcatgcattcatatatacttctggatgcatataaatatttacacatatgagcttctagaaaattgatacttagatattccagattatagagatgagcttttagggaactttataggattcatgaccataaatcatgaaatatagcggtaaaataaggaacaaattttgttaaaatacagtgcatgaggttaaaaagtgtttttaaaaataaaggactcgggaggctgaggcaggagaatggcgtgaacccgggaggcggagcttgtagtgagctgagatcgcgccactgcactccagcctgggcaacagagggagactccatctcaaaaaaaaaaaaaaaaaaaaaaaaaaaaaggagcatctggaaaaaattgatggtgacagcgctaaaactagctaactaatgaccaaaggaaagaaaaaaccggaagacattctaagggaagccggaaaggccaggtccatttcaaaaagcttctgaacaggcgcatgcccagtcatcaatatttcctgtgatgacatgtatttcctttcctgttctcttatttcagtttccattgaggaatatccttgataagaaagaaataattatttacatgtccaaatctaactatgcaggattgagattccctctacttaattcactacattttggctattttaggcatgttagaagttgtagaaactcttttaaagtacaagttacaagtagtaaattcctggtcctaatgccctacagacttttgataacaatagccttgaaatcaacgtgttggcctgcctatagcttacaactgtaccatgagatcctattggacaatgagttagtgaatcatattggatagaaagcaagataagccactactagaattttctcttttgtgaacactagcattgcaatgtccagtgagactgtgaccagaaatgcaatttcccaatttacctagcctattataataggataatttgtttttattattattttgtttgagttggagtcttgctctgtcacccaggctggagtgcagtggcatgatctcggctcactgcaacctccgcctcctgggttcaagagattctcctgcctcagcctctcaagtagctgggcctgcaggcatgcaccaccatgcccagctaatttttgtggttttagtggagatggggttcaccatgttggccaggatggtctcaatctcttgacctcatgatctgcgcaccttggcctcccaaagtgctgggattacaggcatgagccaccacaactggccataataggataatttaaaattaagttcctcttaaagagcgtaacagtggaaatgcttattggtggcccagaagatgacatctacaaaggtcatcttgcactgccccttcttcctcaaggtgtcaacttttgggaatgacagacctatctgccttcacacagcacgagggggcaaaagagagacacgttattgcctcatgggaaatttggaatatagtcaaagatagagattttatttcttcaaatgaaagtgagtcataaaacccaatagagtagccaaaagggatgttattcctgttgatcttactagagaatcacaacgctatttggtgtaagaaaacagacagaaatatgtttaataaattacttgaacaacattttaaaaataaacataaaacacatattgatcatttttaatttagaaggttctagagaaaataacataatatcctgaattggttattaaaaaatatttcaggaatgataacgttataacatttatgtattttgatcgttctaggcaatgctgatccggaaggccagggttactgccaagcaggatttagtctggatttttataaggtgaattattttggtctcgcagttcctaatatttaatctgatttttttttaccctctgcctctcactcccacaccccaaaaccaccaccaccaccaaagaaccaaagaatcttgaggaacatacctagcctgtttgggcaaatgctttctaaaaaaatttttccattcactttttatttttatgtaaataatttatgcacatagcggcctattaaatagtagagaaatagacatgataaaaagcaacagcctttcttctgatcctttgtggcaataattttttaaatgaaaatctaaaaaactcagtaatgtttcttaaaaagatcacatgaatctattcattgttttgttaactgtaattgaccagttacatttaatattaatattaaaattcatatatcctttcaaaaaattaaaaagagatgttcagtaagaatgtagagggaaaagattctgtggttttgaaaatagtatagaaaaatttcatcaacgtataaactgtttactgtcttttatcattctttttatcattacttttttgtttttatattttccactgagagttaaagatatgaggcacgaaaggtgaggatgtcaattcatgagaaaatgtttatatttgctagtctggagtgtttgctctttctcctgagaagggggtggcactggggatgtatggaaaaaaataggcattactatgtccttgaaataaattggaacagaattttatttctatcacgaaggctcaaaagaccatgtctgcaaaactgcacagcactaaacatgttgatattttgcttatgaggcagtgccaaaaaacagaatttatctctctcaagggagagagttcaacttacctaattgagtcaaattaaaattatttaatatgataacacactaaataattgaaaacaaaagaggaaagaaaatgaactgcaggcctccgaaggatctcttttaaaaattgctttttatgtgtaacaaattgttagagcaatgcttattaacaacaatttatcaccctttaaaaatgtttagtatttcttttccaattatggttgctgttgctgtttctgttttgtagaatggagaccttattgtgggaggacctgggagtttctactggcaaggtatgttctgttggcagacaagaaaagcacatttgttgttactaacagaaggatggacccagaagtagtgttaaatgtttactttctattaccttaattttatatccttattcatagtttctcaaatgaagcgttatttcttttttttgcttttaatattttattttaattgacaaaacaattgtacatatttatggggtacatgtgatattttcatacatgcttatgatgtgtaatgatcaaatcagggtaattagcataaccatcacctcaaacattgatcatttgtgttgggaacattttaaatctcttctagctatttaaaaatatgagataaattgttgttaactatattcaccttatagtgctatagaatgttagaacttattcctcctaccaggctgtacttttgtgtacattaacccatctctggctatacctgaatctctattcatccttgcctctagtaaccacttttccactctctacttcgatgagatcaacttttttagcttccatgtatgagtgagaacaaaagcatcatttcgatttgtactctcatttgttttctgttttttttctgagacagagtttcactcttgttgcccaggctggagtgcaatagcacaatctcgacccactgcaacctccacctcctaggttcaagcaattctcctgcctcagcttcctgagtagctggtaatacaagttcccaccaccatgcccagctaatttttgtatttttagtagagacggggtttcaccatgttggccaggctggtctcaaactcttgacctctggtgatccacccgcctcagcctcccaaaatgctaggattacaggcctaagccactgcccagcctgtactctgtaatgtaaataatattttaaaatactcttgcaacttaacaattcatttctccatcaacaatgtgttgaggctctgccaagctctgtggtagaggctggggacacattaatgagtaaaaacagacattgttcttactgtcatggaggttagtatctagagaatgataacaggcattaatcgaactgtcacaggggtacccaagaaaccccaactgtgatacacaatccgaagcaaaggcatgtggtgatggggctgggagaaattaggaggcttctcctgggtggctgtggacaggtgtgttttgtcctctgaccactggctgacagggagctggaatacaacctgtgctctgcttatggagccatgaacccaggtacagacagcatctgctgagaggaaattacgtcttctaattcttgctaaggtgctgcataggccagcagcaacgcaaagttaacttggaaagcaaacaaccctgaactgagatctggaccttacgtaggagtacctaggtgaagagaagagggaccacgtgcagatgtactgtgggaggcaggagggcagcgtaggtgagaatggaggaaagtcaaggtgaccggagttaagagagtgagggaagaagagcttgggtggtatggagtggcccgctaatttcacaaaagaatggatgatgtgaaattaacattattatgttaataaaaaatttatcataaattttcatgatatttttaccataaattatgttaatttcacatcatccattcttttggttgaaaaaacgtaggatacaaatgatttgctgaaaatttaccatagcaatggcatatacaagcatttgtctgagacatagaaatttaaaattttattcaggtttcacattgaaggcttgcagtccatgctaagcagttttgtctttattctacaaactatggaaaaccactgggggattttaagagtttaaatagatggctttagctagagtaagaagatgttgtttgtcctgagtgtagtgacaaactatgaagtgagtttaagcatggagtgctacaatcaaattatgttttgaaaggatcattctggctgcgttacagaaaatagattgaaagttggccaaggtgaaatatcagcaaagtagttacaaggttgttacaaggatataaactaattttaagtttataaggtaaacaagttgtataagtttcaggtaaagttgtctgtttcttagagcgatggtggtactgactgtaaaagaagagaaatttgagaaatactttggaggcaaaataagcagcctaaatgatgggttggatatatgctggtaagggaagaaaggtggtaagggagtgtttctgacgcctgctactgaatggctgtaggtgggtgccgctcactgagatacagaacactggaagaggaccagtttagagtggcctggagagggaagatgatgagtttacttcttgttctgttgtgtatgaaaatatttgagatacccaaagggtttcacctaagtatttagggcttaagcccagagaccatctagagtgaaatataaattttcatcacttcatactggtgataactcagtccatgggtatagatgggaggcctagagagagaatactgagaagattctataatttgggctataaagtttaggacagagtagaatctgagattaagagttgagggaggaatttttttaatggaagaaacttgatcatgtttaaaagtcattgagaaagatccaggagagatagatttatgatttttttttttttgagacgagtctcattttgttgcccaggttggagtacagtagtgtgatcttggctcactgcaacctctgcctcccaggtttaagtgattctcctgcctctgcctcctgagtagctgggactaaagttgcatgccaccacacctggctaatttttgtatttttagtagacagggtttcacaatgttggtcagactggtctcaaactcctgatcctggtctcaaactcatgatccgcccgcctcagcctcccagagttctgggattacaggcatgagccaccacacccagctgatttatgataaaattgtatataaacttaatgttaagctcagttcatgcatatacaattataaacatcaaacaattaacattttggtatttaaaaactactctgcaaactgaaaaactatatattttgcacaacagatggctacaaaattaaaattatatttacggaaggttttcttctaattcacttggttaatttcacataatccattcttctccttaaactgaaaaaatgtctgagacaaatgatttgctaaaaatttgccatagcaatggcatatagaaacatatgtttgagacatagaatttaaaattttattcaggtttaagatgataatgtgtatatgtgtatagacatagctaaaggaaacagcaaagacagtgtgtatgtgggatggaggaaagagggtatttagctgtaacccagagacaactggcaaattctacagacagtgttcagaaactcatgtgtaaataccatggtcttaatatcagaatagtcatttcaagtcccagtcacttggcaatatttatgatctagtttgacagtttcattcttttgtggacttccaacagaaagactgtgggaattttgtgtgaattcccaaagactaatttggctttcaaattaatgttaaatgatagtcttttgaacgcatttcttcagttttctgccaaagagcatgatatcacacttttgccttagatgtccatggtaaacatgggaatgcatagaaattgcagcggaaattgctggttgtcttttagatacttgtctaccccaaggcaatcgtatttcaagacttctgacagtgacttttgagagagattaaccaaagttcttatcacgtcaatgttggtgcccatggatttctcttttgctgaattttggatctcattggacctagctgcttcccattgtcctaattttatgctctctctatattttagcaagaaaagcagatggctcaaagagtttacaattccttcatttaacttagctgatatattttatcatctattaatcagatatgtgatttagattgaatacagtatctatgctttgcaagagcacaaaatgttttattagaataccaaaggaaatgttggctgtaatgcctgatatcctattagcaaaaccatatgaccttagagaatgcactgtagctctttgggcttcagtttctccacctagaagaagctatatttgaccaaatgatctcaaagcttccttccaggtggaatattccagaataaaaattacatcatggccgggcgctgtggctcacacctgtaatcccagcactttgggaggccgaggcaagcagatcacgaagtcaggaatttgagaccgcccttgccaacatagtgaaactgcgtctctactacaaacacaaaaaattagccaggcgtggtggtaggtgcctgcagacccagctacttgggaggctgaagcaggagaatcacttgaacccgggagacagaggttgcagtgagctgagactgcaccattgcactccagcccaggcaatagtgcgagactctgtcccaaaaaacaaaaacaaacaaacaaacaaacaaacaaaaattacatcacataaattttacttgcaaatttggcctccactcttggatacttttatcatttggaggtggagtgtgtatgttaaaagcagcaggaagaccaataaaatattgtagttcatctcaggtcttctgtcagaatggaaagttctacccagctgtaactaactctgccttggagtttgagcggcaggcgggaaaattcatcatcaaaaaagcaagcaattccaccatagctttcaagggaatgtgggtctgctcatggagggcctgcctcttgctttcattcagttaacgtattaatttgtttaaacacaggacaagtgatcactgccagtgttgcagatatcattgcaaattactcattcaaggatatcctcaggaaactggcaggagaaaagcagacggaagtggctccagcttcctatgatgacagttaccttggtaagacccattgcccaagacatttgtggtttttcaaaagacaagcatagtaaatgtagatgcaagttttatccctgacttatccgatgttatttggcatcttatacaaatgttctcttattagagtggactcaatttttcttttctttttaatactgctatttttccagccgcgatgtgtaatacataatgtgagcagctattttgttggctccatagcagttttttgcacatgaactatttcaccagtagtagatactatgtattagcagggctgctaccagtgtgacagggacaggatgatagcagccttcttagttaacagagacgcacaagagaagtttgagttgctggaatattctcaaattatattatgcacaaaccacacaatgtcatttcaccactactgtttcccaactttggttcctagtggccatttgattgcttgatgaatttgaaaaagaaatgtagctatgttttgtcaatgtagccagcacctcactttagagctaaactaaattgtggaaaaccatcatgaggtattaggaagtaggtcttactggtgaccagaaatagcaaaacctgagcccaaaggaaatctttcagagtattctgtctcattattttcaatcagcagctcttaaaatgcaacagccaccatttactctcaaggtggattatgaagtatccatgcttttaaaattgacctcagaatatctccctcttttttttttttttttttttgctttgctcctacttaagtagtagataatctattatgcactcaggacttagtataaaagtgttccttttggtgtgattaatttttccctttatagaatctttaacttttataatatttgtagaggtttctaaataaagcagtaccatggtagccctttcacctttttctagatataactcattaggttaagtcattaagtgtgattagtttgtttctttttctttaaaacaggatactcagttgctgctggggagtttactggggattctcagcaaggtgagaggcactgttgagtttaaatcacttataaagcatggggaaatggtaaaatggcatataaagttttttctatcaatgtgattttatttgctataccaaagggatattaatggagtcccagagtgcctatactttgtagaaaaaatactttgatacagcattttaagtctgaaagaattttgtaagaatgaatatcaactttataaaatctagttaagcaataaaatattagggccataatcccatgttatgaatgaaaaatatagatgactaaatgccatactgttagtgacagatcaaatttgtgaaattaagatcccttcatttctagtacctctcatattggacatgtccaaaattactctccccaacgaactccaatccaacaccccaaccttacttgctttttcctcttttaacataccaaaaccccaaataacaaaacaaacgaatccctatctcctgtatatcccttctgtcctgtcttctctgctttgctgtggctgttgtctaccagggctgatggacatgaaataatgaacacagaatacctaattaaattatgataagtgctaggataaaattctaaacatagagtaagaaaagctgtggtgttaagaaaacggagcctgggatgatgacggtggggggtcagacagacaaaggggcaggggccaacttctatattctaaggtgtgtagaaaatgcgggtgttgaaggacctcagcttgactgccagactttgatagtgaaacgagattggcttcgagcaaagtctgggctcagctcatgtccggttttacgggtcatggaaacaattctgggatctattcaacgtgcaggggagaagacatgaaaggtttcagctgaggagtaaatataatgcaatcatgcttgtaatctaaaagaaaaaaagagaacaaatcacactggctgcctatgtagatttgattgagatgagagtaaggaagaatggtatcacatatatcacttttctcttcatgtctacctccttgaaggcaaggtctatgtattgttatgtattgttattatttatctcttttacaaagactagaccatgtgttgctcgtaatagattcataccggaaacagcttgacagaaataatttgaatctttggagtcaagatccacgtaggttcaagttctgacttcacactctctattccttaggctatgacaacctctctggttcttatttgctcatctttaaatgacactaatattaactaactcaaaataatgttctgaagattgcatgagctaatgcatgaggaatacttagatacaaggcaataaatgggagctttcactcaacgggtaatatttattgaatgagtcaatcatcaatcagtatttaccattttccatcttgtttcatatgaacactgactgcatttcactaatgcaagtggtttaattcacaaataattaagagtaaatggagttgggagccaagatggccgaataggaacagctctggtctacagctcccagcatgagcgacgcagaagatgggtgatttctgcatttccaactgagctttgaagagagtagtggttctcccagcacgcagcttgagatctgagaacgggcagactgcctcctcaagtgggtccctgacccctgagtagcctaactgggaaggaccccccagtagcggcggactgacacctcacacggccgggtagtcctctgagacaaaacttccagaggaacgatcaggcagcagcatctgcggttcaccaatatctgctattctgcagcctctgctgctgatacccaggaaaacagggtctggagtggacctctagcaaactccaacagacctgcagctgagggtcctgtctgttagaaggaaaactaacaaacagaaaggacatccacaccaaaaacccatctgtacgtcaccatcatcaaagaccaaaggtagataaaaccacaaagatgggaaaaaaacagagcagaacaactgctaaaaatcagagcacctctcctcctccaaaggaacgcagcctctcaccagcaatggaacaaagctggatggagaatgactttgatgagttgagagaagaaggcttcagaagatcaaactactctgagctacaggaggaaattcgaaccaatggcaaagaacgtaaaagctttggaaaaaaactagatgaatggataactagaataaccaatgaagaaaagtccttaaaggacctgatggagctgaaaaccaaggcacgagagccacgtgacaaatgcagaagcctcagtagccgacgcaatcaactggaagaaagggtatcagtgatggaagacaaaatgaatgaaatgaagcaagaagagaagtttagagaaaaaagaataaaaagaaatgaacaaagcctccaagaaatatgggactatgtgaaaagaccaaatctacatctgattggtgtgcctgaaagtgacagggagaatagaaccaagttggaaaacactctgcaggatattacccaggagaacttccccaatctatcaaggcaggccaacattcaaattcaggaaatacagagaacaccacaaagatactcctccagaagagtaactccaagacacataattatcagattcaccaaagttgaaatgaaggaaaaatgttaagggcagccagagagaaaggtcgggttacccacaaagggaagcccatcagactaacagctaatctctcagcagaaactctactagccagaagagagtggggaccaatagtcaacattcttaaagaaaagaattttcaacacagaatctcatatccaggcaaactaagcttcagaagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccaaattgtaaagaccatccaggctaggaagaaactgcatcaactaacgagcaaaataaccagctaacatcataatgacaggatcaaattcacacataaaaatattaactttaaatgtaaatgggctaaatgctccaattaaaagacacagactggcaaatcgcataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatgataaaaggatcaattcaacaagaagagctaactatcctaaatatatatgcacccaatacagaagcacccagattcataaagcaagtccttagtgacctacaaagagacttagactcccacacaataataatgggagactttaacacccccctgtcaacattagacagatcaaatagacagaaagttaacaaggatacccaggaattgaactcagctctgcaccaagtggacctaatagacatctacagaactctccaccccaaatcaacagaatatacattcttttcagcaccacaccacacctactccaaaattgaccacatagttggaagtaaagcactcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacacaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagtgagagcaaacacattcaaaacctagcagaaggcaagaaataactaagatcagagtagaactgaaggaaatagagacacaaaaaactcttcaacaaattaatgaatccaggagctggttttttgaaaagatcaacaaaattgatagaccactagcaagactaataaagaagaaaagagagaagaatcaaatagacgcaataaaaaatgataaaggggatatcaccaccgataccacagaaatacaaactaccatcagagaatactataaacaactctatgcaaataaactagacaatctagaagaaatggataaattcctcaacacatacatcatcccaagactaaaccagaaagaagttgaatctctgaatagaccaataacaggctctgaaattgaggcaataatcaatagcttaccaaccaaaaaaattccaggaccagatggattcacagccgaattctaccagaggtgcaaagaggagctggtaccattccttctgaaactattccaatcaatagaaaaagagggaatcctccctaactcattttatgaggccagcatcatcctgataccaaagccaggcagagacacaacaaaacaagagaattttagaccaatatccttgatgaacatcgatgcaaaaatcctcaataaagtactggcaaaccgaatccagcagcacatgaaaaagcttatccaccatgatcaagtgggcttcatccctcggatgcaaggctggttcaacatatgcaaatcaataaatgtaatccaacatataaacagaacaaagacaaaaaccacatgattatctcaatagatgcagaaaaggcctttgacaaaattcaacaacgcttcatgctaaaaactctcaataaattaggtattgatgggacatatctcaaaataataagagctatctatgacaaacccacagccaatatcatactgaatggacaaaaactggaagcattccctttgaaaactggcacaagacagggatgccctctctcatcactcctattcaacatagtgttggaagttctggccacggcaatcaggcaggagaaggaaataaagagtattcaattaggaaaagaggaagtcaaattgtccctgtttgcagatgacatgactgtatatctagaaaaccccatcgtctcagcccaaaatctcctcaagctgataagcaacttcagcaaagtctcaggacacaaaatcaatgtacaaaaatcacaagcattcttatacaccaataacagacaaacagagagccaaatcatgagtgaactcccattcataattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattttgaaaatggccatactgcccaaggtaatttatagattcaatgccatccccatcaagctaccaatgactttcttcacagaattggaaaaaaactactttaaagttcgtatggaaccaaaaaagagccggcttcgccaagtcaatcctaaaccaaaagaacaaagctggaggcatcaccctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactcattcccttccttataccttatacaaaaattaattcaagatggattaaagacttaaatgttagacctaaaaccataaaaaccctagaagaaaacctaggcaataccatccaggacataggcatgggcaaggacttcatgtctaaaacacaaaaagcaatggcaacaaaagccaaaattgacaaatgggatctaattaaactgaagagcttctgcacagcaaaagaaactaccatcagagtgaacaggcaacctaaaaaatgggaaaaaatttttgcaacctactcatctgacaaagagctaatatccagaatctacaatgaactcaaacaaatttatgagaaaaaaacaaacaaccccatcaaaaagtgggcgaaggatatgaacagacatttctcaaaagaagacatttatgcagccaaaaaacacatgaaaaaatgctcatcatcactggccatcagagaaatgcaaatcaaaaccacaatgagataccatctcacaatagttagaatggcgatcattaacaagtcaggaaacaacaggtgctggagaggatgtggagaaataggaacactttcacactgttggtggaactgtaaactagttcaaccattgtggaagtcagtgtggcgattcctcggggatctagaactagaaataccatttgacccagcaatcccattactgggtatatacccaaaggattataaatcatgctgctataaagacacatgcacacctatgtttattgcggctctattcacaatagcaaagacttggaactaacctaaatgtcctacaatgatagactggattaagaaaatgtggcacatatacaccatggaatactatgcagccataaaaaggatgagttcatgtcctttgtagggacatggatgaaactggaaaccatcattctcagcaaactatcacaaggacaaaaaaccaaacactgcatgttctcactcataggtgggaattgaacaatgagagcacatggacacaggaaggggagcatcacacactggggactgttgtgggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatgtggaaaaaaaaaagagtaaatgaaatatggtcacctctaggaatcatcacagatcctttcatagtttcatgggaaggtatacaaagcagaaaatcataaagttttgcagttcaggttgaagataatcaggttttattttttcctttgaaagaacatttttcttttaggtacaaactaattcataaaggacttgtcctctcattatgtcttcttcaaggtattaaaaggcagtatattgtaacgcttaagagtcctggactctggagccagacctcttgggtttaaaccctgacctcacttcttactatctctgtgaccttggacaagttaccaagcatcttagtgcctccaaattttttcattcctaaaataaggatgatgagctaatagtattgtctacctcctaagattcttctgagaattcagtgagttaactctgtgtatccataaaacagtgcaaggcctgatatctaaaaagtgctgttggctgttacaagaaccactgaattaggaaccaaagatagtattgagtaactagcgccttgaaaaaaggtcaaatctaaaaatcactaaaaattttacaaaggaaactgtaaaacatgccaaattattattttttttaatgtggcattaggagtattgttggactgggtgtggtgactcacacacctgtaattccagcactttggaaggccaaggtgggagaattgcttgagctcaggagttctataccagcctgggcaacacagtgagacctcctctcaaaaatacaaaaattagctgggcatggtggcatgcacctgtagtcccagcttaagaggctgggaggctgaggcaggaggatcacttgaccctgtgaggtcaaggttgaagtaagtcatcattgcaccactgcactctagccttgggtgacagactcagatctcgtccaaaaaaaaaaagagtcttgttggaaagctctcaagaatagcattcagttttgacccaagaaaataaataatgatgcacaagagtatattgtagggaaagatggtagaaaacagtagtgattttccatcagatctcagaaatatctgaaaaatggattgggttttaagtgttttgaggatatctaaaataaaaggatattttgtgttttgaggctatctaaaatatctaaaataaaataaaaagtgttttgaggatatctaaactagttaaaataaaatatctaaaataaaatatctgaaaatggattgtgttttaagtgttttgaggatatctaaaataaaagcactatcaaggaacatcgcaatcagctcaccagaccactacaaatccaggactgtgcatgttcatgatttacttaattagacaacagggaatgagaattctattttaaaaaacagtgagcacttcaatgtcctctagatgatgggttcttaatatggatcctcacactgctaggtgggacatgcataggcctcactggatcggaacccctaaaaattacatacaatatttaattgtgtataatttttcttgtgagaggatccatagctttcttccaattttcatacacgttcatgactcaaaaaaggttaagagcctttgttgtcactttagagtgaggtgtagtgagctaaaacccaagaaagtaatctgttcctaaccaattccaggaatgtaatttgatgtgttggaaagaatgttgactttgctgtcaatttttgacttgtactactcaccaactatgagttcaatggtgatagaacctttctaagctgcaaatgaaggaaatatttttgcttctcactagtcaggatgctactcaagtcatgtgttcctaggtcaaggatctaaatttttcctgattatattgattattaaaaaccttctggccatgtacagtggctcaggcctgtaatcccagcactctaggaggccgaagcaggtggatggcttgaacccaggagtttgagaccagcctgggcaacatagtgagaccctgtctctacaaaatatacaaaaactagccaggcacagtggcatgtacctgtggtcccagctgttcaggaagctgaggtagaaggatggcttgagcccaggaggttgaggctgcagtgagccatgatgatcatgccactacactccaggctgggcaacagaataagaccctgtttaaaaaaaaaaaaaaaaaaaaaaaaaaaaggaccttctgaagatttcaccttgagttattgaaaaggaaaagtctcctattttttcttgcaactgaatattttttgtagttgagtgacagttcaaacttgccttagaccccaagcaattaagctgtcctgatcacttattaaaaaattaggaggatctttactcaatattacatttaataactccttagagttgtggtcacatgagattgcagacttcacagttactgggtgggagactgatactttaaaaacaaaattcccgatgtttgtgggatgggaaaagttgtggttgccatgtttctcaaatggcccaatcctctagaatctgtcctcacccacaggcctgaccctgaaatcagtcaaccctattatatctgattgtggtttgtttttagtgtcaggagaacttaatttataccaaataaagattattgaaaactggacagggtactaccagttccgtcaactttcctggcagtctctccagattgcttagtttttctgaaccctgttttatgattcaagagcatgcttcccctgccctcctactgctgtagatgaatcatccacgtccctgtccaaggctcccctctctgcttcgcacccattccctcccttgactctgagacggaaccagaactgtaatttttatactagtacaaaagatgtcactatagtaaaagctggaagaatcagagtaagaagtctaatttataaatcacacgcagactcaagaagccagattcatgaattagagaccgaagtacagagagactcgtaatgaagacataaagtatgacaaagtatgacaaagtatgacttctgtttttctgttttctattatctggagaagaaacaaaagctaatggaacagtaaacgcaaagccctggcttcaaacttccaaccctctacatcagcaatccgcaaccgttttggtaccagggactggtttcacagatgtgggggtgagggatggttttgggatgaaactgtttcacctcagatcatcaggcattagttagattctcaagaggcgtgcaacctagatcccctgtgtgcacagttcacaatagggttctcactctggtgagaacataatgccaccgctgatcagacaggaggcagtgctcaggctgtaatgtaagcaaggggagtgtctgtaaatacagatgaagcttcgttctggctcgcctgaggctcacctcctactgtgtgtgtggccgggctcccaacaggccacagacaggtgctggttgatggcctggggcttggggacccctgctctgtatgatagccactcattttacaagcactgtctttaccacttttagtatatggcgtgtgtgtgtgtgtttgtgtgtgtgagtaattccccttctaaatggctattttcatccccagaattggttgctggaattccaagaggagcacagaattttggatatgtgagtactgagaatgcattacaggaatagggtattttcttgtataggtgctccttgatggaattacatctgaataaacccatcataaattgaaaatactgtcagttgaaaacacacttaatacacctaatccaccgaacatcatagcttacctaacctaccttaaacatgctcagaacacctacattagcccacacttaggcaaaagcctattttataatgaagtgttcatatctcaagtaagagcatcatatcgcatattgctagtctgggaaaagatcaaaactcaaaattcaaagtatgattattacagaatgtgtatcacttttgaaccattgtcagttgaaccatcataattgaaggaccatctgtatacgcaaagaaatgtttcattttatgcaaattttaagtcttttaaaacttcctttatgaaggggttcttcctcccgattcatgctgcttgcttacggaaaaggaaggaaaataagtcagattagatttcttctgatccatgtgcaggagcagctacttaactgatgagacctagtgcaaaatgaaaacacagaccccttgttcataaattattaaaaatttcaggacatgaacagcagaccattaaaccaagggtgagacccatctaagcacagggtcctgtgtgactgcacaagtcacatacccacaaggctggtcctacctgtgggtataatccgggaataattgtggaggatgccatggttatgatcagcaacttaatacgcctcatacaatagaaataaaagcaattgttatttcagttattttaatgaattgcattattttattataaatttaactaattttaaatttattatttgtttccatgactgctataacatagaatcacaaactgcctggcttcaaacaacataaatttattcactcacagttctggcagccagaagtctgacatcaaattgtgggcaggacaatattctcaccagagcatctatgataggagggttctctgtgcccccttccagcccctgatggtccctggcattccttggcttgtggcaacatcccaccagtctctgcctccatcctcatgtggccttctgccctctctgtctacatgtgtcttctcctcttttgataaggacatcagtcattggatttagagcctacccggatggtttcatcttgagatccttaactaatttcatctgcaaagatcctatttccaaataaagtcttattctgatgttctgggtagatatgaaattttggggtgctactattcaaacccattattatgaaattaggaaaagcaaataaatagatcttctgaaagaaaaacattttaaataaagttcatcttttacaaaagtatctagaaagcatcacggttgtctaagtagaagtaaaaggaatatttttgccatgtggatagcattttaaaatctaatttttcttgcaaagaaccataatgatcaatttatcatagaataagaacagaaatggatttggacaaaaatcctgactaaatcaactaatcatcaagttaattgctctcagtattcttgaattcaacttttatttctccagttcagattaataagcatgcgttttttctgaaagcatcccagacttaaccataaacaaaaactttaatcggctttttttttttaaataagatcattccgtgggctttcatttttgttttacatttagctaaccatttatcacactttacaaaaaattttaaatgattcaagttgtagtttttaaaaaaggctccaattctatggcaaatggtgtaacctgtttaatttctgtgatttcaggtttccatcattaactctacggatatgacgtttattcagaatttcacgggagaacaggtagagacattttaatatcaaataaataaaatcactctgggttaccagtagactataatattcatatcagttattcatccatttgacaaatatttaatgagcagctactacgtactggaaactgtcctaggcaccggggatgcaatcatgcatcagacagacagatcccatccagctctcaggcagcagtgaggtggcaggggagggagaggaagggacagtttattaacaagcaaataaatgtccatgataatttcagattgtgaaccatgatttaaagaaaataaagctgagtgatataagacaggagggaagtggcaaggaagcctttggatggggtgatcaggaggcctctgaggtgccaatgtctgggctgagatgtgaatgacaagacagagccaactataccatcttatccagaaccttccaggcaagggaaggctaacaagaaggctttcaaacaagaaccagccagacatgtgtgaagagcagagtgaaggccacagtctctgtaagcaagagagatgtaggagctgaggacggaggggacaggggctactcatgggagactggtgggggaggtgggcggtgtttgggattaagaatttttttctaagaacaatgggaagtggtttcgtattaacatgaatctttcaatagtctataaaggcctgaaggttttgatgtaagatatgggaagaaggtcactgtaaaaagggcctggacttctgcagctgacagattagacttccagttcccaccgcaccgctcatgaactgtgtgagaccacaggaaaatcatctgacctctttgagccacttggcaaaataagaataaaatgtttatcttccaagctccctttaagaatgaaataaatcaaggattgtagattacttagaagattccctggcacataacaactcctcaagaaatgttaattcctttccatcccatttcctgtctcctgccttttgatcaaacaaaagccactaaattcccatgtgccattaaatcttctataatttgagatgcatgcgaatacgtgtgcttatgatgatcataaactattgcatctctatttcagtaagatatagattcaggcctccatgtttgaatgcaggacaaatttaaaataaatgaattccttgtgtttgtaacttatatgtgactatttacaaacagaactacgcacttaattttaaactaaatatgaacaaagctgtggaagtaatacatttaaaactaaccatgttaattaaatttgaagaggagagaaaaatcgattgcctggagaaacaaattcagttcacaactggcttcctttagacggaagcaccaactcagtatttaaagaaatgtggctcatacctgtaatcccaggagtttggaaggccaaggcaggaggatcacttgaggcctggagctcatgaccagcctgggcaacatagtgagaccactgtctctgttaaaaaaaaaaaaaaaaaaaaatgaaagaaaagaaaaagaaaccagcaggttttaaaataaacaaaatgattttgacatctttttgctgtaatttggggctttagtctattactctgaaattttcagcgaagcattttatatctcctgatattcttttggaaggtttggagaaataagactgagatgagcgggaagttgaatagatattgaactgtttgaaacaactattcctaagtggtggtaattaataagtgaatgagaatctagcaatgcttctcctttgctcagatctgtttacttttcatcattagaaactttttaaacattgctaaatttagtctttctataacttcctctcctcaataccacctagttctgtaatcctgaacctcagaaggtgataaatgatgaaatttcataaatgatgaaattcctctgagtaaaggccacacaccaccacatcaagagaaagaatttcactatctatgtttggaacagagaaaagaggtgtgagaattgagttgttacatgccacttgttaactcatgtattcattttctctgcaaagagcatttggcacctggcacctactttggtccagacactgctcagaaagttcagatagaacagcaaacaaaacagaccaaagtctctgcctcctggggcgtgtgctttctaagggattgcatgttcattaaatgaggacacgatggaagctacgtcacttcaaacattgcatggcacactatggaagcaaactggcaacctgaaactatgggtcaaatctggtgagagcataaatcctgaaaagattataaatccaaaaacataggtttaaaaagaaaaactgcagcgataaaatggggagaggccaggtgcgggggatcacacctgtaatcccagcactttgggaggccgagtgggtggatcacctgaggtcaggaattcaagaccagcctggacaacatggtgaaacctcatctctactaaaaatagaaaaattagctgggcatggtggcaggtacctgtaatcccagttactcaggaggctgaggcaggagaattgcctgaatccaggaggtggaggttgcagtgagccaagatcacaccactgcactccagcctgggcaacagagcgagacttcatctcaaaaaataaataaataaataaataaaaaagtggggagactatggtacactgtgtacactcatggaaaagatttaggagcttttgttgactatgagcacgatacaaattgatactgagatgtgggttcccccgacatgaaaactttttatgcttcctctgaagcaggaagcgtaaatcttacctaactcttctcttgtcatcagcgcactcacaagtgtcatctgtgttttggtaccacatgtcatatctctaacacagagagtttggatggtgaaccaagtgacaatattgtcttttgagacagggtctctctctgtcacccaggctggagtgcagttgtgtagtctcagatcactgcagccttgacctccccaggctcaggcgatcctcccacttcagccccacagttagctgggactacacgtgccaccatgccctgctaattctgttttattttttgtagggatgaggtctcaccatattgccagggttggtcttgaacccctggactcaagtgaccctcttgcctgggcctcccagaatgctgggattatagacataagccaccacacccagcctgaaaatattttcatacaacatcatatggaattggaattagattccttctgtgagattcaagattgcagaacttggtgggattaagtgctagaagttatggaagagccagatttagcagtgaacattccgatagctgtgtccacagattaaatgggctgattgttgaacatccccagaggatgtccaagcagatgtcagggttattatggggaaaattattcactgggtcaggggttagactaaatgaggcaaaaagaccctggccacttcgaagaatctatgaatttcaatgcaaaaatgtaccacaatgagatgaatctttcaggaataatagagacatgactacaaaaatgactttttggacacaaaatgtcatctcctgattttcctttgcagatggcatcttattttggatataccgttgtcgtatcagatgttaacagtgatgggtaagtttatagacctctctcatatacaatatattacattcatccataaagatgttatgtttttccttcacaaaatacacccttccttattgcctcaacaagatagaggctctcttgttctcaacttttttggttcaagacaagaagatgcatctattaaataattctctgtcatctgattttgtccttaaggagattttccacatctgctgcttctagaggaggactattttatttcgttttatttttaattttatagtcttcagccattcaaaattcatagccattgagaacattcatctatctctcttcactcctagaattttcccctagcatgtgatacattcacaaaacatttgcacataaacggatttttaagttgctttaaaaatgtaacagccatggagaagacgaaattgttatttttcagattacagtagtaaattacagttgaacatggaccaaacagcacggtgaattttggttgtgcttaagtcattacttcaaaaataaattatgattaaacacttctttgattcactaaaaggacctgacaggtaaattaatgaatcattaaattaaaaaccattagattgagatgtatcaattatccacccaaaaatattattggatcacacaccacgttccaggctttgttcttggtgcccagaatacacaggtgaataagacagatgtggtctctcagggatctcacattttcacagaaagcaaatatctgaagaatacttactttgttctaggcaacgggctaagcactttagctatacttttgctagatattttatgtgacctttatatagctgtcaatggactttgtgttaattgtatcatggcatttgactggagataaatttcataccttttgtacctgctgggaaatatctttctattattctttcattgaacataaacttctcaaacatctactgtgcactaacaggcactgttctaggtgcagagaaatccataacttcatgaagattatactagagttaggaaggttgctgctacagacaaaaattaaatgagtaaagagtatgttagatggttataagtactgtggagacaacgaaaacaaaaggaccgaaagcaaccaagtagatgaatatgtaaacaaattctggtacatcctgataattcagttttattcagtgctaaaaaagaaatgagctatcaggccatgaaaacacacagaggggccgggtgcggtagctcacgcctgtaatcccagcactttgggaggctgaggcgggtggatcacctgaggtcaggaggtcgaggccagcctgaccaatgtggtgaaaccatgtctctactaaaaatacaaaaaattagccgggcatggtggtgggtgcctgtaatcccagctacttgagaggctgaggcaggataatcccttgaacccaggaggcagaggttgcagtgagccgtgattgcaccactgcactccagcctgggcaacagagcgagactctgtctcaaacaagaaaaaaaaaaaaaagaaaaaagaaaagaaaaaacacacaaaggaactttaactgcatattgctaagtgaaagatgccagtctgaaagatctacatgctatatgattctaattctatgacattctggaagaggcaccactatggcatcaggaacaaggcagtgtttcccaggggttctgatggagggagttatgaacaggtgaagaacaggatttttagggcagtgaaatgactctgcatgatacagtaatagtggatatgtgtccttatatatttgttaaaacccatagaaggtttgataccaagtgtgaattcaatgtaaaccatggcctttggttgataatgacgtatgaatgtaggcttattgattggaatgaacgtgcccctctgatgtgacggtgtggaaggttgcaagttagggagagggtaatgggagaactctgtactttctgctcaaatttgctttgaatctaaacaatctaaaactgctctaaaaaaaaagtctattaattaaacttgttaaaatagagaggagagatagggagtatttgaagggatacaatccccaactgggtagatcatgaaggtctcagggttaagagtccagctaaggaaacacctaagggaggtgaggaccagccatggtgatctaagagggagggagggaggaaggagtgttccctgtggaagagcaaaaggtgcgtattccctgaggtgggagctccaggcatattcaagaaccagcagagagctgtggagcgtgaaccctggggagctgcatcatgaaggtgtgcaggtcactgcatttactccaaactgccacacacagtgcaacacaaactctgccatggactagaacaagtccatttccaagaaggctacaacgtcctgtgagccatggggattccaggtgagcagtaccagctcaggcttcgctgttatcagctgtgctctgtctaccagctctagatggtcacagagccttctggaaccctactaccatgcaccaggggaggcaggacagtggcttggagggcagtggaatgactctgtatgagcaatagcagtggagggagattgcagtgcttgctctctgcatgtatttcgaagttatagttgaatgtcaatcttatcctgaaagcagttaatttaaaaataaattgccttcatcttcagttatctaagttgtaaaaataaagtagctattaggacggtcattcaagatttccaacttaggtggactgtaattgtaatcaaagccttttagtcatttggaaagaaaatagctaaagaacttgaaggccagacatagcatgccgtccagttttcataacgcttacaaaaacaaggtttcttaaaaagctccaaaatctcaacatcagggaaaaaaaaaaaaaaatcccactgtggcctttcagatatgcacagacacatttcttcccactgacggccacacaacaagcaccaggggctcttcccctgctgcacggattcattccatgtgttctcttccacaggccactcctgttttgaatcctcaggactttgcccaagcttcgccttatgccctgcagggcaccgtccttcttggaaacatgcgcattctagtctatagcaaagttttgtgagaatgtttatagtactttttatttgtcatgttaaggaaaaaacaaattgtgagaaaaggacctcattggcttcctgttaatcgaaacaacatggtagtaacaaacacagaactgttataaagtaataatttcttctttcttgaagttcttaaaaattgctatgcatactatttttttattacgtagtattttctgaattctttagactgcattgaaggatatttccattaatttactaatgccgttcataaagataaggtgcccacagattctcagtatatcacttgctgtttttaattacttagatgctatgtaaattcagggtcctattatatataactatgctctggaagtaattgagattggccaaagaaagatgccagatagacaactcaagtgaagtctgaaattacaacaatggtgatatatataatatatttcatagggtttaaaaaatcacttggctaggtcattgctcatggttcagaagtgaggacttccctgcacgcacacatttatgggcttgaaccagactctcctttccccaagctggagatagttaagtacatttgtacacaaggctatctagtagacattgttggaaaacatgtattctttgaaaagtaggcaacaaaaacaaggtccctaaaagagctccaaaatctcaacatcacgaaaaaaaaaaaactgtcaataagtgaccagataagttaactggtggaaattttccctgatatttttctgttaagaaaaatctccaagtacgattgagtggactgcaaacatttagacttaacagttgtgtgcatgctggttgatggttaatactgtcaagcctgtgacagttttgaaaatataaacaagctggggaaattatcttcagtttcgttatctcaagacttccagtactacaaactccgtcaatgtaagctttgttaggaatttctgaacaaacctgttaacaacaaatggagatggtatttttcatctcgtgcctaaacaagcaaatatgttttttttttcttacggcttttgagtgttatagtagttatactacttcagaaattcactgaattacaatttaatccattggatactttctgcactaccattgtttctaacctctgcaggaccaaaaggagccaaatttaaacagattcttagtggttaacttgagaataatttacagaaaaatccaattgaaaggaaacagcttagggagctatatttttatgctagatttagcccaagtatgttcattcatacaggatatatcattatgattcaattagtagaaaactctaaaaaattaaaccataaagaggttgtagattaatttctgtaatgtaattgaagtgatgttagctcttgcctatcaattaggttgatttgatatttactatatagtccactaatctgtattcttttaataaataactaaattctgaatattagtcatgagcattagcatggaagtgtactactgggaaaaaaaaagaaacagaaaagtttctatgttaaagcaatacatggcttagcctgttttttgttgctataattgaataccggagactggatgatttgcaaagaaaagaaatttatttcttatacttctggaggctggaagtccaaggtcaaggggccgcatctgatgagggccttcttgctggtggggaccctctgcaaagtcctgaggtggtgccaggcatcacatgttgaggggggcaagaacattccagctctgtattccattcctcttcttataaatccacaagtcccattttggggctccaccttgatggccttatctaatcctaattacctactaaaagttttacctccaaatgccattaatatatgcatctgaagattaattgtctaatacatgaaatttgagggacacattaaaagcatagtaacttatgcacactgttaggttgcctaaaacatgaacccaggtgtgtgattttttttgctgccttcagagttgtgtcttttccagagtgtcatgcagttggaatcatacagcaggtagccttttcagattggcttctttaactgagcaatgtatatttgaggttcctccatgtcttttgatggcttgatagcccatttcttttcattgctgaatattattatatgatgtaccatgatttgcttatccagtcacctattgaagagtatcttggttgcttccaagtttgggcaattattctatgcacatttttgtgcatatttttgtatgtatatctgttttaaatgcatttgagtaactgccaaggagtgtaattttgtgattgtgtggtaagcctatgtttagcattgtaagaaactgctagactgtcttccaaaatggctgtatcattttgtattcccattagcaattaattagagttgttctacatccttgccaatgtttggtaccatcagcattttggattttagccattctaagagatgtgtagtggtatctcattgtggttttaatttgcaattcctaacgacatattatattgagtgtcttctgataagcttgcttgccatctatcttttttgatgaggtgtccattcaaatctttgcccaattttttttttttttttttgagacggagtctcactctgccatctagtggtgcgatctcggcccactgcaacctctgcctcccgggttcaagcgattctcctgcctcagcctccagagtcactgggtacagtcacccaccaccatgcccagctaatttttgtatttttagtagagacaggcgtttcaccatattggccaggctggtctcgaactcctgacctcatgatctgaccacctcggcctcccaaagtgctgggatcacaggcatgagccactgtgactggccttgcccaatttttaattggcttattttcttattgtatatcatgtacatgtaatattgattgtaacaatatatagtatataatatataataatgatatatgttattgttacatattttttcctcatggggttaatttttaagaattctttgtacattttacttttacaataaattagttggaatgcccctagcaccaagcatgtctagacactcactctaccctcactctactcagggacacttggtttggctcacaacacctacacctggagagcccaccttgggatcccacccaggtctaatgccatctcctccatggaaccttccttagttccctccaagcacccagcctctccctggtccaggatacccagcgttaatttcattgtctcatattatttttccccatctgccatgtttatagtaatatgagtagtcatttaacctcatttgtaagttattagggaatgaattggttgacctaatagtcatcattgcattaaagccacttatcaaagtaccttaaacataggaagtacacaggatatcttttgattcagactgaagacaatagataaacaccacaaggcaggccagaaattggagagagggtaggttagagtgatgttggagtgtcttgtagactgctcagatcttgaagaaagtttcttgttctcagtaactgttcccacctcatccctgacttttgatataaactatatcaaagatgtgtatgagccacttgatatggaatctgttagtaagatatatttttatacatattattgattttatgttattgttattgatatatcttaatttttgtatattaatatattgtatattaatatagtattgtttcttgacctttatatttataatatactcaatttatatatttcatacattaatgtattaatatacattattatatatcattcatatacatgaatattataactcaattatattaataatattttaatcggtttgcttggcaaacttcagcatattgcctaatctacataggcataaaagtcaaatgcaaatatatgttcctgccccaggtcactcttgagattattgcatttgccaagacactgtatctgcagacaaactttaatagaggccattaatttagatcaaattatatatttttggttggtgtgacttgtaaaattttaaaacagaaattatacattatacctttttaaaaaatcaaatcacttagaaggcttatagtgaagtttcccattctagtcctcttcctgcccatctggctctgtgaaggaaatacctgtaaccacttttttattttttctccaggtggttatatctttatctctaaataatttgcttgaatatctcttgaaaattttttaaccttaaaaattacatattagttttttgctataatctatgtatccaaagaattcaaatttttatttgggctgaaaagttgtttgctacctttctagccagcttgatatacctctctaatctctgttttatttaaattgagctaacaaaaggaaagggaaggacaaaattgattttaaacattactgcattaaaaactgaataattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaactgaataatttaaatgtatagtcatattaattgcagacaaactctaatctatttttacaaaaagctattttgttctttcttgatatgtttgctttgtgcaagtacagtttctggaaatgcactaagaagctgaaaatggtaaaatatctgtggtttccttaaagtagcatttttaacatagctaaaatgttcagtgtgataatttaacagctcttattttcttacagcattcgattccatagatataacaaagcagcgaaagcaatctgatgattgtaaaataaccctcagaaaaggaaaaataccaatggaaatttactagtctagttgattacaaataacccaaagtgactctactctctgctagcgtgctgagctgctttctttgttccttacagactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatggtaatttaaaccaaagcgtggaagtcatttatgtgtcgtcaccactgcataaaggagaccatgcctgttttaaagtattcagtatggtgtgtgtgggtgcagttattattactgatttttaataaactatcacaaatctcaaggcagctttacgtttatacattttgactaatataaatattacatggaaatttcccttctcacctttctgaaaatttttatttcaaatctcacaagattacaatgcaacacagagaaaaatctgtaacataatttgtttcaatcctaaatttagtataattgatctccttgtagaagacacattcggttatcagaaacatcagaaaaacctcattaagcaatgtcaaaaccatactacctcagagctcagtcttcagagctccaggtaatggtttgagggtgttactacattttgaaaacctctaaatgaattttaagagacattggaaggccacaggcactccaggttacaataaaaataagtacatttaggtttctgcaaacttcaaaataacatctcaaatgttcaactttaaacttctctacttataagtgctgtttacttgcagaaatatttcttattcagttttaagaattaaaactttaaagccaaagttaatacaaaaatcgtcattgctctgacgtccaagcaattttctcacatttgatgttggctatcctgtaatagctctcagtagaggcaggaattatttttaaaattgatgtttggatttggtgacttaaaggtaactaggaaaccttctatatgtcaagacaaataaatacatgttgatatattagcaagtatcctgacttctgatcagcctacatgggttatgtacaggttatactgaattttaattggcacgtaggcttcaccttagtttcaatatttgcaacaaagtagtgttaaactcgtaggttaggcttgtagttctttaggttagaatttatgaaacccctccaagtaccctctcctcagaaaaacacacaccttcacacaaaagtttgcatacattttcaggacctgaaaatgtatgcattttcttaaatgcacttcaggttctttagttaagaaccgagcatagtgaatttcttgattgaactcaaggaagtaacaggaacttgctgtaacaaagtagccttggaagtattcacatcagattagtattcattagtatatttggccaatgtttctgttctcttacacattctttgaaaaaaagttctcagcaacatatggttagtaaattttaaagtatcataaaacaaagtacatgtaaaaagcttatggttccagggaaattttttaaaagacaagcttacctttaagtgacttgctactctgtaaagctgctctattcctgatcactcaagtaaaataaatagtgctaaattatctatggagctgtcgtttaaaatcatattttcttctatttgtcttttctctcaaacctttaatagtatttttaaaagataaaagaagcattctaaatgacataaagggaggtcctagcttctctgagctttggtgtccttgagtatacaaagtaggtaaaatcatgtgaaattcactgagagtaaacaaggggatgggagtcaaggcagtgacttagagaaagttaagaaagtgtcgaaagtgttccttttcgcctgacacaagacaatatctttattttctacaaaaatctgagtttttagatcatctttttttttttttttttttttttttgagacagagtctgtcacccaggctagagtgcagtggcacgatctcaactcactgctcaccacaacctccacctcccaggttcaagcaattctctgcctcagcctcccgagtagctgggattacaggcgcccgccactacgccaggctaattttttgtatttttagtagagatggggttttactgtgttagccaggatggtctcgatctcctgacctcatgatccgcccgcctcggcctcccaaagtgctgggattacaggtgtgagccaccgcgccaggccctggaggctcttaataaatatttgttggatggataaaaggcaacaaataatttgtcattgcagcagtactacagaattttcatggaaaacattataagccctttagagtttcgatactgctttttgagtatactaaactatttctgaaccattcttctgtacttaaaaaagaaacgtctctatggccaagcacagtggctcatgcctttaatcccaacagtgtgggaggctgaggtggggtgatcacttgaggccaggaattccagaccatcctgggcaacaaagcaaggacccattgctcaaaaaaaaaaaaaaattctatatatatatatatatatatatatatatatatatatatatatatatatatatatatattagcctgacatggtggtatgcacctgtagtcccagctcctagagaagttgaggcaggaggatcacttgagtccgggagtgtggggctgcggtgagccatgatcccaccactgcactccagcttgggtgacagagtaaggtcctgtctctaaaatgaacaaatgaagaattaaatacatatacacataaaacatgttttatgtctgtttttagacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccaggtaaggttttctttcttttcccacgtgagagtctacgtcctgaaatagagtccattttctgaaaaatgcatcatgcaaaggcagttttcttctacagatgaggctgaagcttaagcatgccacaggcttttttaatgtacgattccagagcgactttcatgagaacttgaagaaagacaaacacacgcttccttctcctgtcaagagacaatgatagaaaggcagaatggcttaacaatctgcattgtacataaaacttgtcaacttcacaacccaagttttcatttgaaactcctcaataccgcggcttgcactgacatagacagcttgcatcctttctggcgcaaattattttaacccttttgagctcatagctcctattatagcatgaacctcaacgtgtctgtcatgaagctcatgtttttaaagcataaatattttccagcttggcccatcatggtggctcatgcctgtaatctcatcagtatttaggaggccgaggtgggtggatcagttgaggtcaggagttcgagaccagcctggccaacatggtaaaaccccgtctctactaataatacaaaaattagctgggcatggtgatgcatgcctgtagtcccagttactctagaggctgaggcacaagaatcacctgaacccgggaggcggaggctgcactgagccaagatcgagccactgagctctaacctgggcgacagagtgagactgtctcaaaaaatatatgtatctcttccagccatattttgtggttttccaaagatagactgaacattttaaagtggagaaaaaaagaactggttcatgataggaaccataactattcttgatttacctaattcacattgaaggcacatggaaagccatgaggcacaggtaatttatgtattgtgcatgctatatgaagacattgatttgtcttaaaagattatttcactgtccaggttttttagcagagaacatcagacttcttggttttagggtttgattttcacttttatgtttaagatggtttcaataaatacttagaagtcattaatagttaaatgacagtttcaactacttataaaaaccttgtctctttccactagcccctcccctgattgggaattttccatatgtagagctattttttggtttggggcagcatccagtaagctgactgcctaaatatacatcattaatttcaggcctttggctttcttctctcctctgggattagacaaaaaggataccgcaacatattcttataaatttgccataaaccttttatgacactaatggagacgtcatagtgggctcaaagtggatttggtattatatcgtatactaatgcttcctacctgtggcaatttcaagaacatctagttaaatttattttcttaggttacattatgctaatcaatggtggttagttgttattactggggagaggtttgtatacataatatatccaaatttaaaataattcaaaaatctaggtcccttatgtaattcctaccccaaaaatgtcagggtgattaatgaaattcaactcctgggttgcattttaggtaaacaattagaaagttactgctatttattatggtagtcataggtctccttcccacccttagtaccaggaaaattgacagaaaggctgtgcctttgatgaggcaaaggaaatagaggatgtatccatcacatagccagtcctttgacttccttccaaggctaaacacgtcccaaatgagagccaggaaggacagaggcatgagtcaacttttctccccaggaatactcccttcagggagaaaaaatttaaaagcagcaggaagggaaaaggaagctaaagtctgtgcaatgttagtaattgattacctctttttttcttttcctttttttttctgagacggagtcttactctgccctcaggctggagtgcagtggcacgatctcagcccactgcaacttccacctcctgggttcaagcggtcctcctgcctcagcctcccaagtagctgggactacaggcgtgtgccaccacactcagctcatttttgtagttttagtagagatggggttttaccatgttggccaagatggtctcaatctcttgacctcgtgatctgcccacctcagcctcccaaagtggtgggattacaggtgtgagccaccacatcagccgattacctcttaattatgtctttttcttcccttaatcagaaatattcacttgaggccatgtgctagtcaacaactttgctgagtctgatgcaaattataataatcagacatgtcagtgctgtgcgtcttgtctctgaagtaaatgttctttactaaggcaggcccgtcaatgctgcttggttgaatttatccctcaagagtcttgaggctttcagagttcatccatgcatcttggtagacctgggttctggcgccaattctgtctctcaaataggaatatggatatcttgtgattcatgattctataacatttttccctgatcctcatcctctagcaaaaagaatgccattcaaagaagcctttttaacttcatagcaagatcccaggacctacagagaagaaactgccttagaggcaggcgactagattctcttattacagttgattgaaagctgcaggccaaattcaggaatcagacatgtaactttcttcatttttctagaaatgaattccatttagctttcaaagcctccatttccaccatggtagaaaatgatgatcttgcaatcacttctatgtttagatttagtcttatttaggtaagtatttattcagattcaagacccctcagccagccgtggtagcatgcacctgtagtcccagctacgcaggcagctgaggcaggagaactgcttgaacccaggaggcagaggttgcagtgagccgatatcgcgccactgcactccagcctgggcaacagggcgagactccatctcagaaaaaagactctttttctccaccctgtgtagctaccctcccaaggaatgaaatagaaaggggtttacctgttgtccagcgactgggaagagatatctggctcacacccatcatctgctattattggcttcagactaaagggtagctcagtcccttgtggcctttggggcattgctcaagcttctgtggctcgttccattgtctgtgtagtgacctctgctcaaaatttccctgtgtcctgggccctcttcgtcctctgttagcctctttcagtccccttttagcaaatgcttctgagccactgttaggactcagacacgcacaggctgggtattcaggtttctgtgattgccctcaggcttatctacctagattttccttagctgttgccagtttccacccaggcatctcattgctccagcccctgattgagctgcagtcttgtgatgttttgcctgggaagtaacaaaagccctctttcccctaaaggtagttggatggcatgctttctaaaccctatagttcagtcagtaaatgctacgttctaggcctccatgacttgttttgtgatttttccaaaccagtgctttttggaacttaaaaagataaacaatttctttcactctggggtcctgctttttcaaatcaaaagcactttgcctttcaaattatgaagtaaatacacctgagagcgataacatcagcataccccaaaatgaccctgggtggcacacacaccccaatgtggctgggaaatctgagctacggaatctgggagtggccagcccagagatccattccttgtctatgaggaagacctgacacccaggtcggtcccgtggaacacgggccgtagaggggattgaggccctttgtttttggattaaatgaaggttgccaggtggaggttgtcagtgggagagtactaagtgaagatgctttataaactgcatgccttttgcaagcggttgcagttctcttgcccagccctctacccccggactctctgccctgtacgtaggtcctcaatgaaacctcatgtctcacttgctggctgtttttcagcctcttgaacatgctgccatccccaatggagttgataagggtttgcacaacacagattactgtgccttctgagcttcacaatctattcaacaaattgacttcctccctctgaaatctatctcatcatcctttataaacaggggttcgcaaccttggttgcatattaaaatcacgtggaaagctttaaaaaatccgaatgttcaggccaccctccaaaccaattaaattagccactctgggctggagcacagactatagtgacatgtttaagtgaccctggtgattctggtgtgcagtactttgggaatgagtcctctagagcagtgtttccctgctgactgtgcaaacagatcacctgggtgtgtttatcaattgcagatcctgatgcagagatcaagcgggtggggtgagattcctcacttaaggtgcggcccttactgctggccttcacaccacaccatgcaatgagctgtagagtgctgagcttttccactgaggctctgagactcagtgtgcatgcatgttatctgtagggcttgttaataaagctgaatgcacagcaccccttcagatactgtgatgactgactctgagatggggatgagagatctgtgcctttacgcagcaccccactttgagcaaaaccaccctagattcttggcggctcacttccaggtctacaggagtcagatgcgccttttctcttttgccaagaactggtttgctaagccctagcatttcatttattctttacaagggtgtcaaacccaccagccgctgttctctccaacattgcctctgtgtggttcctgccatggtgatgcttgggcacatcccactcaggaaggggcaggggcaacttttttttttttttaagagataggaacttgtgctgtcacccaggctggagtgcagtggcacaaatcatagctcactgcagcctcaaactcctgggctctagcgatcctcttacctcagcctcctaagtggctgggaccacaggagcaggccaccatacctggctaattttttgattttttttgtagagacagggtctcactatgttgcccaggctggtttcaaactcctggcctcaagcgatcctcccgcctcaggctcccaagaagttgggattacagacatgagccactgtgcccaggatccttttaaaatttactcacagacatacaggcgttcagctgccctgtttcaaattctccattctaagtagatcagaaacaaaattccaaaatttgtcactttacctggttacctgcagaatttatgagaaaacaaatgcaaaaacaaacatttaaaatgctaaatggaaacaagtcaaactacttggcatgattagggaatggaacacccctgagaagccacacttatcaacagcaatgctttctgatggggttatgatggggttggttttcccattcttgagataaacgctttctcctcatttcaggtgacaaaatgcttagcagctctgtctaaaagagtgggcagtgttggcttcccctggttttcactgtctgatgtaaacccttttctgtgcagcctattaagaaatctacctttaataatggcagggcatacacattgccccaatcatagatagtagcaaacactcttacgtattcttaacacaacctggctgcctttcacagacagaggagggctgattgtgatgttttatgtgtactttttgtgcattatagctgtttcatcttccaaactgactcaaaataaattaacacggcacctcaaataaccgaaaacacagacatataagaggtggtttggtttatatttattcattgtcaaacgatctgttctgcatgctacagatgttttgtatataatcaggactagttttttagtctttggaggaaggaatgttagcaaagtgcaggcatagagtctgttatgttggtaatgttttttcaattatactaattattagtgctaataattaagagcccaaagcatgccagccactgcatagaaggtaaatacagtgcttattgtagaatattatcgtggaatctctctcattcacagatatatatactcaaacatctatgtatgtattttttatatgtactatatatgtatgtacacagagtttatagggtaggattggatgacacctcacttctttttggaaaacatcaagccaatttaaaaaaaaaaaaacttttaaagttagccgatgggcacggtagctcatgcctgtaatcccaatactttggcaggccagggcaggagtttgaaaccaacctaggaaatgtgcaaacctctttctctactaaaaatacaaaaaattggccaggcatgctgcagtatgcctgcagttccagctacttgggagtctgaagtgggagaatcatctgagcctgggaagtctaggctatagtgagctaagatctcaccactgcactccagcctggacaacaggagtgagaccctgtctcaaaaacaaaaaaaaaaaaaaaaaatttaaagagtctgtgagaacaggggaaggaaaatcggattacctgagttcagattcccattgaatactattaatgtaacaattgaacagtgatttactttcagcttttatttctttatctggtatgatggggctgataatacctacttcactgggttgtgtgtgcctgcactttctagggcgggagaggatttttacaaaatgctgtcaaatggctcagaatagaaaaggaaaccaatttgctgatcatgaacagaatatgagctacttcacctgacagtcatgtggagccacataagattttgaaaaactgcattctaggatgctggagagggacagcctctgtttaaaatctgatttagagacagagtctcactctatcgcccaggttggagtgcagcgtcacaatctcggatcactgcaaactccgccgcccaggttcaagggattctcctgcctcagactcccaagtaactgggattatgggcgtgtgccaccacgcccagctaatttttgtatttttcatagagatggggtttcaccatgttggccaggctggtctcgaactgctgacctcaagtgatccacccgccttgaccttccaaagtgctggtattacaggtgtgagccaccgtggccgacctctttcatttttcactattgtgccttactggttaccagaaaaggaacacgctgctccctcgctgccccttagccatttaaaaatatttaaattcatttaaatttggcctgaagtatggtaatgacagtggaaattgaaaggaaggaactaacacaacagtgtaaatgaaaaatagacaaggcttggtaacaactagcagtgatggaagggagaggaggtggcaggaggtaaggaagaggtgggtgtaaaagatgactcagatttgaatgcagtgtacccaagaaaaggatagtctcatggacagattgggggattttgttatataatatacagatttgattgcagaaataatgtgtggaataattttcctaacatccacctcaaccacccaatacgtttttaggctttttacaacaaatattgtcactggcacacacactacatagagtcataagtactttcatttctagcatcaaaattcattttctgattcaaaatgtagatgtgttcaggtctgtatgttggggttcattgggaaagtaggattgaccagaggagtgtcttgcatacattaattgagtgaaagcattttagaggagaaacagccgtgatagtcaggaatcttgaaatccagtgatctcctctaatcccattaaacgtgattgtataacaataccatctgttaaatgcatagctcaggcattggaaggtggaggaggggcggtacagattttgttgaggggcagaaatcctacaggcaagaaaaactggaggaaaacatgggcagaaggccaagactatcattgtctcatccgggcccctactatataattatatcatgaagccatttcagacaattacactcaatgaaataaaataacccattatcttttcaatgagtgctctgtgtgtgtgtgtgtgtgtgtgtgtgtgtgtgtgtgtgtagtataagcaaacaagtaacacagaacctgcgcatggaaggaggctttatccaaagggaatactgcatttcaattaaactttaagctccttgaaattgttaatttgaagttcagttgaactaggttcaaacattatagtcaaagtttatttttacttctcaaactgctactcaagttttgtgtgaaaagccaagcattatgtttttattgactaagatattcatagtttcatgataaacacattagaaattagaatattaaattttgggtaaaaatatctcatgcatgtagatcaaattgaagtaattcaactgggagagctcttggacttcaattgaggagtgttgtcaagtagaaatgaaaatgagtggaaagtgaaaaggcctgagttctagaaccagttctcccacgtgtgattttagtaattccacctctctgggtcttgccttccttatcaagaagtgacaaaggtgcatggattactcctcccagggtctttttaattctacacttctctgatactatcatcccagatctagatttcctgcctttacacagtgctctgtaatattgggtagattattaaggatctatctttaaaaagatttagtgaaggccgggcgcagtggcttatgcctataatcccagcacttttggaggttgaggcgggcagatcatgaagtcaagagatcaagaccatcctggccaacatggtgaaaccctgtctctactaaaaatacaaaaattagctgggcatggtagcacgtgcctgtagtcccagctactcaggagactgaggcaggagaatctcttgaacctgggaagcggaggttacagtgaaccgagattgcaccactgcagtccagcctggtgacagagcaaaactccatctccaaaaaaaaaaaaaaaaaaaaagaaagaaagaaagaaaaaatatttagtgaaattattttttctcaatgttttcttggaaatacttttggactcacagaaaagttgcaaaaaaatagtagacccttataaactcttcccccagctccccctcatgataaacatcttatgtaaacatagtacaatgagctattaatgaatcaatggacctattcgaaattctatcgaatttcaccatttgtccctctacagttcttatttctagtcccatgattcaatctgggatcccatgttgcatttagttatatttccttactctcttccaatctgtgactgatgatgctgacggtagaatatgtgctgattatatgatattcaagagattgttatccatatacccagcaagtatgtgttgagtgacttccatgtgcctggcactatgctagatgttgaggatacagcactgaattaaacaaagatcctgctctcacgggcccgaattaaatcaaattctagctctaacactggctggatgtgtaaccttacccagttaatcaactttctggagtctcagttttctcagtggtaaaacatgtataataatacctaataatagctttttcctttaaagttgggttttggaggttcagctagataatatgtataaatcagttaatggtgtgaatagcatctagtagcagccactaaatattagttataaatgacatattgttactatatgggcataacgcatgcctttaaggagcaatgtaattgtggagataaaacatccaacaatgaactgtaatataagcagcagatgagaagagctttaagagggtacaaaataatgaaacagttaaaaagagagagtgtttcttgctaaggtgataagagaaagtttcctaagggagataagtaggatcctgagataggtatgactgtgagtggttgtagggagaaagcatctcagaaggggaacacagcatgagcaaagaccctgagattacatgtgtcaagtgtgttcttgccacagtcataaaaagcaagacttcgcagaacagggagcattgaatcagggaacagaaggactagatgagaaaactgccgaaggccatatgtattcaacgtcttttggtcatcatctgacccagataatttcctacttttgacaaccctttgtattatcaagggatacaacattgtgaattaatgatttgacttagtgatatatgagtgagggggggaaaagggatccacagatttctaggactatgtaatataggtagaatttaaaaggaatttggtggctgggcatggtggctcgtgcctgtaatctcagcactttggaaggctgaggtgggcagatcacctgagatcaggagctcaagacccctctggccaacatggtaaaaccctgtctctactaaaaatacaaaaattagccaggtgtggaggtgcgcacctgtcatcccagctacttgggaacttgcttgaacctgagaggcggaggttgcagtgagctgagattgtgtgctgctgcgctccagcctgggtgacagagcaagaattcatctcaaaaaaataaataaaaataaaaggaatttggcataaaataattaatgttgactgtttcagttttatgtaatgaaaatgttgcctagtttgtctttgttagtatgtactgcagaattttttaaccataccttctttatttttttgatcatgctaaaaaggaaattctatatataagttaaaggaaatgcttcctagttttttcaaaaaggcaattttggaagtgaattggtccaaaatgatggaagcatacatggagagaggtaaaaatgaaaggtggactggggacagttaacaaagagccttgaatagcatgtttagcaattagttattaggaaagtaatggaaaaagatatatgctctgtattccaaagtggtgctttaaggacctcattccttagcaatgagcagaatgagtaataatgaaaaagaaacatgaaatcaaaagtcattaaagtatcccaggggaggataatgagatgaaccacgtgatgtagcagcaaggccagggcagctggaggtgtctggagattaaaagcctaaagaatgaggaccagcagtgactgtccagcctcccatccttcataagacagcctgggagctgctgtgcacacgtctcaagagatcccactgtctatatatcgttaaccttgaaataggcctttatattcagaggtgtgttaaaaattggttaacaaccagctcctcagggagaaaaaaaaaagcccagatttgtaccacttaccaatttccatggtataaatatcctcaccatgattgatttcaagctgtagtgaccttggtgtgataagagtgctacaattgctatctgtatcactgaatgaacctgaaataccgacctgcttctgcccagtcacttacaaatacactaatctcctgtttgtgggatgtctttccaagagggaattactattttcagaaattcacagatccaggttgagaatgactgttgtctacactcacagctgcatttatgaaaagaccaaaacaaagattagctatagtcattttcaagtccgataacataatatctgacttttttccagctttagattaagatatgaaaatgtaggaactgtcatctctctcaaacaaatatttctattttgcttagtgtgttgtgaaaacctctgagtacctccatctgccttatttctgactcccctttgaagaggcaatcctattgaaaaagtggaccttatcgacacagctatgtcaatgaccttaaatgtgaagccaggactccctcacacacctgaactccatccctccccatgcttgaatcaggttctcagataaagcctttcacaagtaataaatccttattatttcacaaataatatagccttcagaatccagattctgtcccaaagcaggtttaaatcatatcccactcataggtagtaaatacagcaaatttccctcgccagatacaagagatctaactatatggctattagattttctatgccacaaatcatttgtcagtttaagtttgaactaacttccttccaaataatcagagactgggttctttctgaaacccagtgtatatgataggatattatttatacttgatcttgcttataaagatacagttaatagaaatttgctgcttagccatggctttttttggggggggtggggctagaagtccaatgtgctatcaattgtgccatagagtcctcttggccatggcttttttttttttttcttaatatactttaagttctgggatacatgtgcagaacatgcaggtttattacataggcatgcccgtgccatggtgatttgctgcacccatcaacccgtcatctacattaagtatttctcctaatgctatcccttccctagcctcccacccctcaacaggacccggtatgtgatgttcctgtctctgtgtccatgtgttctcattgttcaactcccacttttgagtgagaacatgtggtgtttggttttctgttcctgtgttagtttgctaggaatgatgacttccagcttcatccatgtccccgcaaaggacatgaactcatccttttttatggctgcatggtattccatggtgtatatgcgtcacattttctttatccagtctatcattgataggcttttgggttggttccaagtctttgctattgtgaatagtgctgcaataaacatatgtgtgcatgtgtctttatagtagaatgatttataatcctttgggtatgtacccagtaaaaggattgctggctcaaatggtatttctggttctagatccttgaggaatcgccacactgtcttccacaatggttgaactaatttacactcccaccaacagtgtaaaagcattcctatttctccacatcctctccagcataatatccagaatctataaggaacttaaataaatttacaaggaaaaaacaaacaaccccatcaaaaagtgcatgaaggatatgaacagacacttctcaaaagaagacatttatgcagccaacaaacgtatgaaaaaaagctcagcatcacagatcattagagaaatgccattcaataccataatgagataccatctgttgccagttagaatggtgatcattaaaaagtcaggctttttttaaaaaataggatataaggaatggagtatgaattagttggagtcaatttctcctgtgtttagaacctcatattatttcttccctccctctgcatgttttttaatatgtcactttgaatttactaatatgtaaatcggaagccatattttcaggtcattcacctgatgcatcccttctgcctcagagtctctctgtgccctggccattttcccaggagttcatttcccacttagacactcagtcaaatgtcacttcctcaggaagccttccctgaactgttgtccttcccctgaaaacaatgatctcagatggaaattacacatgtgtgcaattctttgataaatgtcctttctgctccactaaactggacactgtattagttgagactgggagtggatttggcgttactcactgcgaaatcctaatgcccaaggcagcggctggcacaaaaggcaacttgtcgatatttgttaagtgaataattgaatgaatgaatatgaataaatgaataaataaaccagcatccttccagctgcacaccttgtatataaattgttgctcatatctttaacttgccactgtgtttcaactctacttaaaatccagtcaactattttatgtttgtgcagaatgagaatggaaatataagtagagatgatgatgatgccctttaaaataaatgttggcatctgtctcctgttactcaaagtagcagactgattcttggctagcgtttaacccttgaccctagttctgccttcaccagtgtcaatcgagaaaaatgacaagtctcaattattttaagaggtttatttgccaaacttaaggatgcattcctggagacaggtctgtgcctttctccaaacttgtttttttgtttatttgttttgttttttattgttgtttgtttaagtcttgctctgtcaccaagactggggtgcagtggcacaatcttggctcactgcaacctctgcttcccgggttcaagagattctctcttcctcagcctcccaagtagctgggattataggtgcatgccagcacacccaactaatttttatatttttagtagagatggggttttgccatgttggccaggttgatctcaaactcctgacctcaagtgatccacctgccttggcctcccatagtgctgggattccaggcatgagccaccatgcccagcctctgaagacaattttaagggctccaaatttaaaggggaaagggcagaatattgagaaatacacaattttcatttaagaggagggtagggaaaaataatcatgcctgcctttgtctggctcagtgaatctgcatttttcttttacataagatgacatagacaagtggggcagaggaaaaatgcagggagcctgcctttcatataagataacatagatgaaatggggcagagggggtgacatagatgaaatgggcagtgggggtgactgcacttataaagatatgctatcaatttacattgccgtggtgaaatattaacagaaaccccctagagtgaagatcttgcagctcactaggaatttccttgtgggcaaaatatgggggaggcatgtaacttttcatctcgttcaggaaccaaaaacggagaggcaggtttgtgtgacccagttcctagctagacttctccctttggcttaatgagtttggggtcccaagatttaatttcctttctcactgggccttcagatgccagctgctcttggctgtgagaccaggagtacgagtaggcagtgtgatggaaaaagcgccgtgagtaggggtacctaaattctcttttgttaccagctctgcagcctgggccgcacttgcagctccttaaccttagcctatccagccacaaaagaaaggtgatcagaccaatgcccaccactcaggattgttgtagagacaatttgcatgctgtaaagtactcgcacagttaattgttcctttttaatttttaaattttttgatacataatatttgtagttatggggtacatgagatattttgatacacacaacaaatgtgtcatgagcaagtcaaggtattaaggatatccatcaccttgagcacatcaattgttcttatttttaaacaccactggccaaacggaggtagtgttactggaaaggggtcctgatccagaccccaagagagggttcttggatcttatgcaagaagtagaggtgaatctggccgggcgcggtggctcacacctgtaatcccagcactttgggaggccaaggcgagcagatcatgaggtcaggagatcaagaccatcctggctgacgaggtgaaaccctgtctctactaaaaatataaaaaattagccaggcgtggtggtgggcgcctgtagtcccagctactcgggaggctgaggcaggagaatggcgtgaacccaggaggcggagcttgcagtgagcagagatcggccactgcattccagcctgctagacagagcgagactccatctcaaaaaaaaaaaaaaaaaaaaaaaaaaaccaaaataaattagaggtgaatccataaagtgaaaggaagtttattaagaaagtaagataataaagaatggctgccataggcagagcggcagcatatgggccgctcagctgcttatacttactgttaacttcttgattatatgctaaacaaggggtggattattcgtaagttttctgcgaaaggagtgggtaattccgagaactgagggttcctcccgtttgtagaccatatagggtaattttcttacgttgtcatggcatttgcaaactgtcatagggctggtgagagtgtcttttagtatgctaatgcattcattataattagcatataatgagcagtgagcaggaccagaggtcactcccgtcaccatctcggttttggtggttttgaccgacttctttactgcatcctgttttatcagcaaggtctttgtgacctgtatcttgtgctgacctcccatctcatcctgtgactcagaatgactaacctgggaatgcagcccagtggatctcagccttattttacccagcccctattcaagatggagttgctctggttcaaatgcctctgacagtaggaggcataaaaacaacctccaaggctgagggtccaggttctgcaccccagacccaggcctgtgccatcagatgttgacttggggaatctctgtctcaaacctcttctgggatgacagatgggaggttttcaaaataactaatacagcaacaaaggcctctttcatctcttttgtccttcctgtttgcaagcattgttcatgtgatgctcttctttctatatgccaacccttttagattttcttactgacgttttcctgcaattacattaatagctggttacctgaaaactatcaaccctaagagaagttcacgagatagccagcgtaagccagaaagctggcggtccaaccagaccacagactaaagagtgaagcaggtgaagcttgtctgggggatgctcagcccctctcatcctgttacctctcttttctgtgcctgagggctgctgcatactaattgcagaaacttacactctttcctcttctcaaacatgtgaaagagaaggatcttatcagaatgtgagtgatccagtgaaagtaggtcccacccagggacttcaattcagtggatcctggcctgtgtttgtaatatgacccctcagtgagttgattgatagactctaagtagctggaaggcaggggagtgtctgtttttaaagccccctgctgaatcctgggcagttagggtgggacctggctcatgctggaagttcaataatgagttcttagatgagggtgtccagtatagggaaccacctgtgtacctgttcttcccttcctctcccatctcccttgcaactccgtcaatcgcaaggctgccatcacacatcacagactggagggctcaaacagggatacatttcctaccagttctctaggctgcaagtccaagatcaaggcgtcagcagggttggtttcctctaagcctctctctttggcttgtagatggtcatcttctccctacatcttcatgttgacttctctctgtgcatatgtctgtgtcttagcttcctcttcttataaggacactggtcctattggattagggcccacccagatgatctcattttaaactaattacctctttaaagaccctactgaagcagtgtttttgtctggggtaaatacctgaggttcattgtttcacgacaagggaatcgagggtgcagatatacacaagaactgggtttaggagcagcgatttgattggcaaaagaaagagaaaggaggccgggtgcagtggctcatgtctgtaatcccagcactttgggaggccaaggtgggaggattacgagatcaggagttcgagacaagcctggccaaaatggtgaaaccctgtgtctactgaaaacacaaaaattagccaggcatggtggtgagtgcctataatcccagctgctcaggaggctaaggcaggagaattgcttgaacccgggaggagaggttgcagtgagccattgcactccagcctgggcaatagagtgagactgtctccaaaaaagagaaagaaaagaaaagaaaagaaagaacatctctctctccagagtgcactggattttatagacaggtttgaggaggcagtgtctgatttacatagggcccaaagattggttggaccaggtgtgacatttatacaacatgcaaggaagctggctgccccaccctaatcttatcatgcaaatggagtttttgcctggcaggtgccatgttgcctgtttcttcctgtatacctggctggcaaagatggagccaccattttgaacatggctagtcccaggtagccttttcttattggcacagatgccagcattcacccatgcaatcttccagcttgcttgtctatgtctgcagctcgattttataggctgctctttgctagaaaagaaaatgatttgggggctgcttttcattaaaaggaaaaccttactgaggactcccgtaccctcatatctgcctaaataatttcttcttaactcctatatcactatctcctaatatagtcacattctgaggtgcaggctaatacagtcacattctgaggtgctggcagttaggacttcaacataggacttttttggggggacacaattctgcctaaaacacttagcgaaatcatcaagtcccattaggtttttatcaataggagtttatctgtcaggctaggtgtcagggaagcatctttgtgagctatcacgctcttctggagactgtgaaacactttccaataggcagctacatacaagtgacactggtactgtagaaataaaccttcctccagggctttcagcaattgcacagacggcacacatgtgattcagtgtggcccatgaagaggataaagttaaatgcctttgatacggtgacacgaaatacaacaagtttaggatcaaacagttgaaggtggaaggatcattcttgtagccacaggatgctaataatatacagaaaactattttcataaggcagactcatcatttgatattctgctgttattttttgtgggattgttttaaaaggaaaacaatcccccagtaaattagaatgttgcaacctaataccatgttccaactcataaatgtttttcttcagagttcatttggaagcatttcagacagattgttaggattattactttctgggataaaatcatgctttttttttttcaaacatttcttcctcaactcataaccttcctctcagtaatattttgcatgttgcaataaaaaagcaaggcagacaggcaacttctatttttagattaacacgtttgccaaagtcaaggagacttatctaaatgctggattcccacagacatgagctgtgtttgcaatgccagacacttaagccaatttcatagcccactcacaagtggacattgccagatgtatccgccatctgtaaccccaccattggacacattatctcgaattctcttatttctcttaatatcatcattgtatgaaagtgagccaaccttgggttggtttatctaaacaactatacttgatggccttagttcgtctttaaaatatttgggtgctgtgggaagaggattggcaggatgggacctgggcagtgatgggcagttcctggaggagattctgtgagctgtgggcagttgtattgccaagacaggagtcaggcgtctgtagagctgagttatgaaggcgaatgggaagaagtccagtctggtgaagccagggagaaagccagaaactggctgtctctcagtggaggcacaaggagtccctaaatctgcaggaacacagctgagtccaaaagcaaagcagagtcctggattgtacatcaaagtgcccagaatgcagtcatcagactccaacaaatgctactgagctcttgcccttctcatctagagaaacttaaagaccaccagagattcagcaatgaagattgacttgttcaatgtcatttagaagccagtagcaaagtgaactggagttgagaattgctgatttttcagctgccacttggtaattttgcacctgacatacaacaccgtgtttcaaagaagtcttcaaaggttttagagagattcaaagagagacaacgggcaagtcaaaattggcctgttgatgcacaaactgctgtacaccgatgttgacagtgactttgcaaaaactggaaaaacctcagggttccctaagccagggatggatgaataaactgtgggccatctacacagtggaatactactcagcagtaaaaaaatgaactcctggaacacacaacattgtggatgaatctcaaatgcaccgagctgagtgcaagaagctagacccaaaaggctgtatggctccatttatatgacgttctggaaaatagattagtggagtccaggggttaggagacaggtcaggcttggctacaaaacagcatgggtgacatttgggcatgatgggactgttctctgtcttgttgtggaagtggttacaggtctgggtgcatttatcaaagctcttagctctgcttactaaaaaggatgaaatttatcataataaaatgtatctttatttatttatttttatatctatttatttattgagatggagtctcactctgccaccctggctggagtgcagtgctgcagtctcggctcactgcaacctccatctcctgggttcaagcgattcccctgcctcagcctcctgagtagctgggattaaaggcaactgccaccacaccaggctaatttttgtattttttgtagagatggggttttgcactgttggtcaggcaggtcttgaactcctgacctcaagtgatccacccacctcagcctttcaaagtgctgggattacaggcgtgagctactatgcctggccatatctttaattttttttaaaggcttaaggagagaataaaaacagcatgtagttgtgcacctagaaggcagtgtaaaaaggagcccagtgtgggttcaggagccagactgcctgggtttaaactttggtcttgtgactttactgtattcgggctctgtacctcatttttctcattctaagatggggataataaaagtatctttctcataggattgttgtagcacttaaaggaggcaattatatttaaaatgtttagaatattagcttttctttgatctatctttacacaactgtccaacatatcctcaggataaattcctagaagtagaaactaggtcagcggtacacatagtcatacatatcaacaaactgccttccatgaaaataatgctaatttatactccctcaaacagcctataagcatacctctgctctctatccaacaccacctagtactaatcttttccaattcacaaggttaaaaaatgatatatctatgttcccttcatttggatttctttgatgactagtaaggttgaagtcttttcatatatttattagtcacagatatttatttttatgtgaaatggctgtttgtaatctttttaagaatgtttatagttttaatactaatttgtatgattaggcataataatcaatgttaacttttttttttaccaagtgccaaacattcctctaaacattgaaaaatattaacatttaatcaggcatatacattataaacatttcaccctgttgcttttgtttctctttcagccttgctcatgtggttttttttttgttttgttttgttttgttttgttttgtttgctataaaagtcgtctagattttgaaattcctttgtgatttctacatttttggtcatgtttaaggaggtcttcccttttgattaatcataatgtttttatacaactataagatagacactaccatgtttcacatttgtttggaaattcctggtggccattctcattgtctggaattattctaaaatagtaaatgttttttaattccaaaaaaaagaagatgtccaatggcatttttgggaacagatataaacatcagtgtatctgtcaaggagatgagagtgagaagtgggaagaaggaagcaggaggaaggtgacttagcttaggaagtataggtgcttgggtggccacagagactgctcccctgaaatgattctgggtgattcttttttgttttttgttttgttttgttttgtttgagatggagtcttgctctgtcgcccaggctgcaatacagtggcatgatctcgctgactgcaacctccacctcccgggttcaagtgattctcctgcctccacctcccaagtacctgggattacaggcatgcaccatcatgcctggctaatttctgtattttcagtagagacgggttttcaccacattggccaggctggtctcgaactcctgacctcaggggatctgtctgccttggcctcccaaattgctgggattacaggcatgagccaccgtgcccagctgttgtttttttaatggggtctcactatgtttcacaggctggagtgcagtggcaccatcatagctcactgcaatctcaaactcctgggctcaagcgagcctcctacttcagcctctgaagtagctgggactacaggttttataccaccatgcctgactgattctttaatctgatactgtcagctcttcctcatcttcccctttggcctgaccgttccctaggaggggttcactctccctcccttcactgtttcctgcccacctaatccaaacctcagatccacactcaaaacaaagctgatgttttcaaatagaacttcttccaacactaaaatttctttcccaaattagtgaaatcagactctgcaaaccaagcaccactttaaaggtttggcttttcttcctcatttaaaaataacgatttgcaagaaataaaatacaaaacataggtgtaatgcatctcctatgacctcacatttttagggtttttttttcttgccaactgatcctgcattcatgccaatgtcccctttttgtttccttaaaagtactcagttgttccatcaaaagccaaaaagaaaataaactatgtttctcaggcaacgtgaggcaatagcaaaggcctccagcagtttgggaacagtttttgattgaaaggaaagacccaattttaattgtcagttatttcctccaggaaaaaaaaaaaaagccagcttaagtgtctatgtatagagaaaggcaaagttttttatttgtttgttttcaatttgcccttaaggcatttatagaaaggaagtaaacatagataatggtatcagacccgttatctcaaagtaagggagaaaaaaatgttccaagtgttataaattcaaatatcagccctgaaactactttgtctctagattaacatttaaattcctaagcacagaattatgcaatatcttaaaatattatttctgagtattatttaaatatcatttcacatgcacacataaatatacacactccagcataaatataaatgtatgtgtatataaatagaacagatatataacagatacgctgcatacacaaacttctatacttatgtgtgtatagatggaagcagcgtagtactttccaaagccaaccacatattttgaaaagagaaattcattcaaaacacaaaccagcaaatcagttctcctcccctggagagatctgacaattttaaggtcccgagcataagtacttctggctctttctagcaggcatattcccaaggtagtgtctctaaaggcaaacatacttttgtggtaggtaactgttttctttgcctctgaataaccgtgaccacattctcatgaagaaaattgtggcctgtgttgccagttattttatttttccagagtagaaaaaattcccacccgaaggcacagaaattaaagttcctaaaggaaaagcccatgtctcattaccgttgggagggtgtccctcaaattctcacgtataatgacaatctagttgtgatggagactttatattactttctagaatctggaacgtgtgtgtgtgtgtgtgtgtgtgtgtatctcaacaccttcaagtatacatgcaaaactccagcagaatttagctgcagttgacattagtcggttttaattgtttcattttcttcatctctagtatctttagtttattattacattattacttatgctccctatttaatcaggcatttatgaagtctctgttctgcatctggcactgtgcctggtaacatgcatgcaaaggttatttctttcttcatttatttcaacccataccattccatgaatatttggggatgtgcaaacgtaaagattcctgccctggaagggcttacagtcttattttctttgccatttccagagaatcaattcttaaaattcgcctgttatttataaaatgtctaatcttattaaataaatatttcaccttatttggggccaagaacaaagcacataattcatcgtgaatcagttttcataacagagctctcctatctggtgtcatgtcaacagatatggattcaggccagggccacctgtgttacacttgtctaaatattggagtttgtaattacacaggaagaacagagctcatgtttcttcaaatcggtagctctttttttctctgatttagaaaaaaaaagtaccaatctgttagaagagacaatgtaacagaaagaatacatgtaaacatagttgaaaaattgaaattctgatagaatttatcattataattttaaaaactggtaaacttagaaacttcggcatctggcttcagagatttaaacccttacaaaagaatgttttattccatgagtcctaggtggccaaggtgtagccctttgcttaatgtgttctttaatgccatgaatatggagctctttagatgacgtctgttcgacttatttgaacatcagcatgcacatgtttttaaatatggagctctggagtcaagttccaagtctaataactgaatctgattctgtgtccataaaacctaagacatctgacagtggttttgacctggagaactttcagatcatttttttttaaattttaacaagtattattgtgtcttaggttgggttgtcccagagcaggcattaagacaaagatgagaaaacaagcagtgcatttaagaaatcctgagaaatactggtaaaggtagagaagagagacatggaaaagaagaatgcaataaagatcatcatcaagccagttgccactacgggcaatcagggccccacctggctgaggaaagcaaagtcaaagaacaaacctcagctatcccacttgactgataaggaagctgggccactcactttctaattcctacctgtaactgactaaaagccattctcagggacactaagccctcaaggggagaatcatctgcagtctctctctgttcacatgtacagtgtatcagtcagggttctctagagggacagaactaataggattgctgaacatataaaggggaatttattaaggagtattgactcacacgatgacaaggtgaggtcccacaataggctgtctgcaagctgaggagctaggaagccagtccgagtcccaaagctgaagaacttggagtctgatgttcgagggcaggaagcatccagcatgggagaaagatggagtccaaaagactgaaccaatctagtcttttgtcgttcctctgcctgcttttattttggccgtgctgacaggtgatcagatggtgcccaccagattcagggtgggtcggcctttcccagtccactgacccaaatgttaatctcctttggcaacaccctcacagacacacccatgaacaatactttgcatccttcagtctgatcaagttgacactcaacatcacatgtgcaaaaggtgagtgccaaagggaatatggctgtaaatcatttttctgtacaaattctattacaccaatttaattcctgacttagttttccatatggagtggccaaataggacctccctccacctttgttttttgtttttctattttcattcgcgttgtgctagaattaaccaattatagtttcaactgttgtaagtcttcttctgtggcccttatttctaccaagtccagttttctttttctttttttaaatttattttagattcaggggatacgtgtgtatgtttgtcacatgagtatattgcataaaggggtttaggcttctagcatactcatcactcagatattgaacactggactccgtgagtaattcttcaacctttatctccctccctccttccccaattttggagtccccagtggctatcattaccatctttacatctatgtgtactcattgttttagctcccacttataagtgagaacatgcaatatttgattttctgtttctgagttcacttaggataatggcatctagttccatccatgttgctgcaaaagacatgatttcattcatttttatggctacataatattccatggtgtttatatacgacatgttctttatccaatccactgttgatggacacttaggttggttccatggaggtccagttttcttacatctaaattttactctgcagatttagccattgtcatttttatttgtgtttgattgcttctactagggacagccactgtaaatgagattaagaaaagcccgccaggtgcagtggctcatgcctgtaatcccagcactttgggaggccgaggcgggtggatcatgaggtcaggagatcgacaccatcctggttaacacagtgaaaccccgtctctaccaaaaaatacaaaaaatcagccaggcgttgtggcaggtgcctgtagtcccagctacttgggaggctgaggcaggagaatcacttgaaccctgaagatggaggtttcagtgagccgagattgcaccacggcactccagcctaggcgatggagcgagactctgtcaaaaaagaaaaaaaaaaaacagacagtttgacctctatgttagccaatcacctaaataattgtgaccattcccccttacctagtccaggattgctccactgcagtcaaccagttccaccacttacctacttgtgtgaatgttaggaaatttacagtttagccttcttaagtctcaattgactcatttgcaaaattgtgctaataataaagacctcctaccttcttgttaggaatcattcaaaggaaatcctttaaaaggcctcctggcatatagtgctgttccatgtgctatttattaggattgctgttgtcatttcagatcattataatatgttagttattttatatactactgattgctttgccaaaagtatactcaccacccatactatttgtaaagagcaaacggttgtgtcaaaatgacaatcagaacgttccacttctgggttaatacccttcctcatagggtattcactggtgagagtgataacacgaaatgtgtaatgagcctggtacctagcagacactaagcagctgactttccccttttccttccctgggtgtatatgccttgaacctgaaggataggaaaagtgatgcgatgatgagtttctagaaattgaccttcctaagcacagaagggtttgagatccactgatggacgttttattaagttggttatagtgaagctccaacatcctttccaaaatgccttaagaaaggtgtgatttctcttctaattttgtggctctcgtaccatcagcatgtaggggtattctatgtgctacttacgattttgaacttagtaaattgtttctatacgattcacgcatgtgttctgtgtttttgtctttttaagatttgattgtgggtgcatttggaacaggaaaagtcgctgtttacaggtatgtggttggtagtattcaaatgtttttctcattgtttcaaatacattttcttgttagttctgccttaaagagagcattccaacgatttattctggggaatatttagatgctctttttaaagtctagaggtattttttgctctcactctttctttcctttgcatttttactctcatactgcatgaccaaacttccagattttatgaacataacattaaataagatatgaaatgaagcagatcttataaaatgacccactttttagacgttactgaatttgatttattctctttgctttggaaatgcattgaaatgttcacttgtaaagaagcggtgcagggtagaagaatgttactatttatcctggcttccataatcaaactggacactaagttagggaatagaacattccaagagttggtagcctccaaaggcaagtattgaaaacagttcaaatacaacagctatggattccaagcctggacattccatacactgacttatttgtaatcttgggcaagttcttatcactttcagagtttcagatttctgatctgtaaaagaaggataaaaacaacatttataacgttacctttgttcaaagcattcagtgagaatatgcgtgtggtgtacacagaatagtaactgggagagaggtggtgctcaactttagcttcttttaaaaaaaaaagttttatggcaggacacggtgcctcatgcctataatcccagcactttggggggccgaggtgggcggatcacttgaggtcaggcatttgagactggcctagtcaacatagcaaaaccccatctctacttaaaatacaaaaattagccggacatggtggtacacgcctgtaatcccagctactcgggaggctgaggcatgagaatcacttgaccctgagaggtcgaggttgtagtgagcagagattgtgccactgcactccagcctggaagacagagtgagactccatctcaaaaataaacaaacataaaaggtcatatgacttatgagaattcaagacactaggtcaggatatcaagacaaaaggccgagggcatacctgggtgtactaggtgcatagtgctaacctaatcggcttccagagatattctaaggttaagtttcctcaaataggtaagattttcttcttcgtcagtcccaagacaaactcagagagggttgacttgtaccagccatatcccacttaaggttctagagaatcagacagtcaaaaccctcaaggtgtctgaagtatggggcttgcgtttgcggtggctgtggagtgcaccactcagagctgctggagcagaatgggcacagggctcagctgctccgcttccaatccgccactttcatgccaaggccttgttttccatgagctgctcccagccaattagcggacacaacaagaacacaaatgcaggcctgtttttgcaagacatggaactcctctcacgggcaaatttggctcaaggactctccattgcccaggccagaactttcttacccagtcctctgtccttcccttgatccttccagggatcagaactcccagccccctccatctccccacttttcctcataagtgtttgatcccagtatatctcttgcatatctagttccgttttatcacctgcttttccaaggagtggaactaacacggtattgaaagcaaaattatgtaacaaaatacagagaagtggcttgaaggaacttaggaggaatcccatcaggcccactgcttattgtttaaagcagtgctgtaaacccattcagccccaagacacagcccttcttcttgttggggggaaacttatccaacatggcttcatttctccctgtcatttgaggactttggcttccaacgatcatatcttggaaccaagctttaaaatctgctctattcccttcccccatgatttattaatacttttttgttttgttatcctcatctgggtggctgcaattgagtttacttacactctgtcagtctctctcctcaaatttggctacatattataatcacctggagagtttgtttaaaattccaatgtctgatccttaccccataagttctggttcagttggtgtggcagggcctgggcatagaatttgttttaaagctctttaggtgattacattgtgcagtcaggattgagaaccacttctctggctgatgtacagaattattctgcaaaccctgcttcgtgtatttagctaaatttgcaaagctcagcttgaaaactatcaacagaaatttaaaaattatcaatgataatttgcaaacttcaagtactcacaaaattaaaattatcaatgaaaagttgcaaacttcaagtactcacaaatacgaatggctgtaagatgatgtatttcatcagatacagatgtagatatgctagcaggtggcagagcaatatttcacagcaatattgccataataccggaggcccacttcataatgaaattaggttgtgtacgcaactttgcttgacagacccacagcactctttatttgtatttgtgtgcttccagatgtgttttgaggtaattagttgagtgtgatacccagctgttcatgcagtgagcaaaattcttggcacaaatgctgagaacgttggcaatggcctgtggagtattctgtctactactgagttcagtatgcagtgaagtgggcttctgcctgcctatcacccttgtgttttatttaaacaaaccctgcattttctccccgcagagcaagaccggttgtgactgtagatgcccagcttctgctgcacccaatgattatcaatcttgaaaataaaacttgccaggttccagactctatgacatctgctgcctggtgagttagtccggtgcttctcaaactccaatgtgaattcacatcacctgggtatcttgtgaaaaatacagatttggattcagtaagtctggggtagggcctagattttgcatttctcgaaaaaagcttcaagagatgctgctgctgctggtctgtggccgaagtttgagtagcaaggagttagtctttcaagagaacctatgatatgatgctgatctttggctatcgacttaccattcaaaggctacttctctaatctataggctctaggtgagatgagaagtataaaaacatttggggaaattcccagtcaaacaaatcttggagatagctcttagattcttggtgtactaaaataaacactaaccaaggtaaaaatataacaaaatacctagactcttacattttggcatatgcttatagatactgcttttcaagcacatataatgtcctgtttatttatttatttatttatttatttatttattttttatttattgagatggagtcttgctttgtcacccaggctggagggcagtggcacaatcttggctcactgcaacctccacctcccaggtccaagcgattctcgtgtctcagcctcctgagtagctggaattacaggcacccaccatcattcccagctaatttttgtatttttagtagagacggggtttcactatgttagtcaggctggtctcgaactcctgacctcaggtgatccacctgccttggcctcccaaagtcctgggattacaggcgtgggccaccatgcccagccgatgtcccatttctaactagtcaatttactgggttaatttactgggttttctatgctgacaacagataccagttttgtaacttagcatgcacagctagacagaaggaacacattatacaagatttttgtgccataagctgtatttttttgtctgtcattaagaatagcgattgaattattccttttgctggatgatggaggctttgcttgtactttcagaagctggctgatatgactcctgaaagtgttccttctgaattttgtcagccatctggagggagtacaagatggaacttgactataacacagttcaagaaaataccactgtttcccaatatgtaggtcctcaagagttagaagtcactatgttggttaataccttcagggtataccctctgaaagatcaacaaatccttggggtgtttaatattttgcccttatttttcaggagacgtggtctaactcagacagtatttttggtttctgagaatgtcagaattgcagaactaaccactcttgacccagagaagttatttccagccaattttaacatgttgttgatggccttttgacaggagttcatactggagtcaaagcttttgagggtggagggtggggacttagaggaccctgaagaattctttgaaaaacatcctattgctgggagctggggagtgtggcgggagagcatcctcttctttaactgctcttgaaaagagttggaaaatgccctgggcacatttggttaaaaccataaaatagtataatgaaaacctgatctgagaaaatatgtcagagagccagcgtttatccttacccctgcatgattaaatgaacaatgaactgtgagagttgctacttgttcatgagtattaaaacttcagtatttcccccaaataggctcatgttcacaccttcataacagaatggacttctaggctgaattcctttaagcacatgtggtacactctgatatagaatgttgttgttttgaactagataattgattctaagggtttttagtttaatgcatatttgtataagactgaagtgtgtggttttttttttttttttttaaccagattaagagttctgtttggggccgggcgcggtggctcacgcctgtaatcccagcactttgggaggccaaggcgggcagatcacgaggtcaggagatcgagaccatggtgaaaccctgtctctactaaaaatacaaaaaattagctgggcgcggtggcgggcacctgtagtcccagctactcaggaggctgaggcaggagaatggcatgaacctgggaggcggagcttgcagtgagctgagatcgcaccactgcactccagcctgggtgacagagggagactctgtctcaaaaaaaaaaaaaaaaaagagttctgtttggttttatggaaagaatattactttttaacaagaaaatgtctttcttttcatgagccattttcttactgcatttaatcatattattaagataaagtgcaatttgttatgtggacaaatgtatatccctttacaattatatttgtttctattgcatacatttttctggaagaagtcttattttcacatgcaaaatttgtgaatggtgcctcagagcctcagaagacagaaagttaacagctggttcagtctagaatgtgtttctttgattctcttttttctttattttaggaacttagcttagtttttccaaaatgattgaaaggtctccgttgattttctctgctgttatttgtgtctgtatttgatataactttatatcatacatctgaaaactatcacataaactctacttggcaaatagttcttcacttccatcgatgtggatttctgtgtctttcaaacagcggtgtagttttataaagtatctatctttaattggtatttctaagttagaaaaagggggaaaaaagccagctcaataaatattaatataactggtgactaaccaattacaaaaagaaaaactagcgaaatacttcattttagaaatgtaaaagtgagtaacgacccagttgtccaacctgattaaaaaaacttgtcagatgtgagtgactgtgtgaaacctgctatttgctatcactgaaataggagtgaaaactgatgagaatgtaaaatgaattgctttgtacttttaaatcgtgtttcacatttatctcattttctcttcatcatagacagctgtgagcacagtcacaacgcagaatcattattccaaccgtgcttgggttgggactagcctcagaagatcatgtagtgtatcaccctgccttctggccatatcaaaagcactgtccacaaacagtttaatttagaatttatgtaataagggacttggattgatttgatgggtttttttgttccaatcagacctatttagactaatgggccatactgaaaatgaccaatatttctagtttgaaattttaattctaatttaatgaaagtttacagctttccctaatgacccaagtatactttgtaattagctgtaggcctgcaagtgatcctaattctatgctccatatgacctgtgatgtatgtgtgcttatatataatatagtatgttttcctaaattcagcatgaacacatcagcccactactataaaatcttgaaattttctttagatcataacacagagtttgaaaaattatgacttcacagactcttttccactaaagtaatctattaactggcaggtttaggttggagtgctattattgagaattcagtacattgtagcagtgatattacacttgtatgaaaaaaaagttaaagtcatccatttggtaatgatattcagaaaacagaaagagtgagctaagaaagaaatagagatttatactgacaggtaattcataaataaatagtaaccctttagctgataacatcatttatcaactatataccatcccataaggaaaaaaatgttcatttgtataactttattcctttttaaaaattagttattttgaattgtttgtattaaaaatactgtatctaaaatgattttaatgtatatatgttgataatgtcattacaaataggaatttattttataaaagctaatggctttggtctacacagttaaagatgaatggaaaaaaagatcattggctgatttgaacatacaccaaaatactttcaaaaaggttggatacagaaaaattctaattttgaaagccaggcttactacaaaattgaaagatgtgattaactcttcatctttcttgaataattctaattgaagcagaagcaagttggaatcagtgatttctctggggaagcggaataaacacttgtaatagcgtagacatttcaggaaacttttggcttaatggtatgtggcaaattatttaccctgaggggagacattgactgaggtcacagcagatagatgaatcccagatgtgacactttttcattatatttgacacaggaagctgacacataattaaagtatgattggggattatttactccctttgaattctgtagaaatatccacatcatactatagtattttactggtaaaagtttatgactgtcattaaaccatacttaagtattttcttatattttcactttcctagaaatgtgaaaaggccccatctctagtgatagctgttagggcttggaatttttcagggagaggtgagcactttcattcaacaaaggcagccagggagtcagtcgtctctcattccatctgtagccacagaccaaagccaagtgcagatcatcctataagccagtgcagacattgccttgaatggtagtgatggtgtgttcaaggcacaactccaaagtgtctctcatggacatctgccctctcttgattgtctttattcctatatcattgtgcccacctagcttgagacagccatgctaaacttcctgttttctctttctcccctccctcttctcgtctcaacctccagtcttaccccaactgtagcaaggttctgccaaatttcatctccttccaagcagagtgggtgttttaagttaagcataccatgtgctccatgcttctgaagattaaatctgcattttttagcatgactttcaaagccctgttcctcaccgatccaccaagccagccttgcctcctacaactttgccatcttgctcagtgccccgactacactgaatttcttcagtttcctcaaatgggtccagattcttactcacctccagattttacctctggctatcctcttgctctgctgcctaattcttccctccctggcacatggaagatactgacctgtattcattgaataaaagcaacaagtaattgactaattgagcaactgattaaatcagttaacctcctgtactattttccagtattaccttccatgtaataataatgtcacttgtcttgattgtattagtgttgagatcaattggtagaaggggtgtgtgtgtgggtgtgtgtgtgtgtgtgtgtgtaattagaaatatatagagaaaatgatattcgttatctgggattaggtaaaggaaggcttctactttagattcaaaactttattaaccaataaattactactattttctatagcttttctttaagagtatgtgcatctgtcacaggccagagcattgcaaacacaataggtaagcatgttttcatttttacattcttatggtatactaagaaagttgaacagtaaccatttctctgcacagaccataaaaaaatgaaagaacccttgaggaataccaagatatctgttgcatatatggaaccttctaataaatattacttcaatacttggtaatactattatttataagaacatataattgtagggaaaatgacaacttttataaaaccattataaaacatttgtagcttggagagtatgttatacaatttttccagctcatttatcatgcttggtctcaactatgaaaaagaactgtttcctgaataagcaacttgaaatagaaattcatctctctgatagagcactgtgttcactgaatactttttctctactttacttctgtcctttagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagtaagtattccagaaagacttctctggcctctctccttcatatccaaattccaaccatttttctccatttaaccatcatgtttgtctgcatagacccccatctgtctgttttcattttcatagcaggaaactttattttagggtcaaatactctcctcttgaccctgacttcaactaacctgatgatgtgttgctattaatttctaaggcttcttttcattttgatcaaaatctttataatggcattcagctcacatggttttcatttctacccacctcctccccaaaatacataaaagtgcaacacagtttatgtgaatttttctcctatgtgagtatgtcttgttagattttatcaatgcatgtttcagagccaattcaggaaaatatttaggcattcaaagcttttattagaagtaacttataattatcttatttaaagtaatgtctttttacaatgacttcaaaacctaccgaaattttaaagtaaaaatatttataacacaattacctatcttcaccttgccggttgtgaggttgtgataactgtctcaatttctcttttccattaggggacttagttagcaaggaccaccctagggaagatcacaggttcacaatcacactcaagaatgaaaagttggatacctgacccttgattggcaaacaattgaagggtgacatatccaccgtgtgtttagtgcttgctgtttggtgcttacccctctctactaaaggagttctgtttctttttccaaaagaacttcaaatatcctgaaggtgttctgaagttcatgcaggcaagggcttaaaaagatgatgagaggaagagaatcaagatgttttcttcttctgagccccaagagagaactcataaattctggcaacctcacgaaaataaaaatccaaattcatgatgttttttgtgacatttatgatatacacgtgtaatcttttactttgcaacttgaccagttctgcatgagttgttgaaggtctggagaacccaaagattggctccagaagcgtatttcaatgaagccgcagctctaaatgatttcatcactgcacatatattaggtatgctggctactatataccacataaatcagcctccatctaagcctgctgcaaagataattgtttcatcattcactttcattgagtaaattccagtgttgcctgacttttgcagactgacatcttgcagctatttcatggagcctctgttgagtttgtgattatttttcctaggatgaaactgaattccgagataaattatctccaatcaacattagtttgaattacagtttggacgaatccacctttaaagaaggcctggaagtgaaaccaatattgaactactacagagaaaacattgttagtgaacaggtaagtccttcacagtctttgacggcattttctcaagcaagctctctggggtgttgttctcatggctttaagactaaagccagctcctttcatttttacttctgcatgcagacatggaacatttgggagttttcctaccatgtttcctgaaacactgcatgattgtgtttttcggaagcctttcctcttgtgcaatcaagatttaatttgttcaaaatgtggctgtaatggaagcaatacagcctgtaatcctcaagccataggcagagttgcattctttgcagatatttcagagtgcattggaattgggctattatgtaaagtagcctgtattgggaggtcactgtgaaatgtaggctattggcttgggtagagtcatgcatagtgagaggaaagctctggttccgtttgtggcaccattcagaattttcaagaaaaaggatgtgaatcagattttcctagattgttcctgacgtgcgtttatacaacacaggctcacattctggtggactgtggagaagacaatctgtgtgttcctgacttgaagctgtcggctagaccgtaagtttaaataactaaatgtgtactttctatctaatggaattacaggtatttatgtaaaggttctctggagaaagtatacacttccaataactaccaaaaactatgctgcgtgaaattcttgagcttggctacactttgggttagcctgtggtttgggtcagttatttgtcattggtgtcaaatgacacaccctaagattttgcctgggtcgtttcatctttcagcaaaagtggggaaaaaaatgtttttgttgaaagtaaactcattgatggggtggctcgggttatgtttacttgcctcagtcaagtagacaaaggattcagacaggcaggttccatctacaccttcaaccaaactttttttcagcaccccatgactcaaagccatccttaaaactgtcaaaacaaaattaattttaacttattgaataaataaacctaaatagcactctatggagtaaagcagaaggtgtcacaaaattgaaacgaatcaaagggcttcacagttgccagtaatggacgcccccattccagcactggaaattgcactgtattctgttatgggaagacatggactaggatgtaaaacattctgtggtcaagaaacagatttgtgtttctttccctcccaggaactatctcactgccagtgtttggaatctgcttggtaacttctcagagggacttcccccaaatttcataatttatcaacttcaaatgcaatcgctttaagtaaggttaaaaagtggagtaggcatttccaactattggcttgatttgcagttctaagtgaactgcatgtcttcaaaataccttgaagtcctctaccagtgatttaagatcttattgtatctgcctgcttcttccctctcattatttcctttgcattaatctatccctcttactttctaaaccacctctcttccttttattccattgcccattttcttcctaatgtatgttttcagtgaagtgctgaagctgcttcattctggcttgtaagtgaaatgttaaatttgcagtaattttgttggtagattgttaaatatgttggtagcttgaaaatgaccacggttcatggatttacaccactggaatctgaaaatgctataaatcaatccttttttttttttttttttttttgagaactggttgttaaacatttaccaacacactactgggtgttttcctgccctttttacccagagatgattctcttgcctcttcctaccatctcttcatgatggtccatcttctttttttgcacttgccatttttcttttcctcctctataaatccttaaataaaatattcacgaagccaagaagtagagtacctaatccttctttttaaactgcatttttagagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaaggtaatgcctgcaaattgtttgaagtcaagagctaggtatatttttgaagtcaagtaaatgttaagaagggccatcttagctgagagtttcttccttaatgaaagacagcaaaatgataccttcttttgttaaatcataacagcaatgagccacaaagcaggggtgggcttacacagtattaatgtctttctttgccacagtgcaaagatagattggccaaagattgagagctaaagcaaaaaagagaacaagactggctgaaagaagaagcttaccaatgcgatcaaaaagctaaactcccaagctaactccctgtcttcactgacttttctagccttgcactgagttcctatcagtttcaagcacatgtcaggaagcctggttttcgttattggttagggaagaaggtccagccaatccctgatgagcactgataaaagcctggaccgacacaggaagggaaacaaggtcctttccctttcttcttggtccaccttgtcagaattatgaccaggaacagcctggtcttcctcatttgccattcctcaatgccactatttgtttaaatgacaacaatgctatttatagtcttccccttccttatcagaacatgaatcttcccattcaaagcatcctccagttctgcagtgtccttaatcacttggtctagaaaactattaaaaatacattgtagaataacagagaaagtccctcagtgtctgaaatatacaaactcacaattaagggtaaagcccaagtttcacgtttcctttcataggatgaggtgtagagtaggtgctccttaaatacttgctgatagcattgttcatttagcttaaatgtattaaatgtctactagtttccaaataccacaccccctgaggaccttgtccattttaatgattgaataatgtaatgaaaagtaattcttctaaacagatgttaacaaactgttgttgtgatgttggtattttaaaggcattaaaaaacttagggaatataaaattctctattcacacttctagtctcatgatttttgtttgttttagttgaacgatcttcttagtaaaaaacaaaaaattaaaaaatctagatgggtaatgatagagcatctttaacagtcatttaaaatccttgagtatctgttgaagaaatgtataagaaaaaaaaaactccaaagtcatcaaatgttatccattaaatatgtactgctgttttgtgtatgtcagtcacatcttaataaagtagtttttaaaaaaatagtcctaaattattcttaactcttccatgttgacagtgaagttggatagaggggaaaaataattccatttcttttcaagagtatttgcaaatctccactcagctttcatttccctgttatttcaaacatgaaaatcagtataaaccctaatttctccagtgagtggtttataatcatcccattttcttctttcttgtatttttttttttgagacagggtcttgctctgtttcccaggatggagtgcagcagcgtgatcatagctcactacaacctccgattcctgggctcaagcaaaaccctcatctcagcctcctgagtagctaggactacgggtgtgcaccaccatgcctggctaatttttgtattttctgtagagagggggttttgctatatggcccaggctggtcttgaacacctggggtcaggcggtccacccaccttggccttccaaagcgctgatattataggcacgagccatccttgccccgccaattatgtgattttttttaatcctcttcatttctctattaaagtcactttaagataaaaataaataagaataaaggaagtaattatacacacaacttataaaaatggtgtttaataaccactttgatttgaagatgtcatttcataataaaatctctacaagcaaaaacagaaagaaaaatgacgtctacaaatacttacctgcagataacgcataaacaaacacaaaaacaaagcttgagtatgttttgtttttaatattccagagctccactcatatttttatttcaattcccttcttgtcactccacccctgacttcactaaacaaaggacctattctaaaatgttcttttagcagaacatccagtttactgttggctttgttgcatagaaaacacaggagagcacttaggagtctatctttggctgtaaacattacaagggacattatctgcaatctcaaatgattccttcactacttttttctctgtcaatttccctttggcagagacttcactcagtctttgaattttacgtgactaagccacattctaatttcttccttgtttggaaacagtttgaggtttgtgtaccttttgatttcaactcagttcaagattttttaaccattttttcctcaaggggaaaaatattaggcattatctgattgtaaggttggctattgttttgttgaaaacattcgtctttttagaaaatgtaaatgcttatcatctcttgctctaggaaaccttagttgagccagcctttatatttccttttggtgatttttctccttaatttttctgtgaaaaaaggtgtatatgttttatatttatcatcatcatcatcatcattatgatagtagtaagatacatgtaagatataatttatcattttagccattttcaagtgcgcagttcagtgacattatatttacgtggtagtgcaaccatcagcactgtccatctccagaccttttacatcattccaaactgaacctctgcaacccttaaaaataattccccattgctccctctccccaggccctggtaagcaccattctactttctgtctctgtgaacgattctagggacctgttatcatctcttgttcagtctctcacagccagctcgccttcagcatgtctgtatccagacttttggtcttcccactcacacccctcttcccttccattttcttttttctttccttttttttatggagtcttgctctgttgcccaggctggagtgcagaggcatgatcttggctcactacaacctctgcctcctgggttcaagtgattctcctgcctcagcctcccgggtagctgggattacaggcgcccaccaccacgcctgactaattttagtatttttagtagagatcagtttcaccatattggctagactggtcttgaactcctgacctcaagtgatcccccagccttggcctcccaaagtgctgagattacaggtgtgagccaccacatccagcttccctttcattttctatgtacaagaatgacatcagcatcccctggcttctaatacctaaagtgatgccagcctggatgagggtgatgacagtagcagttggatggagagaaggatatgaactagagagattgtggactgagtccatccaacagccactgtcaccaccttcatccaggctgccatgatcttttgcccagattattgcaacagtcttcctagtttgtcttgccaactccttacctctaacctagaaaaaaatccatctttctaaattacaaatctgagcatggtactgtcttcaaatcctcactagctccccattgcgttgaggataagatccaaatccgtcagataatgcatgagacccttgatcatatcacccccactcacctcttcagcctcatcgctaaatgctgacgcttccagctggcttgagttccttttccattcctgtaatgacacggagagcttgttccagccgtttctcctcccaacacactaactctgctccctcatcctctttatctatcctacttattttcaattctttctactcatccttcaaataataattgagacttaataaaaattgaggcttaataatagttgagacaataataattgaggtggctaacatttactgaacaactgctatgaactgggtaattctctgagttcttgaatgtatttcattcttttttttttaatagcattaggagatatacctaatgtaaatgatgagttaatgggtgcagcacaccaacatggcgcatgtatacatatgtaacaaacctgcacgttgtgcacatgcaccctagaacttaaagtataatagtaattttaaaaaagaatgtatttcattcttataacagccttatagagaagctgctgtcactatccctgttttataggtaagaataaattaagtaacatgcgcaaggttatacagctattatgtagccgaagcaagttcaaacatcaactgttaggtccaggcccctgtttgttttgttttttggttttgttttgtttttttgagatggtgtctcactctgtcacccaggccagagtgcaatggcgcgatctcagctcactgcaacctctgtctcccaggttcaagcgattctcctgcctcagcctccctagtagctgggattacaggcgccagccaccatgctcagctaatttttgtattttcagtagggatggggtttcaccatgttggccagactgctctcaaactgctgacctcaggcgatccacctgcctcggcctcccaaagtgctgggattacagatatcagccaccatgtctgctgggcccctgttcttaaccactgatatgcactgcccccatcagcttagatgccacttcctccaggatgccttctctgattgcttggatctatgtgcaggtcctcctttgtcactatttatttatcctatcataaaatttcccaactctgctgcaattgtgtgtttccactgctgttataattgcttagaattacttgttacgttgttaaaataattaagaattcagtgaggacaaggggtctcatttgtcaggcctggtaaatagtgggtacacagttaatattttcagtgaatgaagaacactctaagagctataaatggattagaacaagaatgtcccagaaactgcagaggaaaataatctagaaatgtccataaaaagtcattgttcctcttattaacgagaggaaataatgcctaaaaaaagaaaaagggtggaggggatgtgaaagggagaaaaaactctttgagtgatgtcaaagaactatttccagaaaactggggaaaaactgtacatataacttttaacctttaggtgagatttaaaaaaaaaaatttactatagaaactaaatccttgaatgtaattcaagggacatatgaggacttacggaagatttttctgggttttgttctttctgttttcatgactgagttaataatcccaacacaaagcatctctgtatgattagcggttagttatggatccttaaggagctgaagacatactaaacctaactttgagaagaaagaatattaccacctttttgaaaagatgttttttagctcatccgacgtaactaactgtctttcaggatatttgaagagaggatgtattaaattgtgcctccaaatattagtgatccattcctttctcaataactaggacagatatttccatgtgtctgtgtatctggggattctgggggcagggttttatacttggttgcatacttgtctgtttcattgtagccttctcttttacaagaaagtgtcagctgcctctactctgttgttcctgaaccatcacttactttgtgtccaagtttgctctaggcattaggactagaacagacacaaaaacctctgccttcttgaagcttatattctcaaagtgtgtggtttacctacagaattctttagctagatgtctggggaatgtttcatgttttttgcttgggttttcggtttgggcttttgttaataaaatagaagggaatggaagatcatttctgaaattttatattattctcttacctaaaatttcaatagataacagacaaggacaaaaaaacaaataaaaaataaaataaaatttcaatagagctgacagatggataaatggtcattatattgagaaccctcttccgaacctatcacagggacagaaattccccccaaatttgctgttttatgaaagtcctcatattgcaagcttaccttttggaacaaaggtgatggataatatatcgatggcacataacaagttagactgaaataatggaaaaatgtaagtagctatggctgcatgcagagtgggaccatagggtttgcggtatgggaaaagaatagggtagagagtgaggggtgggtttctgagcaactgggaaaagcatgcggacatgaagaggagctggaagccaagggcaactgttccagaacaaatctgtatttcccctctcatctgttcaaccttgagaatttgtccagtatatagcttcaagaacctcttctaacttcagtttgtatgaactctacttggaataggatataagggaaggaaaggaaataggaagtactgctaaacatgaaggtattctctttacatctgaaatactgaagaacagaagaaagtcgattgcatgatctcaaaacgggaccatggtgtatagaaatttgtgttcaaggcaattatctggcaaatggtcattgaatcatatgataatctatacacattatgatcattttgtttttggaaggcttaatagaataaatttatttactcatgtttaataatttgtgattttcatgccctgagtttcacattaatcttagtgaagatattgtctaagctatttatataaatactatattatgcattgtcttccttaatgaaacacaataaatatgcttacctacccaacacatttatttctaaaatttaacttttacttttctctctccattttctcttctgagttaagggtcatcaattactttttttgcactatcgccctcctgggtgtttgagatccaggggagctcccaggcccccagcatggcttttgtgtcaggatgtcatttatcctgccccctaaaccccctgttctttgcaattgtagggatttcgaccactgagctgtgagtacaagatggaaaatgtaaccaggatggtggtgtgtgaccttgggaaccctatggtgtctggaacaaatgtaagagagaaccagaaatactgactgatttccttctaactggacttcacagggaacaaatggaaagctctccagttaccactcagcaactcagcacctagcagcaacaacaaattaggcaggaaattgccagagtagtgggatttcacattataacctacacagagtgaatcgtctcaagctaaaaacacagaaagatgcatgctcttctatgctttctctttatacattactcttgcctgtcttttagttacaacaattttatacagactttgtttttactatagatattttctttaaatactttttctttgaattcaaaaagaaatgcaatgtaagttaaagactctaaaaataaccaaattaggacaaagattttagcaatggcaattaaaggaaggacatgacattcaacagtgaccatagaattcccttttcaagggagattcaggtacgtatttgcattttaaagatgctgataagtctttcagttaataaaccttttagcctgatgtttcatacttttgcttgagcatttgaaacttttctcaagttagaatattatgctagaatgatatttttgctcttttatgctataatgttgcgttgatcttgggtattcaaaaatgtgctgaaactacagtaagctcacttcttggggcaaaaataaataaatatttcaatggcaagtacattcccatgacatattattattggttaccatggattgattgtcctctaggttataaacgcatcgctgggaggaggggagttttttacgttattttattgaattttcaaaacaaccctgtgagtcaagtattttctttattttatggatgaggaaactgaagctcagagaagtcagatgaattggccaaagcctcacagagggtaaaggttagaacaagattcaaaccaagtcttacagcaaagcccatgttctatcccgtctgcaacatggtgaaaagcccttggataaaaaacaaatgaataacagatgagacttcaaaatgaagcattgaaagagagaatgggatgtttacactgagatattagaacatttttcactatcatagtccttttatctggaaggtaatgaatcgttttgctagttttttgagaaaaatccaaccgcctattttattttattttgagatggagtttcacgcttgttgcccaggctgaagtgcaatggcacgatcttagctcaccgcaacctctgcctcccgggttcaagtgattctcctgctcagcctcccgagtagctgagattacaggtgcatgccaacatgcccggctaattttgtatttttagtagagacgggggccaggctggtctcgaactcctggcctcaggtgatccacctgccttggcctccgaaagtgctggaattacaggtgtgtgccaccgagcccagcctcaatggcctaatttaatatgaagagggttacctaagacaaaagagaaatgaattgaggtggtagtaacagtgtcagcatctgtagatgatggaccactcgttcctttttcagtattagaagtgttacagctagaccagaggtcatctaaggataatcttggaacaaaactggccaccagtatcattcaaagtggaggaaaaatggcagtgtggtcttaatcacaaatgtgtttatgtgaaagtatgtcaattcattttgccagcaaatagtctttagaagtcagggaagtaaattgtttatattcatttatctctgaggtctatagtaaaagaaacctaatagctttcttatctcattctttagtgcccttaaacacatcaaattttattgcattctgttttgttataaaacactttgatttatattcttcttcattttgtactctacaaagaatactctcagtgggttgtggtaaaattccaaatggaaaagcagtgctaaagattttaaaagcaacataaattgccaggaatgtttagttctatctattatcttttaaaaatcactttcaagtgacttggtattttaacttaaaaaaaatattcaagatagtattcagaagttttacttctgatttttaaatagtaaagtcatttccatagagtagctatagtaatataagatgtttacatgccaataagattcataacaagttgcaaattttctcatgggaaaatttttttaaacggtggggtcaataagagcgctttaaaatcaatgccatgagatctggtgtttggtactagttaaggacacatgcacctcttaccagtatgaaattgtcacaccttcattgggtctttgtcccatgcttattgttctataatgaaaaccatcattaggtagcctctatcgcaatacaataaggtttctatcactggaaataagcaaacaagaacaaactctcatcattcttttggcattttttttgttttgttttgagatggagtctcattctattgccctggctagagtgcaatggcacaatctcggctcactgcaacctccacctcccaggttcaagcgattctcctgcctcagcctccggagtagctgggattacaggcactcaccaccacactcagctagtttttgtattttagtagagatggggtttcaccatgttggccaggccggtcttgaactcctgaccttgtgatccacccacctcggcctcccaaagtgctggaattaaaggtgtgagccaccctcacgcccagcctgttttggcaatttttattgcactgcttctatatgccaggttctaagctagagtcggcaatataaagataaaaacatacaaccttcactcaataagaaactcaaaattagcagtgtcataagttgagtggtggaagagtggtaaaaaaggagacagagaataaaaaggagaacaattctgcctggcccagcccatagaatcagagaatgtattgcaggagatatctcctgtcccaagatttcaggcatgcgttagcagttcttcaagtagaaaaggcaagaaaaagctaaaaggcttctaaaaaggagagaagagcctgacagaaaattgctcctttggaatttttaaaaaaattcatccggccgggccctttggctcacacctgtaaccccagcacttggggaggtcaaggcgggcggatcatgaggtcaggagtatgagaccagcctggccaacaagatgaaaccccgtctcttctaaaaatacaaaaaattgctgggtgtggtggcacacacccgtaatcccagctactcaggaggctgaggcaggagaatcacttgaatctgggaggtggaggttgcagtgagctgagattgtgccactgtacttcaacctgggcaagagagcaagactctgtctcaaaaaaaaaaaaaaaaaaaatctttgctggggcgtaatgccttagcattaaatactagctataccagctgtgatactttgagcaagtcacactgaaatgagaaaacacctacctgtaggactgtttggagcaatgaatgatatgacaaatgtaaagccattcggacagtacgtagctcgaagcacattcggcaagggctggtgaactggtgctgctgatttatgacaaaagagatgatttattattcgttcatattattactgattcatgtgaatatgagttttggttaatggtttgattctgatactatagtggctgtgataacagatttgaaagttagcttgcagggatttaaattctagctctgtgatttatttgcaatgcacctggagcaaggtacttcatctctctaatcctcaggttgctgctcaattgtataatgtcagcaacaacagctcctaccccagagtgctttttgggattacatgagatcatgtgtgtaaggcatagtacagtgcttggaagagtaagtaacataatattacagatgtgttaactattatttttacttccttatttatatcatcattgaatttattttccccatgtttttatctatttccacgttatgaaaataataaaagcagttttaaaaatttggaaacctttaaaaggaaaaagtaatccatgtaactgtaacctcaactagaacatattattctgaaatgttttcctatagcgcatccgcactcctgtactgtagaggaatttttcgatttgtagacttttaaaaccaaaaaccatagctgacgtgcattgcacataaacattgtaaccttcactcattgttgattgttattacattagaagcattttccatattgttgcgttgacttcacagctataatttcaatgactacataaatgtccatcaaacagaagcatcatagttttctaagtcaatttctggccaggtgtggtggttcatgcttgtaatcccagtactttgggaggccaaggcaggagaattgcgtgaaatcaggagttcaagaccagactagactctgtctctacgaataacaaaaaagttaaccaggtgtggtggtgtgcacctgtgacccttgctacttgggaggctaaggaaggaggatcacttgagcctgggaagttgaggctgcagtgagccatgctcgcactaatgcactccagcctgggtgacggagcgagaccctgtctcaatcaatcaatcaatcaatcaaccaatcagtgtcttctcatatatttggattattttcaatttaacacacaaaaaggtggcaggagaagaggcagtataggactaaatggagagagagaaccaacctgtactgtgacctgaatcttctggggcctgtagttcattgcatgacttctcttggctctcagccacctggggtagaagcagaacaaaggaaagagttacagtgatccagggtggggttttgcaggaatgacttacaaaatatttttatgttgtgtacaagctactcttgtgtgattttattttattttttagtattccctgggcctccgatttgcagttccacgtcttgagaaaacaaacatgagcattaacttcgatctccaaatcagaaggttagacctttacatgcctatatcgttgacagcagtcaaaagaaaagagatccacagtgaaatgatgtcatctgtcaaggcccttggccttaaaagctcacctgaaattagaacccagactttcacagcccatttcttctttgtttttctcaattgtttcagtaatttcaacattttaggggttttgaaaaagagattgaattatacagaccaagttatgagatagcaaaattttgtcctgggcaccctcccacctgctttacttccacttttcctcattccaaagcacatgtctttccccaccctaattcccatgctctcagctgggcatcagctagtccctgagaacaaagtctgtgaaagaaaaagcatagattttgcaatggccatcctgaagtctcttcaattttcaagaatgaatgaatctctgatggcttacctatgcgcactgtggcaggatgcaggtgagatactccattttgagggcaagcccttctctagcaatgataagcagagccatataggtagctgcctctcttttctaaggctgatgctgtttgagaattcagctgtaactttaccctcttaccacctattctgtctgctcctttgtggctgaaaataatatttcgtgaacaggaagacctgaagaaagtagtagtgtggcatttgggctggggcttcccagctgtgaacttaaacccattggctgggtaatggaatcagtttaatggctctagatccacattaaaaggaaattgaatggaaagtaacatataatataatataatataatataatataatataatataatatatattaatacagctcatgaaatattcctttcagtaagtataaatatgtgtagtaagatgtctagtgagatgtatgtattttttgtggtctgcagcttaaaaagtttgaaaatctctgatgtaaacaggacatgaaagccttctatatttatttataccttgcctggcatgttgaacccttgctctaactattaaatgaatatgaagtcagtatccacaatttgagtctcaaatactagtgtgcaagatggttaatttctaagtttatcttaatatcttgcaagaagtaccattagagtgtgataacttttagaataatgactccatgcaatggattaatttttaaatagctacttcaataaaaggcttaggattttttaaaaatatataaactctgtaagaatgtagcagattttaaaaatccacaacccatgtcacaaattattctcccaccccaaactttgtatagatttctagagaggaaggttttctcaacttacttgagctgttcatttctgaccttaatgaaatctttcttgaatttaacttagacattttctgctgaattttaggttcttaaaatctggataaaatttagtgatgggatacagatggaataaattcttctgtaatattccttcattttaccaaaagcatgttaaatcatttctttgtatctgtaaaaatatatcaaaggtttaggtagccctaaatatttttattttggaaatcttctgttgatatttctaagtatcttaagaaaaaaaacaaaaacaaacaaaacacgtcatggcaaaggaccaccatccctccagacagtaacctgaagtttctattcctctgcatcattgtctgtgccattgatcctccagtgacatgaagctttgtgtcacctgtggaaagatacatctctcataaaatacacaacctttatatagaaaagaagtctggtacaaagcaaattcattgatatttcctcctcgctcttggttgaagttacaaaagagaatggatgcaattactagttcatctaagaagcaaaagacacaaggtagtgttctagatggcttccccgagtccatcctgtagatcatcattgaaataatgaattcagtaatgaagtgccgaatttgctgtaaagtagaagtggccacgtttttaacattccccttcatctaaaacaaagggtcatgactgattacattccatttctactcaggactattttaacattacccttaaaaaatataaagatgcagaaatgcagaaagaactggaatatacatacagcattaaattcccaaaacatgtattatacatataaaagcaagaatacagtgtttgaggctgggcacagtggctcacgcctgtaatcccagcattttgggagtccgaggtgggtggatcacttgaggtcaggagttcgagaccagcctagccaacatggtgaaaccttttctctactaaaagtacaaaaattagctgggtgtggtggtgcacgcctgtagtcccagcttctctggaggctgaggcaggggaatcacttgaacctggcaggcagaggttgcagcgagtcaagattgcgccactgcactccagtcagggtgatagagtgagaccccatctcaaaaaaaaaaaaaaaatacagcgtttgagtaaaacactgtaaaaactcaattactagggtatttgagaggtgagcatttatctgcatgctttgctggctgactccaaagctgtaaataaggatctaaatggatggttttgcatttggtttaaatgtgtttaagccaaaaataaattaaaccaaatgttctgaagtctaaactcttacaggcatatattgactgccatgacctgcatttaatgaatcccttttccacaaatagaagtcaagagagaaatgggctttatatgttaataaacttaaaatatttcctgttaccaaatatttgcattaagcggtctctccatgccctcactctacacgacataaacattttcctccctgtgtacaacgggtctcagattgcaattgccacatacaaacaggtcttggtgactgtcctcagagtttcttccttagtaatggtgagatgaatactgtgttatctttgctgacattccaaagaccacagaaagcatagagggaatgttagaatgcaggaaataggaaatagtaaggaaaaagaaaatagcattggagtaataaagtgaaaaacatgtctatccatagtatataacatagggtgcagttgtagagaggaaattcatcattccttgtgtagaaccagcaccaacagtttaaatagttcagcttccatggcggtgatggatggcttgtttggatgtagcagcggtattagtgagggagctttcctttcaggaaagaggtcaaggaagcatccaagttatttctcaagcctggttcctttcttacaagagatattgctgacaccgctagtatgcagtagcaagtgtcatggcaagtctgtgtgacaaaagatgattttgattagccgaccagaaggtctggactcagagtttgctgctgttcctgctgcatttcaaaacagcctctaaaagcctcatgttagattgttttcaaggatgatttcaatgttcaatgtctatttacatactcagagtattgtgggtaatgaaaactgtgttattgaaaccacttgggaagaaaatacaatagaattatgcaataacttaaatgaaactttgttttttcgtaattctaatttccacggctgccaagcagtagtgaactagaaatagaaaaaagtctggttaatctgtggcacaaatatatttaaatttccaaactgaagaattacccataatatatttggaaccataaagtctacaataagtaaaattacttaattacttcttaatggttagaattcagaacactgccttaaaaacacacacacacatttgtttagttgactgatcccagatgtgatcttaataaaatggcctggaaactggggttcagcctctggtgaacaagtcccttaagctcggtcatgggtttagtggcgatgctccattccaggaaatgagcctgacatttgcctgtttatatcttttatgtgtggttgcagtttaagttgtcttatcattatatacaatcggccaggacttttcaaaagcatcatgggaacaattctgccgcctcctgctttgaaagcagaattttatcatatcctttccagctctcgcatttggaaagcttcaaaagctagtcacaacctaccgcattaccatcatcttggtgctagagcttgtccatcgaatcagagtgaggtttgatgatgaaaaaagaggaggccttctcttcctaatgacacctgaatataaacatgacctgttagtggtgatgtggctgtgtctcggtttgctaaaagctgcctaagtttttagtgacttcagtaaaagcataataggattataaaattcagatggaagctacctccaaaactcagttactggttgagcctctttgtgaagtacgttttattttccttatagcacacacattttgaaacccatgcatttttaaaagttgtttcatatctaattatatttgctggagagaaaaaaccccagcaaacttaaaaaataattttgccactgttcaaagaaatgttgttaaacacacaccttctatctagacactcttaatgcattttgtaaatatccatgtcatctcctaattgcctgtttatgaactggccaacttccttgggtctatattcagggtattgtgggtaatgaaaagtgtgttatttaaactggtcttttaaaataccctccaactccttgtcctagttagctggtgagtatgcagtgaatatatgcttattttaatactaactgaagaaataaaccgttaggaagatgaaattgctgccaagccagtgcatggtatgatgcatcccagagccaaacacaaatgctgtttcgattatgtatttctctgcattattcatgccagttcttctctttattagcaaggaaaatcaggagttggctgtgttgttacttcctatttaatgggcaatgaacatgatatgcgcagagatgttaaggaatttgtcaaaggtagaagctgcaaaatgagctcagttcaatacatttttggtttagccatttaaaaaagtgttagttttggctgggcggggtggctcacgcctgtaatcccagcactttgggaggctgaggtgggcagatcatgaggtcaagagatagagaccatcctggccaacatggtgaaaccccgtctttactaaaaacacaaaaattagctgggtgtggtggcacacgcctgtagtctcagctacttgggaggctgaggcaggagaatcacttgaattggggaggcagaggttgcagtgagctgatattgggctactgtactccagcctcgcaacagagggagactccgtctcaaaaaaaaaaaaaaagtgttagtttctttagatatctattgtatttccagataaagtgtctcttcatagacagttgttacattactattgatcataaaagatcttagcatttctctgtacaaatggttacgattttggagaatgaatacacttgtatcctgaatgatcaggttagtaacgtgtgttctcctgtgatatgtagaatgttttttatgatcatatattgtaataatactcctgagcagatagatttaaatcacatgtccttgtgttttagttccaacaaggacaatccagacagcaattttgtgagcctgcaaatcaacatcactgctgtagcgcaggtggaaataagagggtaagtagtaagcaatgcatagtacaatatccttctgtatgtagagttaagataaaatactagtgaaaatgatgtggaattttcctgatgcattagagatcacagttcattttggatattaattttcactcttttctactgatcgttattagccttccattggaaagcagagtaaaccctaaataacaattaactccaagaatatcaaaacaagaaatcactttatgccaggcgcggtggctcatgcctatactcccagcactttgggaggccaaagtgagcagatcacctgaggtcaggagtttgagaccagcctagccaacatcgtgaaaccctgtctctcctaaaaatacaaaaattagccaggcgtggttgtgggtacctgtaatcccagctactcaggaggctgaggcaggagaatcacttgaacccgggaggcagaggttgcagtgagccaagatcgtgccattgcactccagcctgggtgacaagagtgaaactccatctcaaaaaaaaaaaaaaaaaaaaaaaaaatcactttattccccaaattgacagtgcagtaatcaaactataaaaaccagctgataagaagccagataaaatagacaaccatgtgattccctgaaaaaaaatctcaattctccaataattattttagcgtaatgactttttagccttaccacaccacatctggagtttaataaatgactaactctcagatgcaagggtcgattggatctatattttacatcttttttctttggtcctattctttaaggaaggtgccaataagcaatcaactgagagacgggggaaaagggtcaaggaaatgactaccagctgcaaaatccatgcctgggggaaaaagaaatcagaaatgggttgtgtgtagttcttatcttgcatgaaattggacttcattgatttttttctgatgattctggtttttcagaacaatcatggatttggctaaaaatgtcaactggtattttggaccaagttgtcactggggttccagaatgctggtttccttccttttccacggtggtttacaagcttcgatgatgacagctggtatttcagcaggcagagccagtgctgccatgggtcctgccctgctgtcctggtgccgctggggcgccccctagcggattagagaataatagcaatgtctaacatacactgttcccttctgggtgctactccaagttagcccatcttataaatgaactagtatcctccttgtacaggtgagggaattgcggcacaaggagttgaaggttaaactagaaaatgccagaatgtaaatataggcaactgtctccagagctcatgctcagaaatgatcatgctatcctgcctgggatatagttttttgaaacttatctacataaaatcgtattttatgtatgtttctaatttttttccattcaaaccaatgtttttgagattcattttagtgcacgtgcctgtaattcactcatgtcaactgcctgagtgttacactgtaaaactataccatcgtttatcttattttactttgagactgggtctcactctgtcacccaggctgatctcggctcactgcaacctccacctcctgggttcaagtgattctcgggcctcagcctcctcagtagctgggattacaggcatgcaccacgcccggctaatttttgtatttttagtagagacagggtttcaccatgttggccaggctggtctcaaactcctgacctcaggtgaatctgcctacctcagcctcccaaagtgctaggattattacaggccttagccaccatgctcggccaaaatataccataatttatttatctattctactctggatgaaaatgcagggcttttattattttcctttttgcaattgttttttgtacatatcttccagtacacagggggaagaatgtcagcagaggatatacttagaagtggaaattcaggatcagagagtatgctctatttaactttactacataatatcaaactctttttcaaaatacttatgccaaattacactcctgtgagaagtgggtgaagtttctgttatcccacactatcagctaactctcaacatgatctggtttttgagccagtctggtggacaagaaatggtaccttactgaaggtttaacttgcggtcccctgattcctaaatgagattcagcagctttttaatctttgttgactctttattcttcctgtgcagagaaattcttgttcaattttttgcacatatttcttttcttttcttttcttttctttttcttgacagtctcgctgcatcacccaggctggagtgcagtggcatgatctcagctcactgcaacctctccctccagggttcgagtgattctcctacctcagcctcccaagtggctgagattacaggcacctgctaccatgcccagctaatttttgtatttttaatagagaaggggtttcaccatgttggccaggctggtctcgaactctgtacctcaggtgatccacctgccttggtctcccaaagtgctgggattacaggcatgagccatcacacccagccttttttacacatagtgctactaaaagagttgactttttttcattagtgtatagaaattcttttctattctagagtttagtcactaatcctttatcagttacaaagattaccaatatctttcaacagtttatggagtttgtggggtttttgaaaagtcagatttattggaatgtaaattacataaagtaaaattcatcctttttaggtgtccagttgaagaagttatgacatcaaaagaacatacaatatagaacagtaccatcactccacatagttattttggactactttatagccaacccttccccaccccgagaccctggcaagcttggcctattttctgtcactatagttttgcctttttccggaatgatctataatgttatgcaagtcattgggaatggtgctggcttcttccacctaacctaacgcacttgagaaacatctgtgttcttgaatgtatcagtagacagtttctttttatatatatacttttttattattatactttaagttctggggtacctgtgcagaacgtgcaggtttgttacataggtatacaagtgccatgatggtttgctgcactcatcaacccatcatctacattaggtatttctcctaatgctatcccttccctagccccccatcccccagtaggccccgctgtgtgatgttcccctccctgttgtccacgtgctctcattgttcaactcccacttatgagtgagaacatgtggtgtttggttttctgttcctgtgttagtttgctgagaatgatggtttccagtttcatccatgtccctgcaaaagacatgaactcatccttttttatggctgcatagtattccacattgtatatgtgccacattttctttatccagtctatctggatgggcatttcagttggttccaagtctttgctatgatggtttctttttactgctgagaagtattccattgtatggatggatgtccagtgaattgttcatccattcactcattggtgaacatttgaattgtctccagtttgagctatgaagaataaagctgctataagtattcatgtgcaggtctttgttggaacatttgttttcacaaatggaattaccgagttgtatgatatgtgtatgtttataagaaactgtgcaactgttttccagaaaggctatactgtttccattcttcattcccaccaaccatgcatgagagttgcagtcatgcaccatttttgccagcatgtgctttatgttggtttgtatttagtcattctagtaagcctatagtgttccactgagtttttagttttcatttgcttaatgaccagttacattgggcatcttttcagtgcttatttgccatcaatatctcatttttggtgaagtatcccttcaaatcttctacccatttattactgggttttctgtctccttattatcgagttgtagaagttctttataaattctgtatacaaagccatttaccaaatatgtgtcccgcgattattttctcccagtctatagtttggttttatatttccttaatagtgatgttcaagaagcaaaagtttgatgaaatccagttgattttttaatgttttgtgttctttgtgtcctaatttgaaataatactgttccaaagtcacaaagattttcacctgtattttcttctaggagttgtataatttcagcttttacacttggatctataattataagctaattgtatctggtgtgaggtgagggccaaggttctttttcttcttttcttcttttttttgagacagggtctcactctatctcccaggctggagtgcagtggcacaatcaaagctcactgcagcctccaactcctgagctcaagtgatcctcccaccacagcctcccaagtagctgggactactggcatgcgccaccatgctgagttaatgtttaaacgttttgtggagatgaggtcccactgtgttgcccaagctggtcttgaactcctggcctcaagcaatcttcctgcctcaccctcccaaagtgctaggattacaggcatgagccaccgtacctggcccacttttacacatgaatacctagtgccatttgttgaaaaaaccatttttccccccactgaattactttggcacctttgttgaaaatccattattatatgtgagagtctatttctggatttgctattctcttctattgatgtatgtatgtatgtatgcacatctttctaatctatataataataaggcttgaaatgtaggagtgtatcctgagattttgacaaattcatttgtaaattccagtagttttttgtttgcacatttcctagtatcttctataaaactatgttgtctgcaaataaagacttttttgttattttcccatctgcatatgtaaaagtttatccaattataaagttagaggggacagtccccacacgagattacctgcctttttcatgccaactgcagattcaggtgattcccaaaaccaccctcagggtcaaaacttcagtagaagtacacagaactcattgaaagctattacacttacagagattattacagggagaagagacattaaaatcagccaagggaagaaatacacactgtggaatctggaaaaggaccaaacacagggtttccatccttctcccctgtggagttaagggatgttacttttctgctattgacatgtgataataggcttggagtatcacctaccagggaagctcacccaagcctcagtggtcagagtttttactggggttctatgacataggcatgattgatcatctgcccatgtaattgatctcagtctccaagttgattgatatgatgtgaccaaagcttccactctatatcacattgttggtctttctggtattaacaacccctactctaaatcatagtgttaggatatccattgtgattcaaggccccaggcaaacaaagatattcctatcaggcataaaattccaagagcttactcattaccccccagaagctgagggcaaaggccagacctcttcttggacaaggttaaattatttgttacatacttatgcctttcattttttttcttcccttattgcatagactagaaccaccagtgcatgatcaatagaagcggtaaaaagagacatccttgccttgttcaattttacaagaaaaccattcagccttttactatcaagtttgatgccagctgcagggattttgtggacaccctttatcaagttgaggatgttctatcttatttctacttaagaatttttaacatgaatgtatgtttagtttttttcaaatgcttattctgtacatatgaagatgattaaattgtttttcttttttattcattaaagtggtgaattgattaatttttggttttgaattttaaaccaatcttgcattctggagaataaacacatttagtgttgatgattatcctttttagatactctgggattcgacttgctaaaattttgttagtgacttttacatctacgttcgtaagaagtactgatctgtagttttcctttctcgcaatatctttttctgatttgggtatcaggtgaatgctagctccgtaaaatgatctggagggttttgtggggatttttttgtacgaaggttttgaacaagtcaacttcattcttagatgtaaggctatttataatatctatttctatttaaatgggctttggtagtttctcattaaaggaatttgtctatttcatctaagttgttacatgtattggcataaagttgttcacaatattctctcattgtccttttaatagttgtaggatttctagtgatgccttctccatcattcttgatattggcagtttatatcttctccttttctctttttttttttttttttttttacattttctgatcagtctggctagagtttagtgatcttttcaaagaatctgctttttgttttattaatttttctttgttttctttattttttctttcttttctattttattggtttcagcttttcttgttatcctttctcgtgctctctttggatttgactttctctcccatttctacttcttctgtgcagaaatgttatgcttgactggagatctttttttgtatataagcatttagtgctataaatttagcagcataccgaaatgtttataagttgggtttttttgttataactcagctcaaaatattttctagttttctttgtgatttcttccttagtcatgagttgactcatgggaagtgacttgtttgatttacagatatttggagctaatctcgatgttttatttttgttgacttctaatttcattctcctatctctctcgatgagaaaattgctatttttaaaaatcagagaaaaaaacacaagcattattttctactatcttatttttatatcttttcaaaatttacaattaatgtatatgaacttttgtctccttctttaagcttagtgtatcttagtttttctagccaaaaataaattgaaactggttcttaattccaaaataaatttaaaactgggaaatgtttctatttgttaggacataactaaatccaagacagctaatggctgaatataactgtctttattctcaatatccattttatgagattaatattttcaatattactgtcattacttacagtaaaaaaagaaggaaatttctattcacttttgccaataatcaaaacagatcattaaaattgggtttctcatacgaaagcagctactttaatagctagattaatgtccaacaattgaccacagattattctctaagactgtgctaaaatcctttttagccatttacatagtaaaactctttcctgcaaatatgcagcaaaacattggtttcaatgtttaatacatcaaagaacaaacagctactgtttgaaaatcttccatgttccgtctcccggaactttatttttggtccatggtgtttattctgatgtaatttatcatgcattattttaagcagttttttatctactgttttttataattaaaaaataaacaaaaatggattcatttatttgggtgggaaaaaatactgagaattgttccatttctttcaaagctagataacatcatctttaagcagatttgtatgcattttgtggtacaaaggatcagtttagcacatgtctgtgagaagtaaacttggccacaagagacagcaccacatacactgagtccatgaagagtggtaagattgcagattttgtaaaataatcaggattgaatgggtatgtactaagagagaccacaaacatgaacagctgaggtttgcataggataccatccacagcaggtacagttaagactgttccatacaatacatggtagtctttgctatttgggaatgatagggtttgaaaacaaggatttgaaacaggattcacagcacactaccaaatcctcagatttgaatttcctgattgcgtatatacttcaacttactgaaaacctaattcctttattccagagaaatgaaaaccaaagttcacacaagaatccctacattaatcttaatagcagctttgttaataatggccaaaaattgcaaacaacccaaatgtcctttgatgggttgatagttaaacaaatcatggtacatccatcccatagaatatcactcaacaataaacaggaatgaacaattgacagatggaccttcagggaagtatgcagagtcaaaaaagccaatcccaaaagattgcatcctgtatgattccaattatataacattcttgaaataacagaattatataaatgaggaacagattagtggttgccaagagatatggaggagatagggacagagggaagtggacgttcctgtaaaaggggatcttcgtggtgatagaagtgttcttgactatgtcaatgacaatattctggttttgatattatatacaatatcacattttggttttgcaagctgttaccattggggaaaccgctaaatggtacatggaatctctccaagttatttcttacaactacatatgaatctacaattatctcaaaataaggtttaattttaaaaaaactaattccttgcttctcccaaaattcatttctcatgtttattgttaccattaacagtaccccagtcttcttcttatctgagggtcttactgggataacgttctatcttccatcttaggacggaaggctatgcagtgagggtcgtaagatgaccacactggctgtttatcctaggcaaattagttcaatatattctgtgttgcttgcttgatttcttccttctttctaaaaaatttactttgaaaaccatgaacactgtttcactgatttagttgagatctttagagaaccattgtttaccatggtttccctggatttgaagtagtcttcggtgggtaaataactgaattttgtgagccatgctttttaaatgattttgacatgatgttttgatagattatatatttcttcatagacttctatttgattttttgttacagaactgtgccaggaagtttaagtcgtcttcactaaataccactgcagcttaggagcccccatggtgcattttatattagaaatagagtagatggtacttaggatctgagctctagatctcacctgcaactaaccctctactcctgtgtacaacagtcttcctttcatgtataaaatgaagggttttgacgatatcatctccatagtacttgtcaagattcaaatacatatgattctatgatcctagggaatttatggccagtcctgtggactgatgaccataaaaacaaaagttttcagagaaaatgtgttcagcttctgtgctatgtttgttctctatgcaaataaataaataaataaaagtttccctagaacctcacaatggacaatggatagtgaacacgaactcaactctctgttgccaagctgaaagcaaacgccagctttgggtttggagactgtcaagactggtatagaaacccaggttctctgggcttctctctgatgacagaagcctgtcatgatttaatcaaaccaagtcagaaaagggaacatagcataatgacaaaccaatataaacgcagaaatgtctgtggtatcagcccagcaaagttgtgccctgttcttcttaacattgcacagtaaggacatatgcaaagagctatgcaatttagcaacatttctgtgggttgtctgtttttaaaatgtactcattcctagaaaacaatgcagccaaattaactttgaccaaaagcatttgagatgttttccgaacatttgtggtacacaaaccaaagagtttatcataattttccagatgaagaaagagagatatacagaaattaaattacttgccctagagtaagaatataacccaataaattttgctaacatttgaagttgccagaggccatgttaattattggatacctttaaaagggccctatgacatctgattgccaaaagagatgttttctgttgaggttactttcagttgaaagtctacgaattcttttaaagacatgttttacctaaaaactgctagaaaacattggtttgttttgaggactacccttcttaagattttataaaaataataatttagtttgtaatcagctttttatataaaataatgccatgtgttatatgtcatttatccaatgctcattttctaggtgtacgttgcaggaaaaaataatcatatgtcaagttaatatcctactcctggattacaccatttaactctctgtctctctctcacacttgagatatctataagaccactctataactctatcacactttattttgttctggctctggggctggctttcccaggaagccaaagaaatatagaaaggaggaatatacaatgaccactcttccactctgatgccttcaacaagaaactatatttcttcataactggacatttaacacaacacacggcatcctagacttttttttatctgcaaaaaagaatcccatttcttgatatgacttaaagcagggattaaataacccatacacacacacacacacactcacacacacacacacacacacacgttctcacatgtgaaatagatggatgtatatatttatatatgtataagtttggttattcatctcaactcaggaacactctccactctcttctttagtgcccacgagatgagatgctataaaatagttgccctctgggctggagagcctacactagcagtttcagatccttcactgtcactgtagtcattctactgtacatcactttcaatatttttccctgtagggagtatctactcaaataaattgaaaaccactttcttctgcttctgttagtatactgtccactagtaaaacattctttacctgggccattgctaacaattaacaggacatttcatgtttcagagtgtcacaccctccgcagattgttctgcccattcataactgggaaccagaagaggagccccacaaagaggaggaggttggaccattggtggaacatatttatgaggtagccattgtctgtgttaaagttgtgttaggggtttattcttaagctctgtgcaaataaattctatgtagcattattatcattatcattattattattgagacaggatctcgctgtgtctcccaggctggagtgcagtggtgcaatcacagctcactgcagcctcgactttctgggctcaaacaatcctcccatctcagcttcctgagtagctgggactacaggtacacaccaccacacctggctaatttttgtatttttttctagagacggggttttgccatgttgcccaggctagtctcaagctcctgagctcaagtgatccacccacctgagccactcacagtgctataactacagtagatagcattttaaaggacatcaacccaagttccgagctgtatatactgcctaggttcatgctgttatgctctcatactgcagtggggtgtagtgggtgttcggttgagtaatactggatataatcacttgttccttagtaggaaagccattacatagtgaaaacactttatcttgttactattgttgttgtcattgttgtttttaattatttccatttttttaaatatttggacaacctagacataaaaatggctagcttcctagacattacttcattttttcctatatttcagatatgtttatatcttttaaactgaaggttacccactcatcttttaaactgaatgtcaccaactagaaggtaccagacagaaaacaataagaactattcattattgtgctaaaaaaaaaatatatatatacatatatataaaagcgcccgggtgtggtggctcacgcctgtaatcccagcacttcgggaggccaaggcaggcggatcatgaggtcaagagatcaagaccatcctggccaacatggtcaaaccccatccctactaaaaatacaaaaattagctgggcttggtggcgtgagcctgtagtcccagctactcgaaaggctgagggaggagaatcgcttgaacctgggaggcagaggttgcagtgagccgagatcgtgccaccgcactccagcctggcgacagagtgagactctgtctctaaaatgaaataaaagcacatataatatatgagatgggtagatggtacatagataaaaataattttacttttcatccaaagaacccaaattggaaatgaatatcttattctgagatttttaaatagttcactgattagtaaaatattttccagaagtgaaccagtgatgcataaaaaggagctgatgttcttttcccatttcaggcattaagttgtgaacagggagaggatctgttgacccatcacctgaaacatttaagcttttttcagttagaagccaacatatatggctgggcacagtggctcaagcctgtaatcccagcactttaggaagctgaggtgggagaagcacttcaggccagaagctcaagaccagcctggccaacatagcaagggccaatctctaaaaataaaaaaataaacaaacataaataattttctaaaaagaaaccaacatatagcaaagggttagtttagtagttattcaggtttttgtttggttttgctctgtttttgcttttgtttttttttttaaataaagtcaatgctagcagtaaagagtagttattcctattcgttttcaagggaccaggcagggaattttggtaaaaccatgttccaaggcgttctgtttgaggttccttctcgattaatgccttctgttcctttcctatgtaactcatgcctctaatctagtaattctgactatgactttcatcttgagctacaagggacatgaataacatcctctaagattaacaataaagccttttcaaaagtgatgaactgtttacaaacgtagggaagatgcctcaactcctgggcagcatcagcatgaaaccctccatcatccgcccaacctgtggcccagattcaggagccttgtccaaagctggatcaaagctttgccttaagctcttttgatagcaaaaggataacacagtcaccaaggccactctgattaagaacctcactggaaaaaagaaaaaaaaaaagctgtcaaataatttaataaagctgtgtgtcctggtttctgctcaagaatggtgaaactttaaagtttgaaaatatattcagacccaatcattctcagggcagtcctgcttcaaatcttagcataaatgtggatcatgaaagtttagggtagctactggtagtgcaaaaagcaatcatcaaatattgtgtacattgctaatctcgtgactcaaaatatactatatcaatggttgccaagcttctttgataaggtgaattaaataggccatctaataagcaaaagcaattatccattgttttatagatcactgtaattttcagaactgagaaaaaaagaaaaagaagaaaatccctgctgactttaaatttttaaaacactggaataaatgtaaatgcacttagtgttttgggcaaacaattttgtgtcctccaagtataggattcacgtgttaaaaaatgttcatctctttatgagatgtggcctttcttgccttgagatctgctgatggaaacagaaggagctcagctttgaaacacgcactcgaaatgaactgtggtgatcatgggcccgccttggcacttgatggatggacattcttccagagggtgaaagagagtacatcacatatggttgcaattgacagtcagtagtcaagaaagcggaggcagatttcaatgtaaagagacagtcactaagttttgaaggcataaaatcaaaattaaaatttctagcgctatgattaaattaacataaatttaaaaccagcatcacagttatcagacaagggtagtatggtcttcaactgaggaaatccactcttagagcttcacagattgaagagttttctctaaacaccagcccatgatgctttcagagtgcttcttgccatatcgactttgaattttcttattttccatagtcatagtccagatgacttaaaaccaataatacatgctttctaaaatgggtatagagtatatggagtttgattttatctctctgccttctgctgggtcattagataacatgtcacttgtttacagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaaggtaggagtctggtctaatcagtggctttgttgattttatttttatggtatgaaaaaaatacaaactgggcttgtttaaaaaagaagagtgaaatcgttttaagttgcttcagtgatcattgatcagaacttttcattttatagttaaaacaccaagcctaatttaaaatatcccttctagcaaatttaaatttctttttgttttgttgcttatggtgacttgtcatttatttcacccattttaataggcaccttttatttttggctcaattagcagcacatccaaaccaaaatcataaatagacatatcacatctgggagaattagtataaaatgctatttttaaagtctttttggtctattgccaaatttcgtaaggatctttgccaaaagaggctcttccagctgcagcccatagcaagtggtgaaccgtggcaatttgccaagggccatgagaactcccagaaaggaatgttctggaccctattctttaattgaagcttaaagcctagagccgtgcttttcaaacttcctctgaatcacctggctgtctgttaaaatgcaggggctggggttggacctgagattctgcctctctgcaagcacccacctcctgtgcctgatgccagtctgtgggcctgactttcacaaacaaggagtaaggagctgatcccatccagattaacatccaaatttggctttcatgtttttctgtgaaagaaagaaattaattagcataagcccttgaaaatgccacatttgtataaagaaaaacaaaagacaacaacatcttgtagtcagatattgtccttaggagataacttcatgtaagaacgaacgttctcctagtagctaccaggacacagtgtctctattaaaaatggcgcagcgcaggcttcatggaatacccacgccaccagccaagacagagcaggtctgcccctacctcagccagtgacactgggtcattgctcattctgaaaggcattctttttcaacccaacatgcctcctattcaaagggaagactaaagggggttcattagtaaaggacttatgagacaacagcctcctcctttatgtagaaattatacataaggccacttgtgttacacaagattctttaaaatatttccttcctggaatttttttttctcatttcctctttgctcttcattgagatgattttaaattctttaaggacagtagcttattataaaataacatctgcaaatgcaaatgtataacatttaaataattaacacttttacatatcctgcattgcatttaacatgtactttcagtcatagattctttgagcacatgattctgcagagacctctaactctttttgagtgtaatgtttagtttatatctgacactatttatatatgtttgtatatattatgtaactggtttaatgtacaccatgttggttgtgagttatttgtttttttgtggcatactgtgactacgatagtattaatagatgacttgtcttaaatgttgacagattcttgcaaaccaagccatagtatatactaagcacctggtgttccctactccccacttattctcttttttttttttttttttttttttgagatggagtttcgctattgttgcccaagctggagtgcaatggcgccatctcggctcactgcaacctccacttcctgtgttcaagcaattctcctgcctcagcctcccaagtagctgggattacaggcgtgtaccaccacgtctgactaatttttttgtatttttagtagaaacggggtttcaccatgttagccaggctggtctcgaactcctgacctcaggtgatccgcccacctcggcctcccaaagtgctgggattacaggcgtgagccactgcgccccgcccccacttattctttaatgtatgtgcttggagtaaaattctgtctgaggctaatacttttaaaaatgcaattcaattatgttcattttcctaaaactttcaatctgtggaaattgaatataagatttaaatacaatataaagtaatatctcccttaaataactaatcatagcaatttgtgaatttttgaaattctaaattcatagagaagttgaaatgttattactttcaggttctcaaagtactgtcacctatacttaataaatgctccagagagtctaaaggagcttttattaatagacattaaaaaacagataatcaagagagtttacattagtgactataaataattgagagtactggaaattattctcctcttatgatgctaaataattttttggtgaagttgctattaacttacatggcaatttaatttttcctagagaatgcaaacgtcatcttttcttgatatgacttggactttagtgaaaaacaaataatctcttacctgttgttgtcttcaacagaatagatctgagaaatttttaattttaataaccattttaaattcaaattagcatgaaaatgaattgctgttaaaaaaacaaaactgtgccatagccaggcacagcgatgtttgtagctactcggaaggctgaggtgggaggatcacgtaaggccaggagtttgaggtcagcctgggcaacatagcaagacttcatctctttaaaaaaattgtatagttagttttatttttagtaagaagcagacagaggatgggcttactaaaaggaacagggaggcagcagaaataacatttgtcaaggcaagaattcaattccagtatccaatcttactcaccggggaagtgaactaagcttcaattcctgattatttggttctacagtttctttacaagaagagtgatctagatagtaagtgcctcataaaacagctgcatctgtgagtagttcatgtctacacattcttcaccctttctgaggatgctccagtccccactggactagcccccaaaatgtcccaggccaccgtgggcctgtaagagaggcgctctctccccagctttctaaagctgagggattggccatttccttcctacgttttcctctttaatcattccattgattttctttcagcaaaatccctttccctcgtgttcagatacactttgtagtcaacgtcccctttccttatgtgttcttaagttgcccacttcccactggaaaaatgctctcttcttcgttacctctccctgatccccacagatctctaggaaaacttgtgaaaaataagccagacttcctaagaagcattttagaggtcacacactccagggatccattgccactaactctaaagccttcacaacttcccaaatatgccctgagaatccctgcaagttcccacatacttcctaatttttctcagttaaatcgatttccacctaatgtaatgtgctgaatgtaatgtacttaacaaatggattttcttctattttttaaattactcatatggcagcagtcctggacattgttattttccttacaaatacatactttgacggcatcaaagccctattgaggattaagttgggtttttgtggactggcttgagaactgaaacaccatttaaaacatcatttctaaagagaaatgcattctgaatgccaaacatctagcctaaaaccttctgaaatacaaccggtctataacctggatatgcactccaaatacaacataactctgaaagtcttctcacataagtctcagcatctgataagacccaaacaaggttcaggtattttttatcacagtagaaactggttatagtttggttatctcagcaagctaccctaatgtccccaaagtttcaggaggagacactgactgcttttataagctaccactgggatcatcctgtaacctgtggctgtttaaaaaacagtggtgaaaagttctcatccacaaccatctcacttgttgcccaaacacagagcattagcaactaaattgggatggggcaggggcagacacacacaaatgcttctagaagtcagtgagttcttattctgaatatttgtcttggaccaggagcatggctcgtgcctatgatcccaactctttgggaagctgaagtgggaggatcacttgaggccaggagtttgagagcagcctggacaacatagcaagaccccatttctacaaaaaataaaaataaattagccaggcatgatgacacatgcctgtagtccctggagtcccagctgctcaggagactgagaaaggagaattacttgaacccagaagttggaggctgcagtgagctatgatcacactactgtactccagcttgggcaacagcatgacatcctgcctctaaacaaataaataaataaatacttgcctcatatcagggtttatgggattcactcagcttggtttgttgacactttcaacccttagggcgtgagggaaggtggaatcaagggtgggcaacagcctgggggctgcaggagatcaggaagggctgggtgagctgcacaactggtgtttcccctgtgaattgtccccagggcccaactgaggtcagcctaggggcatggaagtgccttgaggatgtcccttcccactttctcttttgcctcccaatgaaaatgtctctgcctttgagttcctgtttctccggtgatagtttctgcttcatcaggttcagttgtgttttctgtaagtttaggggcataagcagatgcccgggaagggtctccctccaggcttcagggtctaggtcagagatagaggattttaacatggcaccttattcacatcgtaccatctacaacattttgaaatgttcaactgtctgcagcatccaaagcaatccattagagctaatttttttccagatccttcttggaataaaattttagagttgagtgaagtatttctcaactaatctaaagccagtacaataattatttcaaactatcaattttcttatttgatgggctttatcctagggtttggagagtcctgcacacagactgttatctttagataagatgaggttgaaaaagtaaaacctattgaggagccaaaagtttcataatgagtaaaggatttttctttttctatttttttcttctttttttttttgagatggggtcttactctgtcagtcagtctagagttcagtggtgaaatctcagctcactgcaacctttgacccctgggttcaggtcattctcctgcctcaacctcctgagtagctaggattggcacccgccaccacacctggatagtttttgtatttttagtagagatgggttttcaccatgttggccaggctggtctcgaacccttgacctcaggtgatctgccctcctcagaggccgggtgcagtggctcactcctgtaatcccagcactcctcagcctcccagagtgctgggattacaggagtgagccactgcacccggcctctttttttttctttttttaagacaaggtctcactctgttgcatgggctggagtgcagtggcactatctctgctcactgcaacaacctgtctcccaggctcaagcaatcctcccatttcagtctcccaagtagctgggactacaggaatgtaccacccaccttgctgatttttgtatttatttgtagagatgcggtttcaccatgttgccaaggctggtctcaaactcctgagctcaggcaattcacccacctcgacctcccaaagtgctgggattacaggcatgagccaccatgcccggcctaggatttttctttaattggcaagattttgtaatagacagctaagtgtgagatgcagagggaaaaggcttagatgtgaaaccgtacctaggagaggaagaccgataagatgcccacatataacctatgttaagactatggaacaccatttggggcccaagttcaggaaaataatcctgagataaaagtggcctgaaagactctatagactaagaagggcttaacatgagagaaagctgatgctgtttgtaaaaactgctgtgagagccgtggaaagctggaggttgccgccgagaatgtctcctgaaccagaccagtcccatgggaagtccaaattacaaccagatagtacaaacatggaaagcggagacacagaaaccgtccgttctttaggaatgagagttttagagttatgttttagaatgagtgggcccgcagacagtggcttggcaaatttgcatagttttgtcttatcctttagggtactttcttcttcctaactgccttcgtgtactggttttccttaattcagaatgcaggcgctcgttacttcctagcacaacagttcttgacctctttccctctgtctctcactcacgcgtgcgcacacacacacatacccttaaaaatcaagacatatggctaggcacagtggctcatgcctgtaatcccagcactttgggaggccaaggcaggaggatcacttgaagtcaggagttcaaaaccagcctggcaaccatggcaaaaccccatctctgctaaaagtacaaaaattagctgggcgtggtggtgggtgcctgcaatcccagctactcaggaggctgaggcaggagaatcgcttgaacccgggagacagaggttgcagagagctgagatcacgtcactacactccagtctgagtaacagagcaagactctgtctcaaaaaaaaaaaaaaaaaaaaaaaaaaaaaaaaaatcaggacatgaaaggaagaagattatttagtatatctttaccattaactcctgatttctttgtggaatcattttgacagccttgaccacaggaaccgtaatttatgtcctagctgaagcattatttgatggctgttacttgccccttcaatactcggctgtcttctataaactctcctcccagaaaaaaacagaacaaaacaaaacaaaacaaaaaagaacttagctgtttattattttagaaggtctgatcaggaaaacagtagtcaattttaatttacttcctctccaattgtgacgtactagtgacatctatggcttgcccctggacctggtcagtctgtcctaggtatgcttcctctttcttatgggaatgctacctgtgatagaagaattgtatttgcctttttaagagtgcctgaagatccaattctcgaccatcaaaaagaattacacagtctgagatttttaccttctctttgagatggtcttcaggtttgcacatatattttggaatgtaaaaacaccatgttcaaatactaagaaagcatcaacatcaccagtggagtgagtagattcttttagttgtgctttgcatgaacttttcaggaggttaaaaaagtgggggttttctttccctacaaatcctcaacattcatgtcttaaagaaaattacatggtggactgccccccagggcttgtctccacttcggtttaattataggcaaagtacatgagagttgtctgttgtttcttgtgtgctaggaatacctgaaatccaaaaacaaattacaaacaagaaaaagatagtgtgcattgcttttgtttgggttcacagggcccttcatctaatttcacccaactccttttttcaaatgccacatttccgactgtactgcacatcctggctgcacagtatccctttaatccataaatttaaacctatgacacagtgaagagtttggtaaagaatgatgaaaatagaaaattcctgttgggctaaattctgagtagcagctgtaaaaagaaacatgtttaccaacaattatttccttattgcagaaagaagtcattttcatttgttctacagaagacactttagtggtgaccaccagcttctcctagcacttaatgaattgtcctgggaactgtctgcctatcatggatgctaagaggccagcgtcctccaccctcagtggaaaaccatggcctgtaggttcactgtcaattgtgaaagaggctccaaatgttcatgtagaaaatgggctttaactgttgtttagatttcttgggtagcttcttcctttttgttttgttttgtttttaaataatttctggaatgtcatttcagaaagctggtttgcaagctatttggagatcttttgactatggtgtttaagagtggcattcctctatttgtaaaactgtgtcacaaaagaaagagatgtgttccatcaacccctgccacgtgacactgtcattctgtagctcaaagtaagccctgtgttttattgagagaccacttaaaatgtttgtgaatgacaatttaccccaataggacatgttctttatttgtacacaagatacatctgatgaaaccacaccggaagttaaagagttttctttggggtattggtttttgttttttttttttttggagacagcctcactctgtcacccaggctgctagagtgcagtggcactatcttggctcatggcagcctctgcctccgaggttcaagcacctctcctgcctcagcatcctgagtagctgggattacaggtgtgcaccaccaccagcctggctaatttttgtatttttggtagaaatggggttttgccatgttggccaggctggtctcgaactcctggcctcaagtgatctgcctgcctcggcctcccaaagtgctgggattaccggcgtgagccaccgcacctggctgtttgggctattgttttagcaccaccactactattactgcttactgctaataataataataataggctatatcttgggaataaagagtcagtcccttgttttttatagtgcctcttctctgtagcttggttaaccacagagttaacctctgtaacataattgtcaatgacctataaaaaatttacatgattcatctcaaagcaaaatctacatgtacacccacatagtatatgatagaaaacatatgagagaattttagctagtgatttccacaattcttaattttctgtctaagctcactttttatctgataccatcaaaactgttctatcagatcctccatcactgggcatctgtattaggccattcttgcctggctagaaatacataacactgggtaattcacaaagaaaagaggtttaattggctcacggttctgcaggctgtacaagaagcatggagctggcaactgcttggcttctgggaggcctgaaggagcttttactcatagcagaagacagagtggggagcaggcacttcacatggtgaaagcagaaccaagagagagagggtgggtgggcagggagtgccacacacttttaaacaactagatctcatatgaactcagagtggaagctcacttagcgccaatgggatggcccaagccattcatgagggatccacccccgtgaccccagcatctcccaccaggccccacctcccacattgggaattaaaactcgacatgagatttgggaggacaaatatccaaaccataacagcatcctcgatcaactgtggggcttcccctcctcctcattgtgccaggctctgccatggttctgggatgtcccagggcccacagtgctgggctatccaaggcctaccctccggtccatgcactccacctcccagggtttctgccactggtcaacaacacctcaagctaccctgcctccaagacattcgactcaactttcctttctcctccaattcaatctcctgtttttatgatggtctcacttgttctcttcaagaaaatttttcttccctggtataaatgctttctctgacacagttaccccatcccactctcaggacttcctctggccataccttctttcctgccaagcctggactccatgatgagttacttgaaacacgcttttacaagcccccataacctcctgtttctaatatccttccaagcccctgccctgaaaatctcagtcatgcacagtcccacagcctggcttctctaccccatagcctgatggcgccatgacagattgatgtcggggcgcacgttcacggagccgccagcttcgcaggggcatctgccattgtgatgatagcaccctcctcgttgccttgtctaaaccttcaccactctctctgtccttcctacgcaatagctctatcattactattaggaatgatccatttccccatcccaaacccctccccacctgatagggttaggctttgtgcccccacacaaatctcatcttgaattataatccccataatccgcatgtgtcaagagagagaccaggtggaggtaattggatcacgggggtggtttcagccatgcttttctcgtgatagtgagtgagttctcacgagatttgatgtttttataagtgtctggtatttcctctcctgttcattctccctcctgccaccttgtgaagaaggtaccttgctcccccttcaccttctgccatgattgtaagtttcctgaggcctccccagccagggagaactgtgagtcaattaaacctctttcctttataaattacccagtcttggacagttctttataggggtgtgtgaatggactaatacaccaccccacccttccacatgcccctaatcatctctcttccatcctcaattgctttctaacacttccagagaaaggaggattattcctccagctccatgaattaactttggtacatcaagtatctccatttcccgtatcttcaacttcttcctctctccttggacattccttgggttctataaactttgttaaatttctcccatcttcaaaacaaacagtaagtgcagtaatttgactctgtattctcttccaagaacggacctctttccccttccatttatagccaagctgtgcttgctatctctactttttcatttctcatttactttttttacaattttacatttttgtacattgttcatgatttttatgttaagaacgctaaatgctatcataagaatatatcaagcaacatgtaaaaacataaagaagagcattttaaataatagtgttaccacctgtttactgttatttttccatttatttatgcattaacttatttttccacatccataaacattttacatacatatatatatatatatatacatatatatatatatatatatatatagccaacagataaggagacttggccaggcacagtgacttacacctgtaatctcaatgttttgggaggctgaggcaggaggatcacttgagcccaggtgttcaggaccagccttggcaacatagcaagatgctgtctttacaaaaatgaaattcagcaggtgcagcaggatgtgcctgtagtcctagctatttgggaggctaaagcaggaggatcactctgctgtaatgagctgcgattgtacccattatgctccagcctgaccgacagagtgagaccgtgtctataaaaatgaaaaataaataaataaggagacccttttaaaatctacaacattattatcatacctaaaaagaaataagcaaaacttccttaatatcatcggatctccactactctaacactttgaggactgcccttccagattatttctatttatagatctacaatgtcagatacatccatttttattaaaaatacaatcttactacatttgctgttgtaaacctgtcttttccccttactaatatcttgtatctttctaaattccaatggagcttcatgccatcatttttaaaacctgtccagtagtattctgtataaatagatcataacttatttaatcagtaacctgtatatgcctacaaagtgttaagctacagtttttcttctctattataaatagtgttgctacaaacatcaatatttgttttcatgccttatttgggggacaaggctcatcttgtctctcagccgtagggaatttactataagaacaacagaaggatttaatttcatatctttttaaataattatccatttgttaaaatcctttcactcttgagctactgcagttaaatttccacctccaccaatctgtcctcataaaaggacatctgtaattttgttctttttttctttttattttttttagaagcagggcctcactctgttgcccaggctgagaattcagtggcatgatcgtagctcactgcagtcttgaactcctgggcttagatgatcctcctgcttcagcctcccaagtatctgggactacaggcttgtcccaccacattggctattttttttttaattagcaatgaggtatcactatgttgcccagtctggtctcaaacacctggcctcaagtcaagatcctcctgactcggcctcccaaagtggtgagattacaggcataagcctggctcataatatctttttaaatttaattttaagttttggggtacctgtgaaggatgtgcacgtttattacataggtaaacatgtgccatggtggtttgctgcacctgtcaacccattacctaggtattaagcccaacatgcattagctatttttcctcatgttctccctccccccgcccccctaccctgacaggccccagtgtgtgatgtacccctccctgtgtccatgtgttctcattgttcaactcccacttataagtgagaacatgcagtgtttggtttttctgttcctatgttagtttgctgaggataatggcttccagttccatccacgtccctacaaaggacatgacaaaattgccaagttcagtgcataaaggtcttcacccttccttacttctctgcaggatttggcattctttgtcactctcttatttttgcagctttcttttccttgggcttgtataaaaacgacactttcctagattacctcctacatctgatctccctgccttagctttcctctccagattatcttcatctctctgtttcctgggaggctctaagtgactctctgctttgtgttttccattttctcatctggcaatgcagaccagctggcaggcagcttaggtacagctggataggcacagatgggccccagaccaagcatgcagaacatcagaggcttggcgagtgtacctggggccatcgggaacgaagagcaggttagcatgctggagtgaaggaccttgggttcttggtcagagaagaggctggagaaaccggccaaggccagcatgtgaggacctgtgtgtgccatgctagggagtctggactccgtccttctgtttgtctagtaggtttttccaggttttcatgacatactgagcactctcatttcatcttttgtgatgcagcctacatcggccatgtagaaatttcttttcttcattccatagagatgggcatactattattgctcctgtgactacaaagagaaactgtgtgaaagaaatcataattctcaagggtgggagtggggaacagaaaattaggtctttgtattcagtgggtctaaaataaagaatgttaatgcgatattctgtgtgatttattggaattctcaaaatatttatccagccagcagatggacccagcatggaacctgagataaaatagtaagttctaggacatttgcaaaacgaactcagggctgaaaacagactccactgcagcacagtgaacatgtagcagactttcgaaaagtcatttttgtcagggcagaattttctcctaaaggagtgcaggaacgtggggttcagccatgtggatgtggggtctttgaccacatcaggctgtttccccaaatgaggttggcacctcactattctgtcacctcaggattcatctccccatacagaacgttcctcagtttaactggccccactctacaatgagaggaaagtaatgagagaaggatggctcatgtctgaaacgtcacttgcatgttttctatccttgtggggaaatgacttctgcttcaaatcttctccttgcaagataaacttcccaggaatgcattccccatgcttcgtgaattcctgtcattgaagagtggaaaagcttgttccttgtgcgtgcaggtcatgtcactgttaaacacactgctggtaatcacaggtctggatcctcatgtgaatcatattccactgagaaaaaaaaattgcctagagttcaaggctaaagaaaatgtagcaactgttcatgtgtttttaatgtggtatctcccactttctttttgcagcctgctgcctccccagaggacacccctgagctcagcgcctttttgcgaaactctactattcctcatcttgtcaggaagagggatgtacatgtggtcgaattccacagacagagccctgcaaaaatactggtgagttatcccagtgtgcatagaactgagggaaatgagtggcttggatagaaccctcaaatacagatagttttaacttcaaggattgttcttggtctccttcagtgctcagatattcctaacgtttggcagtgtttatctcgagaatgaaaagcaacttttctgtaagaattaaggagcacttgcaatataaccttttcacttttctaaagctgccatggaggccactttggagaataatggtgaaaacatcaactgtgaccttcaatccatttcaggaacatacactttcagttgttagtccgtgcatagatgctgggctgtggtagtttgaagtgagcatggacccttggagttctgcacctgtcccagaatctcagagcttctgcttatctggaagaggcaagaatggtgtgttcagggctgggtatggtggctcacacctgtaatcccagcactttgggaggccaaggtgggaggatcccttgaggccaagggtttgggaccagcctgggcaacatagcaagacccagcctctactttttaaaaaaagaatgctgtgttcaggtttcctgggccaaaacccctgctgagtcttagcactggggtctgtggcagctcaagcctgagcttagttagcccttagcaatactatcttcagtgttcatgagtcagcactttttttgtttgttcggagacagagttttgctctgtcactcaggctggagtgcagtggtgcaatctcagctcactgcaacctctgcttctcgggttcaagcaatcctcctgcctcagtctcccgagtagctggggctacaggcacatgccaccatgcccagctaatttttgcatttttgtagaggtaaggtttcactatgttggccaggctggtcttgaactcctgacctcaagtgatctgcctgcctcatcttcccaaagtgctgggagtataggcatgagccaccatgcccggtcagagtcagcatttttgattctattctcccactcatcctattgcggcagcttctagtgctttatgttttcatgtgaatattcatcctcttccctgaccatgtggcaagggctcaaagtgaatgtcagggtttatctgtgctctgtagaccatgtccataaaaagtaggaagctgcatgcacattctccagctatgcagaagtaatcagagatcacctcagaagctaatacccttctcaaaagcaagcaaacaagagaagtggggatggtgaacaggtacaaaatatagttagatagaatgaataagatctattgtttgatagcacaacagagtggctatagtcaacaatttattgtacatttaaaaataactaaaagagcataattggaacattttgtaatgcaaagaaatgaatgcttgaggtgctggtacctcatttaccctgatgtgatcattacacattgtatgcccatatcaaaatatctcatagaccctataaatatatacacctattacataaccataaaaattacaatagatatataaaataaggataaagcaagaaaacaaacattccgtgcttggggcagggacaggctgggaacactgggtctggtatggggggcacagaccaagcacgtacttcctgccccatagctgcagttcagaagctcagtccaagatgcagtgatttgtggtgacactgaatcaaaggccacagtgacaagtccagggttatccatccaaagcagcaagccaaagagagagacctggctgggtatggtggctcagcctataatcccggcgctttgggaggctgaggtgggcagatcacctgaggtcaggagttccacaccagcctggccaacatggtgaaacccatctctactaaaaatacaaaaaaaattatctgggcgtggtggcaggcgcctgtaatcccagctactcaggagactgaggcaggagaatcgcttgaactagggaggtggaggttgcagtgagtcgagatcgtgccactgcactccagcctgggagacagagtgagacttggtctcaaaaaaaaaaaaaaaaaaaaaaaaaagagagagagagaccctggcagaagaccgcagggcaaatgagtaataagaaagggaaggtgttgggaggccgaggtgggcagatcacgaggtcaggagatcaagaccattctggttagcgtggtgaaaccccgtctctactaaaaatacaaaaaaaattatccgggcgtggtggtgggtgcctgtagtcccagctcctcgggaggctgaggcaggagaatggcgtgaacccgggaggcggagcttgcagtgagccgagatcgcgccactgcactccagcctgggcaacagagcgagactccgtctcaaaaaaaaaaaagggaaggtggaggtagaagtggaagagactgaaccaaggagggtgctagagttctttctacaggggcagcagtcacagtcctggctgggttgaaagccattagacacctaacctacctatgctgctgaccctctccagactgggttcatcccggaaactgtgaatggctcctagacttgttgaggtgccacggtgcactgacccaagggggcatcctccctccttccctgtccgcagtcctgacagcccattagggtaggtggcatgttttttttctcagtgttgttttctcaacatgtagcataataccagctcatctgttgaacaaacatgtgaatgacacagtgagtgaactcatcacagacagtattaatagcttttggaatcattgtctaaaatgctccatggtgtgcccttctatgtgttcttaacctacatgctcttaatcctaaatccaattataagccaatgatatattgcaagccgtttaaaagatagtgttggtagtgaccaaattcattagccaccagatctgctgaattcaagataaaatgttatgacatgaataaatgaaatcagccattttttatgacaatgttcaaggatgctttggggactagaactgctccagccatttatgaaactgaaataattcacggtagctatcactgaagaaaggaaatcagtgctcaagaaattgaatccctgattttctcatctgtagaacggaaatccatacgcttgatttacataactgaaaaattaaagtttaagaaaggatttgcaattccccctttgctttctctctccctctctgccttgcaaaaaaggtttttgcttttccttcaccctttccccatgcttgtaagtttcctgaggcctcccagtcatgcttcctgtacagcctgtggaactgtgagtcaattaaacctcttttcttcattaaaaaaaaaagaaagaaagaaagaaagaaagaaagaaaggatttgcaaagataaaatgtaatgacagtaggagggaatgttaacaatcagttgacccttcaactaaagtggaaaatgcactgggtataaatagtcttctactctctcagccaatttagtggcatctgtgggacctgggtgcatgtgcatatgtgcaagtgtgtgggtgcacacatggtggggaggacagacacagagttccaatacaggagacaagactcaggaaggatgatgcaaggggtggatctgggcagccctgaggcagccatgagaccatggcttcatgccagagaggcactagcccaaaagaatagtgcattattttttgtaatccatagacttagggtacaaggagccagatgaacagcccctccccccataggctctgcctctcctgcagttctgaactcagggcaattcatcagggggtcccggtcggagttatcagatgatacagagaaggctcatgagtttttaaggaaaacaaatgggtggcaagcagggagctgcggaagtcctaaattaacttcctttccattcctgcactcctgtatttacctggaattaactatttttaaaaaacaaaagcatgacaaaatattttaaaactctgataataatttatttcagtccaataaagtaggataacgccatattaaattaatcatattcctgaaaatcccaaatgtgttacccatcatatggataactttttttttttcttgagacaagagtttcactcttggtgctcaggccagagtgcaatggtgccgtctcagctcactgcaacctccgcctcctgggttcaagtgattctcctgcctcagcctcctgagtagctgggattacaggtgcgtgccaccacacctggctaattttttgtaaagacagggtttcagcatgttggccaggctggtctcaaactcctgacctcagctgatccacctgcctcagcctcccaaagtgctgggattacaggtgtgagccaccatgcccagctggataactttttttagtcatagccaagagccctcaaagaggatattaggataaaagacatgtaaacaaatcctagttctgtgtctcatcgatgcagaagttttcaagagttttactttgggatgatgaaaaagctttggagttggatggaggtgatggtggtacaacattgtgaacgtacttaatgccaccaaactgcacactttaaaatggttaaaatggctttaaaaggtgtgccttaaacactccttgacattcatttatttcatcttgacagtagaaaatgtttgaactatggaaatggacagaaaaatataatgagcaaatctcaatcagttaaacttaagtcaaatgaagcatttgttatgatagaagtagctgaagttactttttgaagacaaaaaaaaaaaaaaaaaactatggcaactggaagattgtaattcaagtaaattttttttttcttgagatagagtctcgttctgtcgcccaggctggagtgcggtggtgcaatctcagcttactgtaacctcggcctcccggattcaagtgatcctcccacctcagtctcctgagtagctggaactacaggtgcccaccaccatgcccggctaatttttgtgtttttggaagagatggggtttcaccacattggccacgctggtctcaaactcctgacctcaagtgaacgtcccacctcgtcctcccaaagtgctggggttataggtgtgagccaccgcacccagcctcaagtaaatttttatgacactgtaatgtttaagaaacataacagtagggaatccatatactattccttttaggataaattaataaagctctgcatgttatcatttttaaaaagcttccatggtgtacaatagaacagaaaacaattgatatcattctcagcaaactaacacggagaacagaaaaccaaacactgcatgttcccactcataagtgggagttgaacagtgagaacacatggacacagggaggggaacatcacacaccggggcctgcccgggggtgaggggataggggagggataacattaggaggaatatctaatgtagatgacgggttgataggtgcagcaaaccaccatggcacatgtatacctatgtaacaaacctgcacattctgtacatgtatcccagaatttaaagtataataaaaaagagacatctacagaattctaatatgcagtaccaatgggaaaaatccctctgaaaaaccaatgtccaaacatatgcagtattaatgatttgaaaaatcaaagttagacagggtgtagtgtctcatgcttgtaatcccagcactgtgggaggccgaggcgggtggatcacgaggtcaggagatttgagaccatcctggctaacatggtgaaaccccgtctctactaaaaatacaaaagaaaaagccaggcctggtggcggacgcctgtagtcccagctactccagaggctgaggcaggagaatggcgtgaacccgggaggcggagcttgtagtgcgctgagatggcaccactgcactccagcctgggagacggagcgagactctgtctcaaaaaaaaaaagaaagaaaaatcaaagttcaagtatgttttttaatttccacttcagggtatgtctcattagtacactgagacagtcgagatcaataacgaaattttttttgaaaattgtatgtatttgcgttgcagggtccatttttttccttctattgtttctctttaaatgttgatgtaagataattttaaacttccgaatatcataaaaactctcagatgaaggccaaggcagttcttgatttccatatctggttttgttaacacatatattactctctttctctcttactggttcaaaaattgcaaatcttatgaccccctatgtcctggagtcaaaacaactctggatagaaagtgattatgcgaagtttattctaaaatcaaaagcgaaataagacctcctacgttttttgtttagttaaaaacaacttactgaatcccatttctgatgaggaatttgaaagtgcaaaatgccaacatcctgtgttgggatcaaaatttccaatttgcacaggaaaaatttgtatctaaaacactgaaaaataatttctcctccgcctaagaatacccttccctttctcatagtgggcccctgctatttctgtagctatcacctccatctcctcctctccaaactttcctgtcttctgtttcattgcccagcttccagccaccttgcctttcttgatgcctctccagcatttgatactattggccacttcttgaaactatcacatttctgaaattcccccgaaaacatcccctcctggttctctttctgccatttggatggtctcttcttagaaattctcatctaagatttctctctgcccatcctttcaatgcccctgttccccaggattccatcccagccccctcctcttctctctcatccatttaattttttgcatgatcatatttccagtaattcctaagtgcctcctgtcatctcagccctcccttactgaattcaagccttaaaggcatgatctgggtgtctgagagccacgcccgtcctcgcatacccaaaacccttgtctccatgacttctcaaatgtacctcctctctagaatccccagtctcagtgttaccagcacccatccaccccattcttctccaaagagcattctccatgtaacctctgtgtagtcatcatgtctctattctatttcctaaacttctccaaaatttatcttcctctctccatttccactgcctcagttcagggcctcagcatcactcaccaggggctcttgcaacgggcccctatcaccctcctgccccccaatcttccctctctcttctctttcctctcatattacccatccctctaaaatacaaacctgatcaatatcccctggatataaaagcatcacaggttctccagtgccttctgaataaaatctaaactccttagcatgcataggaagactcttcatatagactttctctcattgctatcctacttccatctgtccatttcaccctcatataccctgctcttccctttctcaagcatgccctggtctagtacaacagaatcgtgggccaggtctcccattctgctaggtgacctcccattcataccttcatggctcattccaaacattgtcttctccagaatcctctagcagagctggctatctgggttccccatctgcaaggagtctacaactcctgaccttgacacccctcttccctctgaagggcagggttagtggtacacagcatgtcagccgtgaagcacaggtcaacatgagagtccttgaaagggccacaaaccacagagttttgagaattcctgttcctgctgtgggtacctgtattggtccattttcacgctgctgataaagacatacccgagactgggttatttataaagaaaaagaggcttaatgggctcacgattccacatggctagggagtcctcacaatcatggtgaaaggcagaaggcacatcttacatggtggcaggcaagcagagaatgagagccaagcgaaagaggaaaccccttataaagccatcagatctcgtgagacttattcactgccatgagaacagtatgtgggaaaccgtccccatgatccagttatccctcaccaggtcccacccacaacatgtgggagtcatggaagctacaattcaagatgagatttgggtggggacatagccaaacaacatcagcacctcagcacccaactctagtagcccaaggacagtccacccacgtgcctttggaagcatcctgtaggaaatgaacttcaccgcaatttatcagacaatatattactaacccctttgcagagaattctgaggatcttgaaaaatgttctcgaaaaaggttcttgtcgtaatatgttccttggattattctgtgttatatcaatttcattaaagtgaaatgtctcagtcaactacttcacataatatccaatacattgatttttattgagtactcacaggccaatgttgagggcttgagatatgaaaaatgaatacgcatgggccacaagataaatttaaacccatgatggagtacaattagagaagtatcattctgtgcatggcacacaaaaaatggattatgatgtgttcatttatttccatgctggaatctgattagaaaatctgatttgaggccaggcatggtggttcatgcctgtaatcccaacaccttgggaggccgaggcgggtggatcacctgaggtcaggagtgcgagaccagcctggccaacatggtgaaaccccatctctactaaaaatacaaaaattagccaggcatgatggcgggtgcctataatcccagctactcaggaggctgaggcaagagaatcacttgaacccagaaagcagaggttgcagtgagctgaggtcacaccattgcactccagcctgggcaagaagagcaaaactctgtctcaaaaaaaaaaaaaaaaaaaaaaaaaacagaaaagaaaagaaaaaagaaagaaaatctgatttgatagatagaatgtcattataatgaatccttttgaggaacacacatttcatatattaaaggttattcattatacgctgggcaattctagaaacctattaaaaaatagcctaatgaatgaaagtcacagaaaagcctcctttataaccaggaaataatttagacagaagaacgttatggaacaaatgtatgtcaatcggtcagtaactgtagatctttgagataatataggctcaagagtcttcctctgcaaccccttccagacttgctgaacccagcactgggtattgtgaatatctataagcaatgccttccccagttctgagaaaatgaaacagaacaattaaattgctgctgcagaaagattctcttaaagtcgttcgaaaagagcttaaattttatgttgcattttgtgttccattcatcctcgccattaaactgtgttttcttggttgttgcaatatattgttctttatttacattaataatttatcataaggtgatgacttttgaggaaatgaaatgtaaataagctaacttcagtgttcagtctctaccatgatttaaagactctgacgtgttcccactgctgtttgcagaattgtacaaatatcgagtgtttacaaatctcctgtgcagtgggacgactcgaaggaggagaaagcgcagtcctgaaagtcaggtcacgattatgggcccacaccttcctccaggtaataaacaaccacagaagcacatacacactgctcactgggagctgcttcacaaaagctcagtgggaagtcttttcatagcgatttctaatttaacactgtggaagtccgaggcagatggattacttgaggccaggagctcgagacaagcctggcctacatggtaaaaaacccatctctactaaaaatagaaaaattagctggtcttggtggtgaacaccagtggtcccagctacttgggagactgaggcatgagaatcccttgaacccaggagatagaggttgcagtgagccaagattgtgccactgcactccagcctgggtgacagagtgagacactgcctcaaaaaaaaaaattaaaacttgaattttaaacttaaaaaaattttttttacatttttcaatgtaaaagtttcaaatttaaaaaattacttcaaataaaatgtatgtggaggagttgaacaagatgaactggtcatttttcccagcaggtaaagacagtttaaacatcctgagtccctaagaccttgagaatagatcagaaaatgtacttagtccactgttatatacccagtgttgggcacagtaactattagtcagtggcagcatgatgagtatgagaacataatccaagatatatatgtccagagaagttaaaatagaaatcaatttagaagggaaaggggagattgttctagaaggttcctcttgtcaagtggtcctgcagcatgggctccaaccaggacagcacctcagccaagttccaggtacgtgagtatgatttacagattatgcaccactcctgtggttggctctgcatcccacaatagccagggatcattccattgatttgtgcacttttttttgttgttgttgcttttctgagatggagtcttgctctgttacccagcctggagtgcagtagtgcgatcttgactcactgcaacctctgcctcctgggttcaagcaattctcctgcctcagcctcccaagtagctgggactacaggcgtgggccaccatgcccagctaatttttgtatttttagtagagatggggttttgccacattggccaggctggtctcaaactcctggcctcgactgatccacgtgcttcagtctcccaaagtgctgggattacaagcatgagccattgctcctggccgactatgggcattttaaaagtttaaaatctcttttatgctaagaaaatgagagtttcattttggaaagcgctatttaaatgatactgctgtgttacaaccttattgtttggggaggaattttttttttaatcctaaattaactcttaccacgtctacacattcttgctcacattttaactactaaacaaactcatttggtttattgtgccatgaaaaatcaaagggtcaaatccctttgagtctagttataaatatagaatttttttatccctagatttttatgttttctatgatttaatatgcttctacagtctcgtcaatcttatttttgtttttaaaataaaaacgagggaaattaaagttttgttttaaaggtcattgtgaagccatcttcctttcttcctttcccttcccttcccttcatttcccttcccctcatttcccttccctttccttccctccctttcttcccttccttctttcctttctttattttttcattgctttttctgtgtctcttttctttctctctcttttcttccttttctttctttcatcttccttccttcctttcttactttattttctttctttccttcctttccttcctttctcctaaggcagagtttctcaatctctgcactattaacgttttagaccagatcgcgctgtgttgctgggagccaccctgggcattataggatacttagcagcacccctgacctctacctagtaggtgctggtagcaccctcaccccaggtgtgacaaccaaaattctctccagatattgccaatgtcctcaggggacaacatcatcccattttgaaccactgacctaaggagaagtacagtgcccaatttatttgactttttaaaaaatcaaacctttacatattcattcactcaacaaatatgtagggaggacctactgtgtgccaagggctgcttcagggtctagttataggagaaatagctgtgaacacaacagacatagcacctgccttcacagggctgttatctcagtggagggaatcagaaactgagcaggcaaacagatgcatcagtgccgggaagaaagtagaatggtgtagggagatcagggcagtgggataaatagtagggagtgcggctgcttctgcaggtaggatgggcacaggagaggcctaggaggaggtgccatggaactgagacctgagtcacgcaaagacctgtaggcagagccccagacagaatacaacgagctgtgcaaaggccctgaggccagaacactttagacatgtttgaggaacaaatggagaccagtgtgtcagtatcaccactgatgagacagaaattacaggaattacataccatggatgggagcctgattttagcctaagtgcaatggaccactacaaaattaacctaaggagtgatgtgataataattacgttttttaaagaacacaagtaaataaataaattaatacatactctaacaaagcaatactacacagtaataaaaaggaatgaattagacacattggcatggatgaatctcaggcacacaatactgaattttaaagtcaattatgattccatttataaaaagctaaaaaaaaaaacaggcaaactaagcagtaggttggtaaaactttaaaggaaaacaaggaaatgaaagtacaaattcaggagagtagtagcctcttagggtagaagacatttagcaagaaacgaagagaatgtttcaaaggtacttgtaatggttcattaaagtcagcggtaggcatgtggatattcatcttggcttctttatcatcatgtgttataaatgatttatgtttactcagcatctaataaaacagctttgaaagggcaatattgaaagcactgggtttggaagctactgcaatagtccagagggaaatggtggtggattaatctagggcaaaacagtggagcaagtggaacaaggtatgagtctggattgattttggaggaaaaactaacagtactggttgaatttattgttagaggatgagaaaaagagaagaatcaagatggactccaaggttttttgcctaagccaaatggtgaggaagacttgggggaacactgtttcaggagaggaaaccaagagttctgttctgaaccctgtattagttatctattggtgcataacaaatttccccaaaacctagcagcttaaaaccgtagacattcatcctgtcactctgagtcaggaatctggctatggtttagctgggtgattctggttcagtgtctctcctgaggttacagctgagatgtcagttggggctgtagtcatctgaaggcttgaggggctggaggctctgttcacaacatggctcagagacatgcacagcaggccttaccacgtggccctctccacagtgctgcttgagcgatctcctaacatggcgactagcttccctcaggcaagtaagccaggagatgccaaggctcttacatattttctgacctagcctaggaagccactttctgttatttccacaatgccctatcatttgcacatatcagtcatattcattcagtaggcgaggcacccacacaagggtgtgaataccaggagggaagaatccctggtggccatcttggagggttgctaccacagatcgttagccaactcttgaatttcctacttttagatgcaatttgtctgaaagcataaactgtaaatcctgtttttctctagtcagatgaaagctgggagtaagctatattgttgtgatcaatagattcatttcttggggctgatgcaacaaaggaccacaaactaagtggcttaaaacaacagaaatttattctctcaaagtccaaaaccagaagtctgaaaccaacgtgtcagcagggttggttcctcctggaggctctgaggaataaactaccccctgcctcccttcaagttatttgtttttatggggttttggttttgttgttgttgttgttttgttttgtttttttttggtagagacagggtctcactatgtcatccaagctggagtgaagtggtgcagtcataactcactgcagccttgaactcctggactcagacaaccctcccacctcagcttcctgagtagctgggactacaggtgcctggcaccatgccaggctcagtttttaattattttttatagagattatatcttgctatgttgcttaggctggtctcaaactcctggcttccagtgatcctcctgccttggcctcccaaagcactgggcttagccgcatgaaccaccaggcctggcccctcctagcttctgatggttgccagtaatcctgggcattcagtggcttgtagaccatcactctactctccttccatctcccatcacctttccctctgtgtctctgtgtccctgtgtcttctgtttcttataaggacgctcactggatttagagcccaccctaatcccagtacagtctcatctcaaaccttaccttaattaattctgcaaagaccattattccaaataaggtcatattacgagattctaagtgaacatgaatttgggtaagacattattcaaccctctaaaatcaataatcttccatccccactaacaaagcctgactctattttgctacagtattgcaccaatttctttaatctagtaaatatgctccttaaactacttcaccaaccttactaatatgagaagaaagcaattaattagggtttaaattggttttgttatgactctgttcactgcatacattttccatctactcttagacattatcactaaatgggcaacattttgaaccagaacagttggggctgaagtcatctgaaggcttgagtggggctggagatgcagtgcagatgctcttgcagtttgggtaaatattggcaaaagtgtgtgagtaaacacaggggtgagcatatttttgaatttcatatgtgaaaactgcctattagcaaagtgatgtgcaaaaaactacagacatacattaaattcaagttctaggagatatgcccctgactaacattagacagagtctattttctctgtctctggtagatactgggtcaggatgcaggagctcagttccattcctgcctggttgtgttcaaagcacttaactttcatggggctcaaattccctatttgtaaaatgaagagatttgactaaagtctcctttcatgcctgaaaattcactgattctataggtagctcacaagtaatttatggtgtttattctacttggtgtaagccagcaataactctgtatgctcttaatagcctacttttttattgtgttgatgttttggttgaccgagacagactacatctaaatggctctttacgcttaaggaacagcctgccaatctttccaaagagggatgtttgtctgcaaatagtcagattactattgagtgatcgccatgtagctaagcaccatgatacatgcttgtatatgaatgactcatttaattcttacagcaatcctgtgggacatgtattattattgtcagctgcattttacagatgagcaaactgagacatagatattatatggccttcccgagtcacatagatagtaagggggagaatcttgagcttttaccctatgtatgttactacactagactgctgaactaaagattactataacagcctctgtggattttatattttgatcactgtattacggatagctaaactataactcttaaattatggataactatactataactactatataaaggttttaaatactgtgtattaaaatttttcaagatatttaaattgtatagcatgctatttcagaatccaataaagaaaacatcttatgattcttgaattatactgtccaatacagtagtaatagtcatgtgtggctatttaaagtatttcaatttgactaaagtttaaaattcatttccccagtctcaccagtcacatcttaagtatttaagagtcacagctcatggctcctgcattggtctgtgcagattaagagcatttctctattgaagaaagttctatgcagcagcactgttttaaaatgttagggaagcatatttccattcaaaattgcaagattcgatcatacaatcaattattgtatctatgattatagacctggactgtgtttaataatagctttgtgactttccttatatcccctcgtaaagtaagaattaggccccctttgccccataacagtgtcattggccaccttaaaaggcaaaatctctatcaggaatctatttttccctaagtgtgatgttacaggtttgaataaacacaacagcctcctgctcgccctcctgactagtgagcaaagacagcaaaacgaggtgatatgtagaccaaggggccgaatgtactggctttaattcaaagcttagatataagcaggaaccatgcaagtaaacttttggattcatatttgctaagtgaataaaatattgaaattctgccatatgtaatgaaaaaaaaaaaaacttgtgaggttgtgttaggaagttgttttgggagggaaagtggaggaatcttcccaaaaatatatctgtagttgacatcagagggtaagctcctcaagagcaggaggaatgttttcttgtctttgaatcttcttcccagcccttgtatcacctgacacaggatactactcataatgctttaatgaatgaaacatctcaggccaaatgttaggcttggctggtacacaagtccttgtctatttaaaatgaaaccagtcaaaactaaccaacaaatgagatcacaacaaattatccctcatggcctaaggcgagtagctcaggaagcagcagatattctagaaatgtaaaaacttgtgatacctttgaacaaagtgaacaagaagtgatttttgatgcctttctctggggtctctggaaataccaccttgatggcttcgtttgagatgccaaagtgatgcagggcaggtgaaccccaaaattggggcttagcccatgagcattcttggcttcattcagaaaagaattcaagcaaccctatgttgccttttcaggtgacaggtgacactgcttgtggcaaaaaggggttcattctttatgagaggatgtaaggaaagtcacaatctccaacagccttttattgaactggacctgctgcctgaggagcagggctaactcctaggcagcacacacagagctggacttgctgggctcttggcaactctctttatatccacttatacccatgttcaattatatgcaacttaaggggtgggtgaatgcaaattgaagggcaagttattcagaactctctagcaaaggggcaataacttccaggtcgttgccatggaaatgggcaataacttctgggctgttgccatggcatttgtaaactgtcatggtgctggcgggagtgtcttatgctgatgagcaatgaaggcagctagggattgctttagtagctactggctgccttcagccagtttcttcccttcatcctgtctataccaggtcttgttttagtcatcagggttgtgaccagaaaacaagtcctgtcagtcccatacctcaaaagcacaggtacagccaagaatgcacctatgctgacatctgtgcccagccagcccattcaccagaagaatcttccatgaggagcttgggctcatgtttgttacgacatttggctttcctcccaaatacttgcaccttatcctccctcaagccacaagctgttctgatttagtgagtttagcaaagacttcttgcattttgggcagaggcgagcatctcattttcttacatctttcaaactgaaaccctccaggttgagatgagaaggcttccaaactgaggagagaacatggatggaactggaggctatgttaagtgaaataagccaggcacagaaagacaaatatcacatgttctcactcctatgtgggagctaaaagggtggatctcatggaggcagagagcagattcatcattaccagaggctgggaagggaaggtggggaacagggatgaaaagaggttggttaaagggtacaaaaatacggtcagaaggaataagttctgatagtcagtagtacagtggggagattatagttaacaataatttattgtctatttcaaagtagctagaaggaagatttgtaattgtattagtatgttttcatgctgctaatgaaaacatacctgagactgggtaatttacaaaggaaagatgtttaattgactcacagttccacatggctggggaggcctcacaatcatagcagaaggcaaaggagaagcaaaagcatgtcttacatggcggcaagagagcatgtgcaggggaactcccatttataaaaccatcagatctcatgagacttacaacaagaacagtaggggagaaatcaccctgtgattcaattatctccacccggccccacccttgacactggggattattacaattcaaggtgagatttgggtggggacacagccaaatcatatcagtaatgttcccaatgcaaagaaaagacaaatgtttgaggtgacagataccccaattgccctgagttgatcattacacattgcatacaggtaacaaaatatcacatgtacctccaaaatgcatgcagctaatagatatcagtaaaaataaataagaattaggctgcctttcctctttgagccacaccctaatttgattcttttcagttccataaggcagacaattcaggatctcagggaacagagacaagtccaaagagtcatgattgttcttttatttcctgcccaaaataatgacccgcagtattgggtcatactggctcagcttctggtccacttccaaaggggagatagtgtcaaatgtctgagtagtgcaaggcctcaacccacaatgctgacataatttatctagacttaacctggggaagagtcatggtgatgaataatgttggctgcaactcaccatgctccttggacacaaccaggagacagattcaaagggatgaggtgttttgataccttttatttcatctactgagacagagactagagacccttagtgacattcaatcagaattctgttgcctcgtttgaggtaggttccatgatcagagccagtcacgaactccttctcactttgaggaagtgagaggcaagcttccctctattctgtagttgaaatggaagaagcaagcacacaccccaaagcagctttgcaaaatatcctatatatttgcatacaacatatcttccagaaatgctacacatagatctttgtatagtttataaccagtctgtccattcccttgtcttctaaggaaacgttaaaaaaaaaaaaaaaaaaaaaaaaaacctttacctgaaaatgtcaggtggtttcttgaagggtctttcataaaatttggaacttcaaatacaagttgtcctgagttcaaagaaaacctaattctaagtttaataattcagagaatccaagtgttagcctcctcatgataaattgtcatctgagtctttttatcatttaattattttgttggcatgcatttattagcactaaactaaattaaaagcacttctttagactgaacaaaaatgatgtcattttaacaccttaacaatttgtcataaacttgaacattttcttttttattattattattatactttaagttttagggtaccatgtgcacaatgttcactggccttttcaaattagattctgcttttctaaagtgacataggcttccatagaacgccaattttcttaactatagtttttttttttttttttttcgagacggagtctcactcagccgcccaggctggagtacagtggcatgatctcagctcactgcaaccatcgtctcccgggttcaagcgattctcccgtctcagcctcccaagtagctgggattacaggcacccgccatcatgcccagctgatttttgtattttagtagagacggagtttcaccatgttggccaggctggtcttgaactcctgacctcaggtgatccacctgccttggcctcccaaagtgttaggattacaggcatgagccactgcacctggccaactatagaactttttaactgaatacccaggatgactgaaccacttgcatttagttgatttgcttatgatcactctattgattggctgttgctttttattgttttcttagaaacagggtcttactctgttgaagtgcagtggtgcaatcacatctcattgcagcctcaaacttccaggttcctcccacctcagccttctgattgtctgggactacagacccatgccaccagacctggctaatttttgtgttttttttttgttttgttttgttttttgtagagatgaagtctcactgtgctacccaggcttgtctcaaactgctgggttcaagtgatcctcttgccttggccttccaaggcaccgggattacaggcatgagacactgtgcccagccaattgttactttttatccaagagttggaagagaggtgccttaacgaattcccaagtctatacaacctaaatgacaacaacacattcctcctgttacttttgagcatcacgtcctaccaaaaagagggagaacaacttttcaatgaggcaggactcctatcattatgacactagagtgtaggggaaagttactattttagcccacacacttcagttccatacacgacattctattccggtaggaggctgattgagtgaaagttacatcttcgtttccctgttaaagaagacccggtgtctgcaaaaagtcaatagtaattgagtggctttggaaacaataaatatttagtgcaagtagagtcagaaaagaagaatctgtagcaacattttgaagtcctagggaaaagcatcacttccagagatatgggaaagacgggtacaattcgctgtgtgctcacccacatccttagcccaaatttctgcactgccacagtttctgcttatttcagtgtcaggtgccaaatcctaaagaggaatgcgttattataatctaagaatacactgtacattggggcctattaacagttttgtcatacaaaccaggaagagggaaacgttttctgccctcctaatccaggctagaaagtttacaattcttggtggatatgacttgttgcgttatgttggtttctgtccatgtaacgaacatgcaaactggtcagaaacagattgtatgtaggttaatcctaaatggtcccctattctgtgattgttgcttgaaatagaaatttcctttacaggtgaaagttttgccactaattccttaggttttgtcacctcaaaaggcttggtttctggtaaatattgaatatttcaaaacgggctacataaaatggatatgtgctttaaaataattattgggaaggaattaagcagctggaagttgggagtgggagagcttgtgtcattgcctgacacactaggtcgctaactcctccgtttgttaccaactcacttttattggtaccatgcctataagcaaatcattgtgcaaaagtgcatgatagagacagccagtgagctacaaaccatggtttaaatgatgcggtaatgacagacgagcaaggcattttctggggattaatagccagctggggcaagacgaaggtcctcattgttgccaagggatattaaccccagctgggttttcaatcctaaattgcctacaatgtggcagtgattgctattacatgagtagattgctatatgggagagaggttatattgaacataagaataatactattgttacataaagagcacaactggaagcatttaactttggatgtggaatcactattacacctctgcccgtaattgctttccatgagttattaaatactcacctgtgccatgcctctgatctacaacgcagaacttgggtatctttgatgctgactctgctgatcagtctaataaaccacgttttccattccttggagctccagagcattctttaaaagtgaagatgcatttttttttccttccaacaagggtggaagaaaccttacttttgaagaatgcgttcaaaacaaaaaacagattgatctaggagaggtggtgttacaggctgtttgcttatcttactgtgcccggaattggtgggttcttggtctcaccgacttcaagaacgaagccgcagaccctcgcgatgagtgttacagttcttaaaggcagcgtgtccagagtttgttccttctgatgttcggatgtgttcagagtttcttccttctggtgggttcgtggtctcgctggctcaggagtgaagctgcggaccttctcggtgaatgttaacagctcttaaggcagcgcggagttattcgttcctcccggtgggtttgtggtctggttggcttcaggagtgaagctgcagaccttcgaggtgagtgttacagctcataaaggcagcgtggacccaaagagggagcagcagcaagatttattgcaaacagcaaaagaacaaacctgccacagtgtggaaggggaccccagcaggttgccactgctgtcccaggcagcctgcttttattctcttatctggccccacccacatcctgctgattggtccattttacagagagcccagtggtctgttttgacagggtgctgattggtgcgtttacaatccctgagctagtcacaaaggttctccacgtctccactagattagctagatacagagtgtggacataaaggttctccaagtccccaccagagaagctagatacagagtgtggattggtgcattcacaaaccctgagctagacacagggtgctgattggtgtgtttacaaaccttgagctacatacacagtgccgattggtgtatttacaatcccctagctagacataaaggttctccaagtccctaccagtcaggagcccagctggcttcgcctagtggatcccgcaccggcgccgcaggtggagctgcctgccagtcccgtgccctgtgcccacactcctcagcccttgggtggttgatgggactgggtaccgtggagcagggggcggtgcgcgtcagggaggctcgggctgcacaggagcccacggagggtggggggaggctcaggcatggcgggctgcaggtcccgagccctgcccctgggggaggcagctaaggcccagggagaaatccagcacagcaccggtgggccggcactgctgggggacccagcacacctaccgcagccgctggcccgggtgctaagcccctcatagcccacactcacccgcggaactcacactggcccgcaagcaccgcacgcagcccaggttcccgcctgcgcctctccccccgtgcctctccctccacacctcccggcaagctgagggagccggctccggcctcggccagcccaggaaggggctcccacagtgcagccgcgggctgaagggctcctcaagtgccgccaaagttggagcccaggcagaggaggcgccgagagcgagccagggctgtgagggctgccagcatgctgtcacctctcactattatttgctagcaccccaggctacgtccaggcacacaccaattagattgaggaggtgagagcttatcaatatccccttcaaaggaactgtagccctcatcttatatcactatcaccttttacaacttcctgaattgcttactctaattaaagggagaaaggaaagggtgtccaattcaataatggaaagatctttcataattgccatcaaatggatggtacatggagtgggagggtcgtcaaatgaccaaagcattagatgtgttcattcacccttcattcatgtggtcagagatccagtattgattaagcaagctctcctgtgcacattgttctaggttctgtagaagatatagacattatattccaaggaatatgccttgcatctttgtatcatatagttggggagaaaagtaatagagaaaaattaaaaattaaacaacaatgtgaaccttccaaaaaatatgtcagatacagtctcatctcagtctcactgaatcagaatctctgagactgatctcagatatgtctgaagttcagcaaccaccagaaacggcagtcaagattggtgatgaggctgggcatggtggcacacgcctgtgatgccagcactttgggaggctgaggcaggaggatcacttgaggtcaggagttcaagaccagcctggccaacatggagataccctgactctactaaaaaaaatacaaaaattagccaagcatggtggtacttgcctgtagtcccagctacttgggaggctgaggcaggagaatcacttgaacccgggaggtggaggttgcagtgagccgagatcacaccattgcactctagcctgggcaacagaatgagactctgtctcaaaaaaaaaaagattggtgatgtgatgaatggaaaatatgagaaatcaaactgcagccaacagcaggaagggcaaaggaaggaagtgaaagaaagttcccttagagaaacatattaatccacattctacatcctagagttcaaatgctgtctatgatgcattaggaaactttcgcatttataaatgcagaatctgtaagagaaaagcgttccatctagaaagattttgatgcagagatgcagttttcaaactatttatcaaagacatgacttcaagaacagtaatattttctatcaattttttattgaacttggagataaaagaaaacttcttcattggaggtttgggagcatggaaacgcatttgagaatataattataatccttacccacaagatctcattactagagtttctcttgtttctatcagtgaggatagcaaggaaattagattgaaatcaccaggtacacacatgattttatgagcaaaagtttccgaattgtataaaaacccttctcaaacaaacaaaactccgacttttagttaaaatggaaatgctaagagagaagagatcattagaataacatccaaaaaggaattttcccaaatgagtagagttgtttattctggagggtaggagtagaaagaaacattcaaagatattgtaactttaagtatataaaagttacatactatgtcctgcccttaccatgtagaggaaaaaagcgtttatctaatggagaaaaaaattctgccacaggggaaaaagaactttgtaaaaaatatttaaggaaaattattggactcatgaggcccaacattggattatagacagtgatgtactggtagatttttactaactactttctgggaaggaaaaagagccccgatccgtaacatttgccactgatttcaagccaccaccatgatcgtcacggaatacagagctgggaagagatgccaggtcccacaccattatgtagtgtttcctcttacagatacagtagacataaatcacatcctgagcacagataatagtcaaatgtaataaaatagcaagcatgaggttttgagtatttattaccttttttttagaaatataatttacttaagtttacatttatataatttaagttgtaataatggctctgtttaacaaccggcacccaaaagtcttgaaatgattaacacttgggtctcaagagccatgatgagccagttaggacccagcactgggtagatcgaaccattgtatccaacaaaagagagccacagaagcttcagttctccaagcagccttcctgagtcactcttaaatattttaacattgacttttatcaacagttaatatgagaccctattaaacaaacagagctttcactgagaagctctgttaaaaacactgtttggctctaggtcagtggttcttaactggggtgattttgttcccctggggacaactggctgtaactagaggcttttttttttttttttttttttttttttgagagggagtctcactcggttgcgcaggctggagggcagtggcacgatctcggctcactgcaacctccgcctcccaggttcaagcaactctcccgcctcagcctcctgagtagctgggattatagggacccgccaccatgcccagctaattttttgtatttttagtagagacagggtttcaccatcctggtcaggctggtcttgaactcctaacctggtgatctgcccaccttggcctccgaaagtgctgggattccaccacgcccggccggcatctttgattgtcacaactgagggagggtgctattagcatctagccaggggccagggatgctggccaaacatcctacaatgcagaggacaggcccccccacccccaccctaactcagaatgctgacagtgcttaggccaagaaaccctgttgtgagtcttgtgtaatctgtgaaatatactacgatttttttttctttttgagacagagttttgatcctgttgcccaggtcggagcgcagtggcgtgctctcagctcactgcaacctgcgccccccaggttcaagcgattctgctgcctcatcctcctgaatagctgggattacaggcgcttgccactatgccaagctattttttttttttctggtttttagtagagacagggtttcaccatgttggccaggatggtctcaaactcctgacctcaggggatccaccggcctcggcctcccaaagtgctgggattacaggcatgagccactgcgcccagccaatacatttctttataacttactgccagtttctctcctaaaatatttccgtccatctgataagaattttgtcacccattatgtttctcctttgtccttcactagcagtaactatataaattctttgcttgctcctttttaggactctgattttctgtttttattttaaccttattatacacagtcttttattaatgagataaattctccttagaaataggaagaagataaatggatggatagatggatgcttggatagatggatgcttggatagatggattcacgcttcgacgcttagatggatggatgcatggatgcatggatgtgtgggtggatggatgaatgcttgggtgggaggaaaaaaaagttaaaagagagaaaattaaaaaggaaggaggaaattttgccttgaaatgcaaaacaccaaaaataattaggtggctgccagtataactcttaaaaactttatatgaaatatatttaaataaatacttttactttcagagaaaaaatgatccctatgctcttgcatccctggtgtcctttgaagttaagaagatgccttatacagatcagccagcaaaactcccagaaggaagcatagtagtgagtatctttaaatatatataggcacaaataatttaattgaaataattgttttaatcactgtctagcttgtgctaggctttagtgtttacattgacttgagaaaaattttcctcttcagctcaccaatttcttacattggtctggtaatttcctagtgccttttgatctggtttttgaactttcaatataaatgtctaccccagaaaattacagggcaggactaataccatttttaaatgaagacattttattcagaggaattcagatagcagttatcattacaatgaaatcgtactgattctttcattttaaacagcatggttagtcaagtaagaagggaagaaattctttcttagggatagtaggctacggagcagccgcatggctttggacagtcattttttcttgctatgcaaagaaccttcattttgacctagaagggaataaaaaagtctactctgagcttcaactgaatgaaatgtcttttttttttttttttttttttgagagtctcgctctgtcgcccaggttggagtgcaggggcacgatctcagctcactgcaaccgttgcctccgaggttcaagcaattcttctgcctcagcctcccgagtagctaggactacaggtgcctgccaccacgcccagctaatttttgtatttttcatagagacagggtttcaccatgttggccaggctgatctcgaactcctgaacttgtgatccgcccgcctcagcctccgaaagtgctgggattacaggcataagccactgcgcccagctgaaatgtctttattaaaaactgaaactactaaacattactgacacccaaacatctatcacagaacaactctgatcatcctctgcaacctggcaaggccatgcaaaggggataaaggaatgaatgatgagaccagcaggcaccatcaccaaaactctgccttttcagttatttgtgaaggtggtcagagacttttgaaaagcatagtgctccaaaaaacaatattaggattccaccttcatcccttggtagccagtggatatttcccatccacagcttgaactcttggtcccccagaccttgttactcaaaatgtgattgcagatcaatggcatcagcatcatctgggaggttcttagaactacagaaacagacctctccagatctgctgagccaggctctgcattttatcaaaatcatcagagcattcctaggcatggtcaagtttgagaagcactgctttggatggtagataagttgataatattgtcatctctttctagcctagatcataaacttaattgtaacactgaatctttctagcctggtctactttcagtgatctaaattaaccacttgatttgtgtttctctaccctgagtatgcatcagaatcatcactcatgcaacttaaaaatacatacatgctaagacttctccccaaatattcagtaggtctggggtgggaccctgacactgtgctttaaaagtcttatgagagacaattctgcaggggagccagggttgagagcttctagcacaggcaggtggcctagaggaaaatccaaggttttcaagatagagtcacctgggtttgatcctggctctgccttgctctaattaggaaacctttgggaagtcactttacctctctgagacagtccaccacatccacctgatggaattgttaacaagatcaataagattatctgtataaagctctagcattgtacctggaacaagttagtgtcaaatctcaataaatgagagtagcctctcaaaatgtctccccttctctggctaagtccagtaagtgcaaattgaaagtgacaattaagatttgcacagttgtgggaggatcacttgagccctggagttcaaggttacagtgagctatgatcgcatgcactgcactcaacctgggcgagacctcgtctcaagaaaggaaggaagaagggaagaaagaaaggaagaaaggaagaaaggaagaaaggaaggaaggaaggagaaaggaagggagggagacagggaggaaggaaggggaagggaagaaggaaggaaagaaagaaggaaagaaagaaggaaggaaaggaaggaaggaagggagaagaaagatagatgtgcacagttaaaatatttcagtaaacttcggtggtatttaaagcaagcacagccacatctttcttcatttagaccacctctttttctttccagtgatgtcctctgtgttttggatttatgttcaacctagaaaacagaggctttgggattttaatatagaagtttcatctaaaaatgttcaaaggcttatagctctaagggaaataaatctgggcccttttgttttttccaagcacgtgctccctagcagaaacacatgttacggttggttccatccacaggattgcatctttctgcactggccacaggtgacagcctgctgttctcaactcatctcaaaagatccacaaaataatccgatacatgctttccccagccctgccacccctgttattgaattgccaaaaaaaaaaaaaaaaaagactttttatctgatgtaggtgatttaccacatcagttatgtgaaggttattgggaaaagatccaggaatggaaacaatttcaagtctcccaatatctgactaactggagaagaccttgccagtgcaaagttagctatgcagcacacagggaaatgctgccttactgtggcttgatgtgagagaagaactctgagtggagctggcagacatttttttatagtgagctcttttcaaaggctttgccattcttctcttgaagggagcccagcagggccaagagggcggctcacacctgtaatcccagcactttgggaggccaaggcaggcagattgcttcagctcaggagtttgagattagcctaggcaacatagtgagactctgcctctacaaacaaacaaacaacaacaacaaaaagcataaaattagcaaggcgtggtgatgctcgcctgtagtcccagctactcaggaggctgaggcaggaggattgcttgagcctgagaggcggaggttgcagtgagccgagatcacgccactgcactccagcctgggcaacagagcaagaacctgtctcaaaaaaaaaaaaaaaaaaaaaaaaaaagcccagccgaaagggaattgctttaaggtggtagaatccattggaaatggtagttggagaagcatcagagctctaatctgcccctgaggaaagtcattctttgttccttcttctataatgagactactatttgcttgttttcctagacccttttgtgtgatgattagtttgtttgtactcccttttcaacacggtcataattcagccatctcttgaggcccgtattagctttacttatggaagagaatcacaattcccgtttgctgcttgcatagtatctgtgtttgtaacaaataaaattcctcatgtcctgtgatgcttgtcatgtccggagacaagggaaagattgcatgattcgaagaaatatgcctgaacactgaatcgttacagtgcaacagaagaaactgaaattcaattatttgaacacttttttggctcaccaaggaactttcgcctttgcatgccatacaagtaacactcaattctataatttacatctagcagaaagtgggagtgtcttgtgtaattccaaaggtggttattacaaaatatttcatgaaaatcttcatttaaaaactcatatgtaaactgtgaacccatttggttttcagaattgttagcaaaacttctgcaccttaataccttaatatggaactcttatattaaacaattatttggagttgaaatttatgatgggaactgcttgtctcataaggaaactgtttaaatgttgtcaaaatgtgggctcagctagtacacctcatgttattattttgttctaaatggcaccgtaggtagggtgtcttggtacgtttatttaaaacattcttctgaccccactgaagtatgtttacacaagattttgtgatacataaatagagacgtcaacattaattaccattgcaaatacaagggagctttttccttctaccttggtattttttgtgaaaatatacaaaaacatatcataaatgtccacaataaaatgtaggcatattaaaggtttatttatggtctttcctccataataaaaaacaacaagatttatgacatgatgaaggtaagattaaatgttccctacttagaatcattttaagaaaatctaaaccacttacaatttatgaatactactttctaaaattgcagacaattataataaagtgatttgttaaacttacttaaagctatttttaaaatagctagaagtacttgataaataaaactgtattaaaatagtttattgactagctggcacaagattgaattgttctccctaaatttaagtactccagttactcaacatgaaacttctttcttaaagcaactgaactatctcatcacaagcccctgtgccgaaagtaaacctctagtcctaaatatgctttgtcttctgccctgagtctaccttcttggtaaaagaatcttataatgggccgggtgcggtggctcacatctgtaatcccagcactttgggaggccgaggtgggtggatcacctgaggtcgggagtttgagaccagcctgaccaacatggtaaaagttcatctctactaaaaatagaaaattagccaggcatggtggcgcatgcctgtaatcccagctactcgggaggctgaggcaagagaatctcttgaacctgggaggcggaggttgcgatgagcccagatcacgagataacactccagcctgggcgataacagcacaactccgtctcaaaaaaaaaaaagaatcttataatgaaagatttgggtaattcaggcaatctcatcattgtgtgaaattatacagaatgttctagaactatgcagtccaacatggtagctatttggctagtggaactgaagaacttgtggttttatttcattttcacacatttcaatgtaaacttaaaaactgaagcagtagatagtatttttccattaaacacggttgtgttactttcacaggactacatttcactttaaccattaaaaatttagcaattgttatgtgctgcaaatgtgaaatacatattggattttggagacttagtaaaaaaatgtaaattattagtatttttatatcaattacatattaaaatgataatagtttaatcattaataaataatacatgattcataataaagaaccaattacatgttgaaaggataatacttttatcattaataaataatagttgatatttagggttagataaactatgttattaaaattaacatcccctgcttcttttcactcctttttttttttttttttttttttgagatggagtttcgctcctgtcacccaggctggagtgcagtggctctatgatgtcagctcactgcaacctccgcctcccgggttcaagtgattctcctacctcggcctccctagtagctgggattacaggtgtgtgccaccacgcctggctaattttgtattcttagtagagatggggtttcatcatgttggccaggctggtcttgaattcctgacctcaggtgatccgctcacctaggtctcccaaagtgctgggattacagatgtgagccaccgtgcctggccctttattccttttaacgtgactattagaacattttatgttatgcttgtggcttgcattgtatttctattgggcagtgctgatcaagggcaaggttatgtcttgaagctgataatacctacagaacttcagagaacatagggtgtttaataaatattatttgaaatgatatttcaaatcaaatcaaaccaccaggcatggtggtacacccctgtagtcccagctactcaagaggctgaagcaggaggattgcttgagcccagaagttggaggctgcagtgagctatgatcatgctactgcactccagctgaggcaacagagcaagaccctgtctccaaaaatacataaataaataaatattatttgaaatgaatgaaagattcttcatatatgtcagtgtttagtcatgagaaactctaacatttatgacttatttttcctcattatttattatctaatggctacttctatctaagcttcctgtaggtttgtcaaaatgagctgtaagacaaatatagatattagaaataacaaagttttggtgtttgtcaatattttctttcctgcccaagctttccccaaaactagcctgcagtcccacagcactaacacatatttaaagaaactttggtcctgtaaaagtgatcagttaagtcgtcttctcttaagcttgcctatgcagtcaagtctctagtttatctatacagagcgtggagtttcaggaaaagctttgctttactggtttccacctgcacatggaatgccccattgccatttactgatttagagacatgaatatgtcacatgactccccatcactctatcccagaaagacctctcttgccgagacatatacgtgactcttctaatgatgttgtgtgcagaggcaaggacaaggtcgcctgattcagagaaatatgtctgaacactgaatcattacagtgcagcagaaaaaaattattcagttatttgaataattacctttggctccttgtctaactctttccagtaagagtcaagcatctcctctgcacgggacaccagatgaaatgctctgggtcgctgttgttggttttctgtatttccactgttcttactgtagtgacttctagactatgctgcaaaagcctacataagtttaggaaaacaacaagggtgaaggaaggtctctgcagctgcaccaattttagattgagaagattgggccgcctcagtaccatatggatgtcctacaggtaaaaggaccaggaaagcagaaagcaggcatgggaggagagtcactcagaggttgccttcttttaagactctgtgtattctttcccgctaatgaattgcacaggatgacatggaggaaatgcatatcatatgcataatcctgacatcagagaaaaggtatgaagtgttttttgtttttttgttttgttttgtttgagacagaggctcgctctgttgctcaggctggagtgcagtggtgcgatcttggctcactgcaacctctgcctcccaggttcaggtgattctcctgcctcagcctcctgagcagccgagactacaggtatgcaccaccaccaccacaactgtctaattttttttttttttttttttggtatttttagtagagatggggtttcaccatgttggccaggctggtctcgaactcctgacctcaagtgatccatctgtctcagcctcccaaagtgctgggattacaggcgtaagccaccacacctggcccaaagtggtattttttaaacaaacttaatgttactggaagcagactggcaacagttttgatgatgagaatttcagaatttgggaactgaaagggactttccgaatttgtgatcactgcagggggtcatcttcccacagactttttaaagacgctgctgtcaggctctttgggagcaaatgtaaacagaaagccagtacgttctgtaactatccctataaagttgttctctgcttcaaaagaccctaagaatcatatcctcatcaatttcacattttcattatactttttcatcactgctacaaaaaaaactttaaatgtctttgttagctctttgtaagtgatcttctctgcttatttctctggatagcccagttatatagatgatacatcaaaacctgcaataaccaaggggcaaagtcacctagcaaagtactcagtaggtatccactcagcccattccatttctttttattaagctaacaatttgaagagcctctatttcaactcctttagcatgttttgtgttttctctaacttataaaacttgaactcttttctgtttaacataaaatagtaggcaggaacttaagataataattttttttttttttgagactgagcctggctctgtcaaccagacggagtgcagtggcaccatcttggctcactgcaatgcaacctctccctcccgggttcaggtgattctcctgcctcagcctcccaagtggctgagactacaggtgtctgccaccatgcctagctaatttttatatttttagtagagacagagtttcaccatgttggccaggctggtctcaaactcctcacctcaggtgatccacctgccttggcctcccaaagtgctgggattacaggcatgagccactgtgcccagccttaagatattaattaggtaaaccaggagaggaaagatccattgcctggctcaccctgaattacctattagaaaattttggtgagctctgacacatgctcaaagtagggactaaaactatattgtgtcctcaatggacttgggggttatgaggaagtaatatttacatgaaacctcggaattttccatggctccagatttctctcctggggtcattgtaactggcctgtgagtagatgatcactactgtccccttcagttccaaaattctgaaattctcattatcaaaactgtgtgagtccacttccagcaatattatgttcatcttgaaataccacttcatgctgttcctctgagtgcagtcaaatgttaggattcagcagtaatttcatacatgtcatcaggtgtaattgactaaggaagggtacataacaagagaaataatctagttcttgatttgctcatgtagctgtatacatgcaaataattattttctattgatatataattgtacaaatttgtggagtacatgtgatattttgatacacacgtgcacataacgtatagtgatcaaatcagggcatttaggatatctattgtctcaaacatttatcgttgctttgtgttgggaacatttcaaatctcttctggctattttgaaatagataataaattattgttaattagaatcaccctactgtgttactgaacactagaatgtatcccttctacctgactatgtttgtcagccaacttctgttcatccagccctccccactctttgccagcttctggtaaccatcattctaccctctacctccatgagatccacttgtttagctcccacttatgaatgagaatgtgtaatatttgtcttagatcatttcagaataaattacttaggctgcagcatccaggtagaattgcaaccacggtgggtccttgaaattgatttcttcgacgtatgaactacgtttctcatccttaaacagtggtgcgcagagtgtacgtaatgtcaccgtggtgatggactgtcatgcttcacactgatgtgtcagatgaaataaagataagatgaaataattcctagcgaggaaagttaacaggcataggaagaaaatgtaatgatgactaggttgaggccagcctttttctcatgaagaacatctatcacatccttggcatgttcctgttaaggtggaatgactctctccctatctcactcctctgtccatgcctttattagtgtacatataaatgacatttggggctggagaatcgaatgaattgagtcatcagcatctgctgcatgggggatgcggatcaagaaggaaggagcaataaaaaaccaagacaagctgagaagggcaccatcagggcgctcaactctagttaagaagacagaagcatctgggcacagtggctcacacctgtaatcccagcattttgggaggccgaggcgggtggatcacttgaggtcaggagttctagaccagcctggccagaatggtgaaaccaggtctatactaaaaatacaaaaaaaaaaatagctgggtgtggtggcacatgcctataaccccagctactggggaggctaaggcacaagaattgcttgaacctgggaggtggaagttgcagtgagccaagatcgtgccattgcactctagcctgggcaacagagtgagacactgtctcacaaaaacaaagaaacaaatacacaaaagaagacagaggcaacaaagtgagcatggttagggctcagtgctagggttcaggctgtgaaaacaccaatacatttcctgctagggcaaatctcagagccgccaaccttagtcattagtctcagcctctcctgacgggtgggttatagaatgtgtcctggagttcttgagtgtgtttcaggattgaaatgatcctttcaaccaacacaattaaaactaggagaccttagaccagctgagtggaggcaatgcttgccactctgataaaaccggaatactacgttagtgaataatgtctgcatccaagaataatgtagcgctcttttctttgacaaaaggttttagcagcatggctgggtctctccttgggaatctgcagcttctttgctgcctcggcctccggaggcacaggcctccaacacaggagcaatagaagtgcttctgcccacatagggagtggttcatagacactgagcatgcagtcagattgggaaggtctcattttcctctaagcccccttgcaacagtgcgggatgaaatgggctccagtccccatatgatctttgtttttgtgtttttgttttttggcgggaaggagaaagaagagtgtcaccctgttgcctaggctggagtgcagtggcatgatcttggctcactacaacctccacctcccaggttcaagcaattttcgtgtgtcagcctcctgagtagctgggattacaggtgtgcgccaccacacccagctaattttttgtatctttagtggagatggggtttcaccatgttgccaagtctggtctcgacctcctgagctcaggcaatccacccaccttggcctcccaaagtgctaggattacaggcatgagccaccgctctggcctgatctttggatttaggattaaagtcatctccaacgcatcaaaaaaaattgaacattcactttgcacactacagttacttccataaaatacaagatgcctagcctcatgctctgggatatccttcactgatacagcacagaatctagggataaagagacctagtattgacactaattcgttgtgtgaatgaatcacttagtccctctgggagttaattttctcacctgtaaaatgaggggattagattagagatttctacccttcttgcacatccaaggattcatggttgttcacaagcttacctctctcaatgaggctagctgagttctaaggagacacatggtagacagattcattcagttttttattgagtctacttttggccattgttcccataaaagttccagcccaagtgaaggccattcctttccaccttgtcaattcctgatgcactcaattctattctagggtttctgtgatgcaaagccacccacccaccaaatctctaattagacttttacagaaccaagcagatctaggaacatgctagcttttaagagttcatgttcgagtgctacctctcaaatatcccctagatgatttcaattgtcatatggatcctttcagatcaacttccgatgttgtactggtaattactattttatttcaccaaatagttttcgcattagagctcatttgctttgttttccatttcagattaagacatcagttatttgggcaactccgaatgtttccttctcaatcccattatgggtaataatactagcaatacttcttggattgttggttctcgccattttaaccttagctttatggaaggtaagttgatttactttgttttccttttaaactagaggggctgttgagggaatttagagggatacagttagggattttaaaagacaattatggaggcatttttggaaattttgaacagtctgaaggatataaagggaaaatcgtgtcttgtttgctttggcatacttaatatgtttatatagctgacatttaagatgactagaggtgcttaatgttgctttcatcttgagatttcttgtaaataaatgtagagagagttaggctgtattaactaaggcctgtgatcttctttccaatatgcttagagtgataatattctaatgaagacttctttttcttgtttaattaaccaagatcataagctttttattgacatggccctatcatcaatcctttgacattttttataagcactatgcaaatgcaattaatataggtcaattctgatttttaatttcaactactaatgaggccaaatagattatgcatgtgataggatgcctggacttggtttttaatcttgccaattagtttgtctccactgggaagcctgaacttagtctttgatgtgttttactgaggtttgttctaaaagtccacaacaggaattaatttctggcccaccaacctaaacaattgccaagtttcacagagccttccattcccaaatggaaatgacgtcccagttacataagagtaattaacccagtcacatctttgataactatgtggttttccctaaaatcatagtgcgcttttattttgaaacaatatgcagcatgactaatagacctataaactgagaaaaccttggctttgagttaaggaatggcgtttctgatcgttatcagctctttgtgacatcctacacccatgtggtctatgacatgcctttagaatggacttttgtgttgttctgtcactcatagtaactgtatttccaatgagtataagatacaaccatgtgtgccaattgacaggatattccagtagctctgagaaagagagatgactcaatgtctctaagccaaacccagttaattggcttccaacatgagaaacagaagaaagaattgaggttccaggtgtctaggaaaatatgtagtttacttggcaaagtactaatttgacactgaagaggaggaaaatcctagagtcacctcttccctgagtttctggctaacctttggaaagtcactaagattctgtgcctacctggttctggcattgaaataagtgacaaatctattctccctctatatatgctctatgttccaccaagcaccgagggatgtgtggccatctcttcacttctttctataatccaccccaaagcagctgacaggatactttaggagacaatctccttttcctagtcaatagttagtgcttctgctccagtaagcatgtgggaaatccttgggacacattgctgtgatctcaggaaaatatccaaggtccataagtggtttgtatgaaagagggacatcttccactccaactacaggacaggagaaagggtgtgagcactctgccctcctgctcaccttgcctatgcaataaactcctctctacaagtaacaaacactctgctcgaacctcctaatttggagaaacagactgattatacgtgcagagctccaggctccttcgaaaatacataaagggccaggtgtggtggctcacgcctgtaatcccagcactttgggaagctgagacaggtggatcacttgtggtcaggagttcaacaccagcctggccaacatggcaaaaccccatctctcctacaaatacaaaaattagctgggtgtggtggtgcaggcctgtaatcccagctactccggaggctgaggcaggagaatcgcttgaaccgggaggcggaggttgcagtgagccaagatcacgccactgtactccagcctggggaatagagagcgagactcagtttaaaaaaaaaaaaatacataaagtgaaaattctttgaatgaggggtttcacaggttcccagaatgacgtgattttatagcccatctttccctttatagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagg

SEQ ID NO: 37990 - DNA, 14208 bp, Homo sapiens; identical to SEQ ID NO: 36396

SEQ ID NO: 37991 - DNA, 3730 bp, Homo sapiens
ctctcggctttcggctcggaggaggccaaggtgcaacttccttcggtcgtcccgaatccgggttcatccgacaccagccgcctccaccatgccgccgaagttcgaccccaacgagatcaaagtcggtgcgtgctctggttgtggccggggctgcgggatggagcatccctcggccctgccgcgcgtgcaaagctttccccgtatggggctcttaaagccgctgcctcccagagaccttcccggtgttgcgccgccccggccaagcctcagcctttctgggccttagcttcttcacgtgtaggtggggagggaggactggaccacctgtggcggcttgggagcccgcacgccctagggtaaggcttgtctccgggcgtttcgccccattggcctgggttagcgggcgacggggctctctccacgcctccccggtgtgagtttcggagctgcccacacccgagggaggagcgggtggcccgcctcgcgctctgtgctgtttcgagaagaggcagagggtggcgtgtccaaccccggaaagacgctgagagggctgtggctcggggctccctctgcacagacactaactcttcttttcccccagtatacctgaggtgcaccggaggtgaagtcggtgccacttctgccctggcccccaagatcggccccctgggtctggtacgttatcccctccaaggggcatttttttcacatttgtttcactttaagcgccggctcgtggagtcacgcctgtgccagaggtgccctcgtggcttggactgtcaccctcagtaggcctgagccactgaacaagtactaggtaccttaggaaggtcgtgtgtgaaaaatcgaacctggtgcctttaaattgtaattagctccatgtgtctccactgctgctttagtgtacctgaggggtgggcccaagggggagttttgaagttaggactggcttagagacattgggcagccaacatctgtatttcctcgtcaggaagtgggcatggcgttgttgggagattaaacggggtgtgggtgaagatccagtgagcgtttccagctgtgttgtagatgtaaacctagcagttaatgtggcaggctgtgtctcatgcctgctgagcaactgctggcttccccgtcattctgtcctcttggatttctctgaatttcattaggcctttatttaatccttgcacagtgctcccctgccccaaatgctcttccccattggtcttttttaacctgtatcttaactattcttccttggccgttagctggcacttaagggacacttagcctcctgttgaggctaaggattactagaggaggagaacttcagagtagcaaataatcagacctccatccaggaagatggacgtgggtggtctgacatgggagcctagtattttgaaagctccttaggtgattctaatgtcagcagggctgaaaatccccctccttaagcacatgggcacttaggagggggtctaggttacattgtggccaagtctgcagtttacagttctggacaagaaccccaacccccaatttatgctatggtgatagctgtgctctgattgagaaggtgcccttaggtacttgagatagcttcctttgttgccaagtgagaagtggtgggcaggtttcaaggctgtggttcacctctggacaccatgttgattacatgcctttatttctagtctccaaaaaaagttggtgatgacattgccaaggcaacgggtgactggaagggcctgaggattacagtgaaactgaccattcagaacagacaggcccaggtatttgcttgtgcttggtttcgggagaggagggtggggggacaggtagcaaccctctgggattcctgaagagtatttctgccaccagtggtgagccgagagtgatttcaccttgttggggaggctttgtcaagagtacggacctagggcaaagacttggacagtgtgtggccatgatttttgagagccagcgtgcatggcagtattcactggaggtggagtattcactcaggaatctcttctgcagattgaggtggtgccttctgcctctgccctgatcatcaaagccctcaaggaaccaccaagagacagaaagaaacagaaaaacagtaagttgtcttttccctagtttggttttggtaatggtttgtgagatgtttgatatatgtggctgtgttttcccttaaaggaaacctggggttgacatgggtattgggtgttgatatggttagggctgctagagccaggtagtatgaaaaagtgccacgtatgctgggtggctcacacctgtaatcccagcactgggaggctgaggcgggtggatcagttgagatcaggagttcgagaccagcctggccaacatggtgaaaccccatctccaccaaaaaatacaaaattagcctggtggtgctcgcctgtagacctggctactcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtg

SEQ ID NO: 37992 - DNA, 14419 bp, Homo sapiens
ctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggtgaggcccgagggtctgggcgccgagtgtgggaagacgccggcgcgggctggggtccggttcgtatgtttggttatcctggacgccggaggcagctccgcacccagctgtggtcgctttgtctccctggggtgggcatgggggagtgggggtcactgcggctgctctttctgctgcaggacaccacccccgacgagcttctctcggcagtcatgaccgcggttctcaaggacgtgaatctgaggccggaacagctgggggacatctgtgtcggtgagcgaaccactcaggccctgcgctgggccttccccgttcttccgttcgtccagagctctcctcacctccccgccccgaattttcactgggggaacctccatggccttgacctttgaaggggtcctgccccttcacacctgtgggtatttctcgtcagatgggaggagagactgagaaaagaaataagacgcagagacaaagtgtagagtgggcccaggtgaccggcatcggtctccgagttccctcagtatttattgattactattttcactatctcggcaaggggagtgcggcagtgtgggggaaaggaagagagatcagactgttactgtgtctgtgtagaaaaggaagacagaagaaactccattttgatctgtactaagaaaaatttttctgccttgagatgctgttaatctgtagccttagccccaaccctgtgctcacagaaacatgtgctgtattgaatcaaggtttgagggatttagggctgtgcaggatgtggcttgttaaccatttgtttgcaggcagtatgcttggtaaaagtcatcgccattctccattctcgattaaccaggtacacagtgcactgcgaaaggccgcagggacctctgcccaagaaagcctgggtattgtccaggtttccccccactgagattgtctgagatatggcctagtgggaagggaaagaccttacagtcccccagcccgacacccgtaaagggtctgtgctgaggagtattagtaaaagaggaaggcctctttgcagacacccgtaaagggtcggtgctgaggagtattagtaaaagaggaaggcctctttgcagttgagataagaggaaagcatctgtctcctgcttgtccctgggaatggaatgtcttgggtgtaaaacccaaccatacattctatttactgagataggagaaaaccgccttatggctgcaggtgagacatgctggcggcaatactgctctttactgcactgagatgtttgtgtaaagtcaaacataaatctggcctatgtgcacatccaggcacagcacctttccttaaacttacttatgacactgagtcctttgctcacattttttcctgttgaccccctccccaccattaccttatagtaatggtatataatgccacatccctcttgccaagatagtagagatagtgatcaataaatactgagggaactcagagaccagtgctggtgtaggtcctcaattgctgagcaccagtcccctgggcccacttttcttcctctatactttgtctctgtgtcatttcttttctcagtttctcgtctccaccttgcgagaaatacccacaggtgtggaggggcaggccctcttcaggcaaaacggggtgaacagggtgatggtggggagaaggtcagcaggaaaacatgtgagtaaaggaatctgcatcataaataagttcaagggaaggtactgtgctgagatgtgcatgtaggctagatttttgtttctctttacccagacatctcagtgtagcaaagagtaacagagcagtattgctgccagcatatttcgcttccagccacagggcggttttctcctatctcagtaaatagaaccaatagtcggctttacaccgagacattccgttcccagggatgtgcgggaaatagaggccttcctcttttactaatcctcctcagcacagaccctttacaggtgtcgggctgggggacagtaaggtctttcccttcccacgaggccatatctcaggctgtctcagtggggggaaaccttggacaaatacccaggctttcttgggcagaggtccctgcggctttccacagtgcatcatgtccctggttaatagagaatggagaatgacgatgacttttaccaagcatactgtctgcaaacatatgttgacaaggcacatcctgcacagccctaaatcccttaaaccttgattcaatatagcacatgtttttgtgagcacagagttggggctaaagttacagattaacagcatctcaaagcagaaacaatttttctttgtacagatcaacatggagtttcttatgtcttccttttctacatacacacggtaacaatctgatctttcttttccccacaatcttcagtccagccctctattccacccctcaccttgaaatacagcaatatgatatggcaagagtcttatccagcggatgccacccctaggtcggcaatcactgttccacctctctggggtgacagcagggctcacaggaggatacctggggagatgtgcattttcagaaactcccatttcacttttaagggcagacaacctgcccatctgtgctgatttggaaaagctgggtgcatgggcaagtgagcgtgggaccctcagggacaggagctggtggatgaccaggacaagctgttgtatggctggctctccctgccccaaaccctgatgttccagagttgcaagtgagcctgccaagggctagtgtcccgaagaaagatctggaatgcctcatctctggttttcacagctatactttagtgcccagaacaccaccgcctggcactgaatgaaagtttgttgtccacaggaaatgtgctgcagcctggggccggggcaatcatggcccgaatcgcccagtttctgaggtaaacttttctagttctagccatgggttggccattttgacactttactgggcccaggccccaggaaactcagtgtgcaggttggggaggataaggttggacaccagaatgaggcaacgagagtccttggctccctgctcttgtggactcaacctctcccctactttgaagtgctgagccacgatacacaaaacctttgggactggagcagaagttctctgtagcttgatttttagccaaagccaggttgtcatttgccttttgtgagtgtggactctgtcctcatttgtcaggtgagtaatcaagtaagaatgctgaaaagtgactttcagcctttttactagttgagctgagaactccagtcatatcccactagcagagactttgggatagggcagaaccatggggaaggaggaccctcaggaggagacctggtcaactttcctttaagcgcctgcagggtaaagagtgcttaaattattttcatgtgtagatttaagaactgcttggctttgtacttctagatgcataaataaataaataggaacattagctagtgaaggaacaggaaaacaaccctctaggaactgggagaggtttagactgcccagcctgtagttcaaggccccctacaatctggctccagacttaccttccagcctcatctcctagctgcttactcaccttgacttttcttcgttcagccggctgtgggcctactgtcttccctgatatggtcattctgtctccttgaagtgctagccctacctcctctttctgccctagacagaaagacaaaccctgcctaaacacagtctcaccattttggcatgagttatccaggctctcaggctgaaattgagagccccttcctctccagcagtagccatatacttccttgtgatgtggtttgccctcttgccctattatttcagtctctgatagttgattcattttctgtgtgttggttgggcatcctctagggcacagtgttataagcatcgcagcatccctcaggtgatgccttgtggtaagtaggtatttagtgaacacttggtggattgagtgaaggaatggtaactacctgctagggagttaagggaccctggaagggtcaaacaggctgcacaggaggctatccccctgagagagtctctgcagagcctggcctgggcactagttcagaggttcccaactctggctacacaccagaatcaccaggatgcttccactccctcagattctgagtctgtgggtctgaggaggtctggaaatttccctagggctttgtactgttggccaaggcaggttacatcaggaggggaagccctactagcttccagggctaagaccagtatgagagtcttggggaacctaccagagcaatggatgttagaatatatgatgcccatcagagtgcttcgtctaggtgggatcaggctttcaagagtccatgggaacatgcagggttagctatatgattactggtaaggccgagtggtccctggcctcagactttaggcatttcttttgctctggtgctctgtcccagcagcagttccttttctctgttttttgggggaaacagagatacacagttttcatttctgaatcttcaaagggagagagagagaaggatccctgtggcccaaacaggcttcccttgcctttgggctgtgcttggtctttgattgaagattctcataggagtagaagggaatgtgcttgtggggccctggggagcaagtgcctgcagagatggggtctgcccagtagctgctcacccccattccatggatctggcctggcatgggagcagagctgctgggtttgttcccctgccctttacatcccttgaggggggcagttagaagcataggactgctttccatgagagcctggcatggaattgggggctgattctactttctcaccttctgtttcagtgacatcccggagactgtgcctttgtccactgtcaatagacagtgttcgtcggggctacaggcagtggccagcatagcaggtaagttatgactgggtgggtgccttggtcctggacctgtgggtttgggtcagcaaagtcgctgtctgccgggcaagcaataattaccatttctgaggactctaaccacagaaagagtgcaggagcgccccctaccactgcccaaagccttttctgaacactcctgggtcttccatttctgaggctggggctgagtcccatctagagaccaggtggggaagaggctccactgcttccagaacaggtggactctggcaaaggatgtttatgaaatgcttttgttacaggtggcatcagaaatgggtcttatgacattggcatggcctgtgggtaagaatttttttctgccggagcttattaaccaacttgtgacaataaaactaattttcatctgagttctcagaggccatgatttcaggattccccccatcccctttaggcagctggccacgagtgggttctcacaaatgcaggttaagagtggctaccaactctggctgctcaggaatcactcacacctctcagcactagcaggggaggggaattggcctctaaaagcttactttcttggaaatctttcaggctggaaaaggtgggaaaacattttgagaaaatccagcatttgggtttcctttgggggcccttgttgattcatgatgctgctgagagagaagttgcagtttgggttccctaaagccagggacagcgcctactgtataactagtttgttcattttactaggctgtctgtccctttgtctccccaccttggaaccagtgtggaaacttccagctgcttatgggctatgagggacataattagatctgtggtggtttggtcactgtcaccttcacctagactgtggctccatcattggctgcagcaaatggagctgcagaagttgtatttggcagtgcctccagggaaggtcagggcacaggtgcccaggcttgggtgggcatctggtgctgggagggcaggggagtaaggtctttggcaggctgggggaggtgagcagccccagggttctgacatgcctccgctgcctttcacatcctctttagggtatttcttgagaggacgcattgctggcccctgtcccagggctgtggcagctgtcactgagttgtaatgacctatgtctacagttgtaaataaagccaaagaccactctgcaaggactttggctgggcaaaggccactgccgtttgatttctctcatgctcttctatcttactgggtgagaggtggcatggataacttgagaagggctggagcttttatgagtttcttagagagtatctgattcccaagcaggttaaggatgatggtactaggatattaagatctgggccaggcctgacacccacatcacaggctgactgttctccatagactttgatcagcaagtatttaacacagggcactctagttggaagtgggctctgggaccagactacctaaatgtggatccaggctgggtcaccatggataagttatacagtctctctagacctcagtctcctgatctataaaatggggatacctagctcagctctgttgaagttgagaagaataaatggagtaatagcaacagtttacactgtggagtatttgtctgtcatgtgactgacactgaagcactctaatatctcaaaagaattcagaatagtgctgggcacgtgaaaagcactcagtcaaggttatctgttatcatcccttgaggtgttagggtcccccatggcctcaaagcccttttttgaccacactacactgccgtctccttcctctcagctcgtagcacttccttgtctatgcaggtctgaatgccctttgagctcagctttgtggttacttttatttttattttatttatttatgtttttgagacagagtctcgctctgtcgcccaggctggagtgcagtgacacgatctcatctcactgcaagttccgcctcctgggtttacgccattctcctgcctcagcctcccaccctggcgcctgccaccatgcccggctaatgttttgtatttttagtagaggcggggtttcaccatgttagcctcatgatctgcccgccttggcctcccaaagtgctgggattacaggcgtgagccaccacagccggcctgtggttactttcaaattgtctcttctcccttctgaatttgtgggccctgagggcaggccctggcttgtggatgtgtttcctcctctgtggctgacagcagaaggcttttctctggaattgccagttggctgatttagcagtgtatagggaagcatagccctgcccccaggagtgtttattgtgcagtgctctgtcctggggtgggggtcgaaatagagacagggctcagtactcgtggctgggccttgctggccaagtgccctgcctgtgactcccagaggcccactggtcttcctagggctccctggctatttcctagcacttgccaagtgttcagctatctctggaggagtcctgctagggcccagttcaccttaccttctcctcctcttcctcctccccagggtggagtccatgtccctggctgacagagggaaccctggaaatattacttcgcgcttgatggagaaggagaaggccagagattgcctgattcctatggggtgagtgctcccatagctctgtgtgcttgtgccctctctgcctggggcagggagccaaggaacttttatcatctctgtggctggtggtgccaagccttggcctccttcctttgggcatggtctgctccgcagggactttggggatgagacttgatgttgcccttgacttccatttcctgaaggccccaggtcctctctgtgcccccgagtttccaaacatcgcccaccttgtcactcccacactgaggtgctcagtcataggaaggacaatggtagctccactccaaagccttgggggcctagaaagttgagaaggcagtgggaagcttgtgacgacagaacatgctggtgaggggaattgggccctgtcaggtgcaacaagaaaagtatgtggcatttggccgggtgcgatggctcatgcctgtaatcccagcactttgggaggccgagatgggtggatcacaaggtcaggagatcgagaccatcctggctaacacagtgaaaccctgtctctactgaaaatacaaaaaattagccgggcgcggtggtgagcgcctgtagtcccagctacttgggaggctgaggcaggaaaatggcatgaacccaggaggcagaggttgcagtgagctgagatcgtgccactgcactccagcctgggtgacagagggagactctgtctcaaaaaagaaaaaaagaaaagtatgtggcatttgtatggaacactttagcttctctgagcctctgggccatccccagggtctttgggccaggagtcctggatccactagacatatgaggagactgaggcttggagaggggcagtgccatggcttctttcacatactgtatctccaagggaagcctataaagccagaagcccaggctggaaggcctagctgtggctctaggttctcaggataagcatagaccccagccaaggtgaccaggaagcttaggtttggcctttccagaggagatttgggagtcctcatctccctacattgcagcagtcttccttgaggcataggagaagctggccaggagtagccaactagtgcccccacccaggccctcccctgctccttttctaccctgcgctgaggcagctcacccagggaacaaactcctttctgcaactgcccccatgcaggctgccctctcttgaagaaagtctctttggtgtatgagcttctcaggatctggccagcattgctgacttccctatctgtgcctttatatccactttcagggcaggctgtaccatatcctgagtcatcactactgtctgtggcatggactggcccttacatcctgtcctgcctacagccttgggaacccaaagttccaagcacagctctacagcctggtcccttcctctaggctgtcagaccaatgcccacactatctgctgtttgtgttctaggataacctctgagaatgtggctgagcggtttggcatttcacgggagaagcaggatacctttgccctggcttcccagcagaagtgagtgctgattggggaggaatgtttaaagggctggagagtgaggttttgagtctatctaagtggtctgaagtggcaccatttcgtggttactgctgggcagtgagtgctttccaggccttgtgccacccaggttgggggtgggaagtaggaagtgtcagggccactgtgagttggtagtacttccaggttctattactgtctgttcaccctgactttgccctagctaggcctcagtttccccctctgttattttctggctgcggtttggggactggacattgtagcctggagtgtggggccagcaatgttagggactctggcatcctagcttctggaccatgctgggtctgtggcagcatcctgaggcaagaactgaggacgatatcagagaaaccccaggggctcaggcaggctaagattggcaagtcccggctgtccagagaggaaagcaaaagcagggagtggtatctgggccaggtgggcttccctgaggcagtgattcttagccactttgggtcacataaccatttgaaaatgtgttagaagccttagattccttccacttgaatgtccctgggcacttacatgctgcacatatttgcaagggtcacccttaaataccttgtgctttaaaattgcttaaatacaaaaatacatgagtagtttagtatatgtcactttaaataggcggaaactggggaatagatgacatcgaactgttgagtttgagcagaaaagttagcagaacccagcacagatatttctggggttccatcctcagtttagcagagagaatcaagcaggcttaatccctcttggacaaagggctctaagtggaggcaccacttccaaacaccctttcccccctttgaggttgggattggccacgatctggaggtctggggctgatggtgaagaaggccctgtaaggccttagccatgccctcagagctcccccaaagtcgagcatgtccctgaatttagcagcctgagcttgtgtctacccaaatggataggggttgggggcagggaggaagggaaccccaagggagtctgaagctggctgtccatggtgctggcagggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcaggtaaggtggctccttcatatagtatctgggtcccacctggatcctgcagctgccctgcatgctgttgccaggggcatgagggtggtcctgtgggtgctgcagagtggaggtggggcaggctagtgtcccatacttcaagcccttcctgaccccacagctgggattggctcacccttctggaagagacacacaccaggcagcctgtaggcccatggatggggtgggccccaggggaggcagagggccagtgtgtcagctcaggtctttaccttgtctgcagggctgacagtgagtgacgtggacatcttcgagatcaatgaggcctttgcaagccaggtgagcccttgtttctcaatgttgcctttgccctggacagccgaggtggagtgagcgggcaggtggtgcaggggaggggtaagagggctataggtgatgatctgcctccttccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagaggtaaggctttgctcctggcggtggggtcatagggggatatccaagttagggcacctgaagggcaggggatagaggtaggtgggctttggatcataatctcgacagacacagtcctgagcaccataatcccaaatgttgaaatcccaaaagatcaaagtccctaaggtcttggctggtccagaggtagtgagttatcttgattgttcagttacagatcaaactccatgttctactctttacccccttcttacttctacacttgactagtcaaggagaaaaatccttactgtctaaaatcccaaaaatcacaatctcaaaagattaaaatcctgaatgttgaaatcctaatgttgaattcatgttatgaattctagggaagggattagtgcattttccgctgtatgcaggatagtgcatcatattagttataccatgtaactaatatgatgcaaccattaccttgttattgtctttatttgaattaagtatggtttaaggagatgtgaatgggtgctaagttgacaaggaatggacttaattttgggaatacctagaaacctgacaaagcattgctttgggtgtgtctgtgacggtgtttgcagaggaggttagtgtgtgcatctgagtggaccaggtggggaagatccgccctcagtgttggcaggcatcagctaattgcctggggccctggagagaacaaatacagaaggtgaactgtctctctcagagccgggacacactttttttctgccttggacatcagaaatttgattccatgaaagtgcattatcacattgactttgtaagccttgtgcatgtacataaaaatgttgaaacttcctcagtaaaagaggtgtgctatttgtgcacctgcgtttgtgaaagataaaatttctcaagatcttggttctttggttgactacttgtgcagtggtgacccatcacaggttggtttgttgagacagggtcttactcaggcgcccaggctggagtggagtggctccatcttggctcactgcaacctctgcttccctgactcaagcaatcctcccacctcagcctcctgagtagctgagactacacgtgggtgccaccacacccagctaatttttcgtattttttgtagagacagggttttgctatgttgcccaggctggtctggaactcctgggttcaagtgatcttcccaccttagcttccaaagtgctgggattacaggtgtgagccacagtgcctggctctatcagtttttgatcaatctcatcaaaagacgtaggttgtccatcatggtattcatatgactgcagttataaagctgggtgcacatgattaccagcaatttatacagtttgcttttaacctatttatgaatacagtttgtctgtttataattgttataatcctgtgactattgttagcatacctgagtgtttatgcttgcagaaatttgtaattattttctattttattgtgtaaagtagcctgtgaagtgttctgttgtttttgtttctcaaataaatccccttttaaaaatgtacatttttttttttttttgacatggaatctcactccgttgtccaggctggctggagtgcagtggtgtgatctcggctcactgcaacctctgccttttgggttcaagcaattttcctgcctcagcctcagcctcccgagtatctgggattataggtgtctgccaccacacccagctaatttttgtatttttggtggagacagggtttcaccatgttggcgaggctggtcttgaactcctgacctcgtgatcctcccgcctcggcctcccaaagtgttgggattacaggtttgagccaccacacctggcctaaaaatgtaaatatcttttaaatcaatcttttaaaaaagtttttttctaagatggggtcttgctatattgcctaggctggtcttgaactcctaggcacaagtgatcctcttgcctcagcctgctgaatagctgggactacaagtagatgccaccaggccaggcttccaaattattttttccagaattatattttcaggattttgatcttttaggattgtgattttcaggattttagactttagggattttgttcttccaggatttcaacatttgggatgattgtgtttgggattgtgtcttttgggattatgatcgatccctggggaggggaacatgcacacagaaacaccctgaacttaggatgtaggggcatgatccctgttttccttaagggccagccttgaaagggatactagcctgcagtgggcatctgtcaccgtgtgtgtgcccaagtgggaggccagggtaccgcttgcccacagatctggtctgatggttttgcatcctacttgtccatgacgtccttctgggtcagcctggtctggaggtaatttggtgggtgcctttgcccagccaattaagttttgttttcacagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatctt

SEQ ID NO: 37993 - DNA, 9013 bp, Homo sapiens; identical to SEQ ID NO: 36864

SEQ ID NO: 37994 - DNA, 430700 bp, Homo sapiens
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttctaaggaagcgaagggcggaaagggaacaatctgacaaagctgcaatggaaaatgactttcaccctgaaggaaaggggaaaaacaagcttgcgaaacttcgccaactggtaagtagaaagtgaggcggggtgggcgggattagggaggaatctgcccaagccaaccggtgactttaggacgggtgacgtcacagccaatggacagccagcgcgggattttcaattattgttccgcccaatcgggaaaagactgtgcttataaagacggctgcggcggggctaggagctcgtttttctccccgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagctgccattttgcctttcctgaggcgtgttaagcgaggagagcagcgtaggtgagctctgctggggactgccacatgtttctgctccagggtcacagcaatttctagagcatgcctctgggtctctgccgagaccctcgtaacctgcttaggcccacaatgtatgggcggtattctgacttcaaaaagtagtgactttcagaggtgggtgggtcactatctctgcacccagcttctcaggcccagtagtaactgagcagagactggaacctggggatgttggtgtcagacatctaggtcctctgactgcccccacaaggtcacactccttttactcaccagtctgggtacctctaaactccaggaggtctccctggctgaatctcaaaaggaaaatttcgtggcattttttatatccagtcaggaatagaattcattacatcttgtggtcctggcactgtgaaggcctgcactcacaggaatctgtcagtcttcgtatttgtttgcgagaccagcataagctgaattcatcaatacaagataacattctaaaatgttaagttttaacatttaatcattccctgtacttaaatcattgtctaccctcaggtgagagttaaaggataattaaggatagggtaaagaaatactcttcctctgactaggcattgtggctcacagctgttaatcccagcactttgggaggccaagtcgggcggattgcttgaagtcaaagttccagaccagcttgggaaacatagcgagaccctgtgtctctaccaaaaaaaaaaaaaaagacagaaagaaaaatgaaaaaattagccgggggtggtgccatttgcctgtggtcccagctactcgggaggctgaggtgggagaatcgcttaagtccgggaggcggaggctgctgtgagctgagattgtgccactgcactccagtgtgggtgacagggagtgagaccctgtctcgaagaaaacccacctcttcctctaataaccagcttctacgtggctaccttggttgccagtaagtccactctgaatctgtggcttttatgaagtgaaaaacgtgctttgttcacatttaattctgccttaggctagtgggggacaggtgtgtgtgtgtgtgtgtgtgtgtgtgtgtgtgtgtgtgtgtgtttagagggaaactacgtggtaagagacatggccacgtttacactgatttttcttccttagaagaggacttgtcccctgggtccactctcctggtcacccttatccttctctaggtccccatctcagtcttctcatgtctttctcttccccatcaatattcctggtttcccccatgctggccttggccatcttcttttctccctgcaactcaagtgagattgattgcctgctttcactatttctgtcccttagctaagcgctcccaaattgctatcttctgctgagaccctatcctgagctctacacattttgtgtgtgtgtgtgtgtgtgtgtgtgtgtgtgtgtgagagagagagagagagagagagggagatagagagagaaagagaaacagggtctcactcgtccaggctggagtgcagtagcacaatcaaagctcactgcaaccttggactcctgggttcaggggtcctcccacctcagccatctgagtagctgggactacgggcacacaccaccaggcccagctaattttttttattttttgtagagtcagggtctcacttcatcgcccaggctggtcttgaagtcctgggctcaagccctcctcccaccttggcctcccaaagtgctgggattatagacgtgagccactgtgcctggctacaccaatgtttctaactgcctggtagacaggtccttctggatggatactaggcacttcaaacccagcttatttccaaaaccacatgcctcatcttgctttccaagcccatttgtttctttccacattccccatcttcctggaagacaccttcattagccccatctgttctggttgggtgtcccttcctcttgtcctctgtccaaatctcatgagttccaaatattactaaatctgtcttctgactttcaattgtatcaccttttctccgtccacccatgaccatgccttaactgaagtcctcgccagctctggtctagtagattacatagtcaggctggtctttctgccctgccattgagcttccactccgtatgacagctatctttttttttttttttttttttatgagacggagtctcgctctgtcgcccaggctggagtgcagtggcacgagctcggctcactgcaaccttggcctaccgggcccatgcgattctcctgcctcagcctccggaatagctgggactataggcgcccaccaccacgtccggctaattttttgtagttttgtattttttgtattttgtgatccgcccgcctcggcctcccaaagcgttgggattacaggcgtgagccaccgcgcccggccaagagctatcttttaaaaactgagggttttttgttggttggttggttggttggtgttgctgttttgagcctgtcactttcatgcttaaaaattttccacgaccttcccattcccttcagaatgaagttcacattcttttgcatggcagttcagagcaccggaggttaattactaggaaggactctggagttagacaaacccaagtttgattcctagccttgtccatgtaaacaggtgcatgacttcaggaagcaaatctcaacaggtttaacttttcccatttgtaaaacaacgagtaacttgctcgttgttttgttggaaatcatgaaagtgacaatttctgtaaattgcggtgctcatgcctgtaatcccagcgactcaggaggctgaggcaagaggattgcttgaggccagaagttcgaggctgtggtgagctgtgactgtgccactgcacttcagcctcggcaacagcagtgagaccccatgtctaaaaaaacaaaggacctagcacagtagtagcacagtatctggtccagaacaagcacccaattaatttgtgctactctattaatagttactaatttaaaaaaaaactgaaaatattatacatctagttctttatgtttcccacagccttcccaggtttcagatgttcttgcagctgaacaagaatgtttagccccacacgacatctgcaatctccaagtacacaatatcttcacacattccatttctgtccagaatgtcctccccttctctgtaaccctgagaacccccattcttcaagattcagccctgtgagccttcccttgctcttctggttttttgttttttctttttctttcttttttttcttttcttttttctttttttttttttttttgagatggagtcttgctctgtcacccaggctggagtgcagtggcgcgatctcggctcactccaaccaccgtctcccgggttcatgcgattctcctgcctcagcctccggagtagctgggactacaggtgtgtgtcaccacgcccagctaagttttatatttttagtagagacggggtttcaccatgttggccaggatggtctcgatctcttgacctcatgatctgtctgctttggcctccgaaagtgctgggattataggcatgaaccacagtgcccggctcccttgctcttctttgccctcatctctttgggccctcctccttgcctctgccctctcctatcttaataccccttcccttccttaacctcagcattaggctggcaacatttctcagggtaaggatttgtctttgtttatttccatagtagcagcagtacccaagcaacgcctggtcacagtaagtcgagtgaaaccatctctcaaaaaaacaaaacaaaacaaaacaaaaaacgaactacattgagtgggaaaggcaataaatatatcacctttggtttctgtatcacttcatggcctcattcttctttcacacagaacttttcatttgatccttaaaataatcctgtgaaaaaggcaggaattctcagtaattggccgggcaccgtggctcatgccaaagaaaaagaggccaggcgcggtggctcacgcctgtaatcccagcattttgggaggccgaggagggtggatcacctaaagccaggagttcgagatcagcctggccaacatggcaaaacctccatctctactaaaaatacaaaaattagcccggcatggtggtgggcacctgtagtcccagctacctgggaggctgaggcaggagaatcacttgaacccgggaggcggggattgcggtgagccaagatcgtgccactgcattccagcctgtgtgacagatcgagactccatctcaaaaaaagaaagaggaaggaagggaaggaagggaaggaagaaaggaaggaaggaagggagggagggagggagggagggagggagggaaagaaagaagaaaagaaaaaaagaaaagctgttacctgcatcagtggctttcaacctttaatgtgtatcgggagggcttttttaaagcaccgattactatgtctcacccctcagtttctcattcagtaggtctggcatgggtcccaagattttatccgaggtgatcagtgctgctagatgagaggctacactttgagaaccactaattcagacaatggacgtgttttctcccccactccctttctgctttatcttcaaatttttgatctccttctttagtggatcttggtgcggatcagatatattcatcagcattgcctttaaagttaaaaacaatcagtgatattcgaaatagcaatgctggaaatcacaggtcagatttaaaagggaaaaggaaacatcttgagcattaaaacctctatttctcacctggacatcttcacaaatgttattcttgccacttcctccctgccctcgccccctttactatgtatctcagtaggacgccaatcattctgctctttattcagagtccgacacaagcccccacgtccatagccaagttttccccggtttcccagcagccagtgacttctgtagcattaggattcttatagtagttattgtctacatttctcagcagattgaatatgtactgcctcttactactggactgtttattcttaaatgtgtacagtatggatttatgtcgtctatatattatgcatttatttgtcttcttcgttgtgatggtaagctcctggagggcaagtcttgcatccactgctttgctggcaacccgactggtaagcttctggaaggcaaggcttgcatccagtgctttgctggcaacccgattgctaagtaccgtgttttaagcttagttcagtctcaagtgtttgcagccacatctgaagaccaataaagcaactgctggtttatcctttgggagctgacagaatttcttctcccaaatacatacacagtaaaatcataagcctggaatgaagaaaaaaaaaatcttacgggcaatgcaatggctgcaaaactataaggattagaaatgtgaacccacattttaatccaaattagggcaatttagaggtggtagcgtaaagaatagcttgctgtaatatacgccatgctgatacagaattggcttttggccttgtcaaaattaaattgtgctttctgtattgatggtgggcatgtttctgcaggtctctcattctaagctacaacaggccctaagaggtagaagtcacatacctgaattacctgtgaagttgctttcagatcatatcgttggttcactcttacagaaggatcactttaaaatatctctgcatttgtatccttgcaatgccacaactaaaagacagttatctcataggtccttgattaaattaggaggctttttattgaacacaagaaatgatacttttcaggcactgggcagataacttgctagaaaggcattttttaactgtgctaagattgagctgagtgcgtggctggagacaccacacaacacggacccttgctaaggcatctagtccacccgcttgttatgtagagggtgaaatgaagcccaaaacagtcaatcgtgaactctaagccgatcaggtgggaaagccggcatctctagaatgaaaacctaaggctgcttctcccactttgcctgagcaaatatagtgagattacacagcaaggcatgtgtaaattgccagtgcctatttctcagaaccagatttggtgatcgcaaagactgacgtggccctctaggtgtgcctatactgcaccagaagagcaagccgagaaagcagtgctcaaacctagagcattcaacctttcataccgataaaggctttaaaaaaaaaaaaaaaaaaaaaaaaaaagcccaggtaagtgaaaaagccgctttcggtcaacgacttaagtctttacggctgtgagcgctatgggccgcggtagctttccgttaacttcagatccgattgtcgccccactgccaaagttaccttccaacatcgttactgttgcactttacgcagtcaagtgtccaactcctcagatgagcaagtggtcggccctaaaaagggcctttgggatcgaaacgtgcaaagctggagcggcggcctagcctccgaagccgtacagggtgcgcccctggcgcttgagcgcgtacaccacatccatggctgtgacggtcttgcgcttggcgtgctcggtgtaggtgactgcgtcccgaatcacattctccaggaacaccttcagcacaccgcgggtctcctcgtaaatgaggccagagatccgcttaacgccgccacgccgagctagacgccgaatggcaggcttggtgatgccctgaatgttgtctctcaagaccttgcggtggcgcttagcgccccctttgcctaagccttttccgccctttcctctgccggacatgaccgctggagcccgatagacagcttctgtcaaggcgagcaccgtcttcccctgatatacaagagtatcggaccagattgaaaaccgaaagcgcgccggcgggaagcgttctcaattgtccccgccctctcgacatttcgtcatttcttttctgttttcctctccctcctcctccactctgctcaggtccctctcactcttttttttttttaaccgctacgccacagtccccgggagaattcagatcccaaccggggcttccggattctgtagtggctttggcctgtgtctggtctgaggacgcccggaaggcattgcactgaggctaagggaaaggtctctggagggagcctcaggaagagcaaatggaggccagagactggcaggagcgcgccagcgcaggatttaatcccgacgagcggattcagagccgtgcttatataaagcttcaggaagcgccgttccgacgatgaggtcgacacgcgagaggcgacctcaagagcggcggcgccagggatctgtgcgccaagggaggacgggagggagcaggttcgccataattcctggctccaggctctgttttgttggaccgagccactgtattttagctcacacaggagaattctggccctgggaaaattggtctcagcatgctgccaagctttctcatggacgtcagcgaatcccaacacactgtcggtcaaagccgtgctggaagaaacaaaacagttctccctcggtagaactgagaggggattggtccagggcccccgccgataccaaaatccaggttgctcaagtctctcatagaaagtggcgtagtatttgcacataactatgcacatcctcccgtgtactttaaatagtctctaaattacttcgtaacacctaatccagtgtaaatgctatgtaagtaattgttatactgtttttatttttactatcttttgttgtacttttttttaaaaaagaaattcatttgtttaatattttcggtcttggggaacccgcgtatatggagggcctgctacatagagaagactgagggatattctgtgcatccgtttctacggatcctctaaatcggcctttgttttcagccaggatttagtgcccagctgtgtcctttggaggccccacatggagctagcaaagtttgctaaatcgggttttgcaagaggactgtctgctccatactgggagtagttaccgcaaactgccctatgaaattggttggggttcttactgttagcatgtttattactttatcagggctctctgtaggagagtctatgagaaaatcttctggtttctgctgaaagaatcgtgttttgttggggtttttttcccgaaaaatattatttttaaaaactcttctgtgccctgtttaatctctcccttggatccaccttctgtgtgctcataaatcgtaaatctgtattcagacttctggactcgagacacgtagatccacctggtggttcttcagtcattttaagcccaaaactcaaaatctcccgaaatcaaaatgtttaaacttataatctccagggtgtgactcacgggggatgaggggagcaattctctccctccccgcataaagctggttctcctgtctgctcattgaacggttccactgcgcatcacagcatctacatgcctaaaccaacaccccagcattggcaacagatatcttcctctcccttggctgcttcaggacagggaagaaacatgcttgcccttttctgactctttagtaactctggccgaatctatcacattattttacatctctttacatcttactactcccccatcttggctgtgtgttccctactggcagtgatttttgtttattcatttttgtaaactgacacttagttcagtgtccaatataagctcaacaatagtttataaaaggaaaagttcctgcctttgattgcttttaaacactattagaaaagacataaccaaattgcaacatgataaaacaaccgcaaaacaaggctgagagaagtggtgatttctggtgtcagagggcacaggaccctgggcagaatcagagatacggtgtctgtgcagttccctttttaaggggatcaggacatgctacctccaaatgtgccagtttcgacttaagaattattttcagctgaaacaaacagctaaaatcccttacctgtttaatagcagatcctcctcgcaaatctcaaatttttaactcagttgtcataaatcttcttcagcactagaagcaaatctaacctcggagatgagaagtggtcaccacacccaaatagacattgtcacaagactcgaatcttccatctattctaagggcccatttatcttttcaaaagtcatttggttttccatatgtcctttactcctcctccttttcccctgctgctaggtagatcccaaattctaaccactcctttgagttactcatcacagagtgctcccatgtatacactttttttttttttgtttgactcagggtcttactctgtcacccaggctggagtgcagtggtgcaatctcagtttaaacccccaagtctgtggtattttgttatagtccccctagaaattaatacaggattcatggtctgccaaagtctcattccctgctcagaccgacaatggatagtgggatcctttgtgatatgtgctctgtgagttagaagtagtaacttagagctgttgaggacaatacctttgcaccccatccactgaattttgttttcaaagatacagtctgaaactcccagagggtgagtgcctttccagtgtgtcagagccattagtggctgagcagaccgctgagcatgtagatttctaggtcagggccctctccccaaagaatcatactccctggttgaactgaacctaaatcaggtttaaaactagacagatgccaaccaacttaaaattccaaagatatccaagacctgcccatggccctgggatttgaggacaacgtgtgcatgtcatggctatggcagttcaggggtctctagcttagtgggaatgtctatgtcctaccttgacccttctgagtcttccgcccgcatctgcccctcctatgacaatggagtattcattccccagatacagcaccgtgaaagagaggcaggaacactggatagtctaagacctggtctttcttggctggtgtgagacagtggaggcctcactacttggtcttttctggtgtactgtcaaaggttgaagctggggccttgtgactgcctcctgttctctgttccagggatgctacacaatagaagctctgggccttgaccatggaaaggtcccatgaattctccactcagcccaactgagccccctgctctcacactgggtgaggaaacgataggcagtgcgaacaggtgtatgcacactcactgaggaagtgcagcctgtctgacccactctctctcacccagcctagggtcaggccatggcaggacactgtttccttaactatcagcagccatcttggggatttccccacagggccagggcaacagaatctgcttctcactgtgaccatggtctggaaggaccatgaggaattctccagtgctgtcggggtttccgatactgacacagacaatttagtaacagctttgacaccttttggtaataggacaaagttaacactcctgccactatcctgtgaaggccaaccttcctaggccccataggaaacttttggaatgtctttgttgggttgagaaactggggcaaagtagtacccaattttttcatgtcaatatcaaaatgtaatcatttcaggtacacagagttccgcactttcagattagtcttaaagaaaagaaaatcgccgggaacggtggctcgtgcctgaaatcccggcactttgggaggccgaggcggacggatcacctgaggtcaggagttccagaccagcctgaccaacatggtgaaaccccatctctactaaaaatacaaaaaaaaaaaaaaaaaaattagccgggcttggtggcgggcgcctgtaatcccacctacccaggaggctaagctgacaggagaatcgcttgaacccgggaggtggaggttgcagtgagctgacatcgcaccattgcactccagcctgggcgacaaaagcgatactccatctcaaaaaaaaagaaaatcaagtaaagagcaattcacattctcttgaaaattctcattatgtccagctggttccggggaaagcctaccatgaaagtggtattgttacttagacttagggtcctttgatcagaattgatgatgtcctcagctaagtcagtgctaggagtgggcagagatgaagtgatggatgtgacagagttgtagaatatagatttaataagatttggtgttttagggcggggcgtgatggctcatgcctgtaatctcagcactttgtgaggccaaggtgggccgatcacatgaagtcaggagttcgagaccagcctggccaacacagtgaaacctcctctctgctaaaaatacaaaaattgaccgggcgtggtggctgacacctgtaatcccagcactttgggaagccaacgcgggtagatcacgaggtcaggagatcgagaccatcctggctaacacggtgaaaccccgtctctactacatatacaaaaaattagccggacgtggtggcgggtgcctgtagtcccagctactcaggaggctgaggcaggagaatggcgtgaacccgggaggcggtgcttgcagtgagctgagatcgcaccactgcactccagcctaggcaacagagcaagactccgtatcaaaaaaaaaaaaaaaaaaaagaaagaagaaagaaagaaagaaagaaagaaagaaagaaagaaagaaagaaaaaattggtgatttaggcatttggagaatgcatgcaataaaggagcttctggcctgaggagctatggggttgatgttaggtttcagtaacatggagaatgcagagagaagaaattgcttttatttttgtttttgtttttttgagagagtctctctcggttgcccaggctggagtgcagtggcgagatctctgctcactgcaacctccgcctctcgggttcaagcgattctcctgcctcagcctcccaagtagctgggatcataggcgcctgccaccacacccagctaattttttgtatttttagtagagacggggtttcaccgtgttggctgggctggtctcgaactcctgacttcaagttattcacccacctcggcctcccaaagtgctgggattacaggcatcagccaccacgcccagccagaaattgcttttgaaagcaaaaagatgcataaagtccctcccaacattaaaaattgagattcctgttctctacctaggagaacacatccaccagttgttattactctgatcagtaaagggtctcagctggagaaacttgtgagtaagccctcagcaaatcgataaggaaaacgagaggcagggaatttgatgagatcttcccaggggttagggagaaaagaagaggactgagacaggcaccctgggcaagcaggaacattgatgggagttggtagattaggagaataccaagagacagaggatagctggaaagggatgaggaccaccagaagagagtatgtcccaaggaggcaaaggaggtgtcaacagggtcatattgggcactgaagttcagaaataatgattataacttaacattccttaagctcagtgactgctgactatgcttgatattttgtcttacacatcaccacaacaatcctgcaaggaaggcagatgttttatcattctcactttacagactgggaagctttgagtattttgcccaagttccccaaactattaagtgtcagggccagggactttgtccaaagtgctaggtcttccaaagttcatgtgcttgggcagaaaacagccaccgagaagcttgtactggaaactcagagaggaaatgacaggaggcattgtgacacacagggttgagggcctcactgcttctcctgacttctctaccttttcagacagcattcttctcaggttctaacaagcttaccctctcctacctgttttagcagttcctcccagattcatttatccttccagttccccgtgaaattctgagtgccgtcagaatgggcattttgccttgttcatctcttcaagtcagcatcctggagcatagcagatgatcaggaaatgcctgattgccctaattccactggcctctgaattctcactcaaaacggcataatacccaggcccctcctaggtttcaaagaattctcgggaatttgcaggccagaagcaagtatagcctggactctggaaggaacttcctccaggttggcccgagaagagggagaggtagctgccctgagctgtaccccttgcctacaagttgctacagtccaccatcaggatagttgtgtagccttagctgaaggcagagttcccctcagtgctcgaagataaatactttagaaaggagtgcacatttgtggtagactgaataatagccccacagagatatccacatcccaatccttggaatctgtgaatatgttaccttatatggcaaagggactttgcaaatgtgaacaaattaaggaccttgagataaagaacttatcctggattattgagatgagcccttaatataatcacatgaatccttagagagacgagagggtcaatcagggagaagggggtgtgatgacagaagcagacattagagtgatctgtccaggtgctaaaaaatgccagtttctagaagctggaagagtcaaaaagtggattatatacctggagcctccagaacaaaccagtccttcagacatttgttttagccccttaaaacttatgtttgggcttctgacctccagaatggtaagagaataaatctgtgtggtttttttcgttttgtttggtttcatgtttttttttttttttttttgagacggagtttcgctcttgttgcccagtctggagtgcaatggcgtgatgtcggctcactgcatcctctgcctcccaggttcaagcaattctcccgccttagcttcctgagtagctgggattacaggcacgcgtcaccacacccgactaatttttgtgtttttagtagagacgggttttcaccatgttggtcaggctggtctcgaactcctgacctcaggtgatccacccgccttggcctcccaaagtgctgggattacaggcgtgagccaccacacccggcaaatttgtgttgttttaaaccactaagtttatggtaacttattaatgcaacactaggaaatgaatacaccgttcttacaaaagtcactaggctctttatatttgatgggggcgggggggcggggggagatctgagtgtcatcaggagcagagtataaggtatacttggagggaaagaggaaaggaagtgggcagcagaggtaaaaaggagatcaggaatggaaagtcgggggccccacagtgaacctttccttacggctgactaggctccttcatgggcctgaccagcctccttcacctgctcagcccagaatttgtagagagatctgtcgtctttgcaagtggactgagctctcctagacaattgctggcctcccccagccatggacctctgtagagctccctggggtcatccagggcaggagggtgacaggctggcttcaccgtggtcatatagcagaagtggcaagctcttcttgctcttgaggaaagctcacacctagattgttgcaaggatgttgtacaggttgagcatccctaatctgaagatccgaaaccctaggctccaaaatctgaacaattttgagcactaatgtggtgcctcggtggaaaattccacacctgacctcacacaacgggtcatacaatgcacagtatttcccccaaggaaataaaaggccctcccagcccctttccgctgagatatatcttttctgcacatgcccggtttccccaacgtgcacacacccacaaagggtcataaaatggcatgtgtgcaggccagtgtcgtcaacagcacgttccccataatgccccatgtaggagccaagacctacgtgccttactcactgtggggtttttttgcttattctctgctctgtggtataaagatattgttgaaaatatcaaaaaggcctgcagataccccatgagtaacagtaattttaaaagagaaaaagcaaggccaggcgcggcggctcatgcctgtaatcccggcaatttgggaggccgaggcggctggatcacttgaggtcaggagtttgagaccagcctaaccaacatggtgaaaccccgtctctactaaaaatacaaaaattagccggcgtggtggcacatgcctgtagtcccagctactcgggaggctgaggcagaagactcacttgaatccaggaggttgcagtgacccgagattgtgccattgcactccagcctgggcgacagagcaagactctgtctcaaaaaaaaaaaaaaaaagggagagaaaacatttatgtttatctatagtacagaaagtcaagttgttggagaaaatggggcacagtgtaagtgtgtataaggtatttatgaaacatagatggattttgtgtttagtcttgggtcccatccccaatatatctcattatatatatgcaaatattccaaaatctgaaacccgaaacagtcccagtcccaagcatttcagataagggatactcaacctgtgttagtttcctagggctgccatagcaaatgaccacaaacttggtagcttaaaacaacagaactgtattcttccacagttctggagaccagaagtctgaaataaagtaccatgctccctctaaaggctctcagggagaatccttccttgcttctttcagcttctggtggcttctgatgttccttggcttgtggcagcctcattccaatctctccctccatcttcacatggcttcttactcatctctgtgtgtccgaatttccctctcctttctcttataaagataccagtcattgaatttaaggcccatcctatatccagcatgatttcatctcaagatccttaactacttacgtcttcaaagccccagtttccaaatgcgttcacattttgagatgctggatagacacgaactttagggaacatattcaacccactacaggtcctgagcactaagccttgtgggaggacactctggaagcaggtccagacttccccggtcttgcctcttcagaacctgcgcactctccacctccaaaaggcccttctatcagtcacttacacctgagtataaaactaagcatgatagctgtgcaattttgaccaaccctcccatgttcatgagtgtaggtgttggggaacaggctgtgtctccacttggggaactcacagcttcaggggcaggacaggaagatggtggtggtccttggccagatgcttcctataataatgaaaagcctgaatggttggacagctggcagactgtggcctgcatttacttgcctggaaaagctggaaggaaagaagacatgaggctaaaatagaggctcagtgtcttagtttcaatatctgtaaaacagtaacaataaatacacatacctcataggattcgtgcagggataaattgctatacagtccatacaaagtacttagagcagagtctcaacatgacaataaattaatagttattagcaatttcattatttttatgataaacgttacttgatatatatcctagatctttcccttggaaatattaccgtcatgctgggaaataagacaagcacatggaaaataatgggtaaattatctagtctctagatgctaattatgtagagattcttctagactatgtggccaaggcagcagaaataattgggttcctaggagcttcataactcacaaaaacctttcactaacagcctctcgtttgagtccacaacaaccctggaaagaagaaaaggctttttccctatgttaaagataaggaagtttctggtaaagattagacaccggggaacgtgagttactcggctaaaacatggccaaggtggaatttgagcctaggttttgtgttttgcttttctttttttgtattagatttgatgctttaggagaaagtgatacatggaatagatacaaataatatcaatatgtgtacagtacagcccactctcctgacctcaagtctacagtaagaaatacatttacattggccgggcgctggggctcacgcctataatcccagcattttgggaggccgaggcgggcggatcacgaggtcaggagatcgagaccatcctggttaacacggtgaaaacccgtctctactaaaaatacaaaaaaaaaaaaaaaattaaaaaaaagtagccaggcatgggtggcgggcgcctgtagtcccagctactcgggaggctgaggcaggagaatggcgtgaacccgggaggcggagcttgcagtgagccaagatctgccactgcactccagcctgggcgacagagtgagactccgtctcaacaacaagaaaaaagaaatacatttacattgcctcccagtcacattcacaggaaaataaaaattgcaacaagtttcacaaaatgataattactattggtgatattttcccgttttatgattcttacaaaagggcaaaatgaaaggaaaagatgatctctaccaagtaaattaattgcactatggattacaacttatagttgtggttttttgggaggtttttttgtttttgtttttctggatttttttttttttttttttttttttttgagatggagtctcgctctatcgcccaggctggagtgcagtggcgcaatctcagctcactgcaagctctgccttctgggttcaagggattctcctgcctcagcctcctgagtatctgggactacaggcatgcggcaccacccctggccaatttttgtattttttggtagagacagggtttcatcatattggccaagctggtcttgaactcctgacctcaggtaatccacccgcctcagcctcccaaagtgctgggattacaggtgtgagtgaccgcgcccggcctacaacttacagtttttaaaactggctagagaaaactacaaagaagaaagttaaaatcatctcactgatttaaagaaagttaaaatcatctcactgattttaaaagtcttcatgtttcttctgaatctttctgtgtatgcacatacaacctgtctgtctttgtgaggaggtgacccccatatccagagccagagtggaaggtatcctgtgacagatggtgacttgaaatgtaggttgaggcctggcgcggtcgctcacgcctgtaatcccagcacttcgggaggccgaggggggcggatcccctgaggtcaggagtttgagaccagtctggccaacatggtgaaaccccgtctctactaaaaatacaaaaagtagtcgggcatggtggcaggcacctgtaatcccagctactcaggaggctgaggcaggagaatcacttgaacccgggaggcggagtttgcagtgagccaagatcgtgccattgcactccagcctcggggacaagagcaagacttcgtctcaaaaaaataattaattaataaataaataaataaataaataaataaataaataaaaatacatgcaggttgagctttgtgggagccaagagggaaaggccaaggccagctgagcaaataaaggaacccttccaggaggaggtgatatctgagcttggttctaaagaatatttaggattcgggacatgtttagattgggggtttggagaagatgatgtaatccaggcaagaggggacagcaaaaacaaagacagaagaattgttcctggaccacatgcagcatgggcaaaggtcagtcatgagaagtaagctttagcaatgggggccagtttaggggaccccaaatgccaaagtagggagggagtgctctataaacaatgttggagcaaaggatatgaacaggcaatacacaggagaagaaatccgaaaactatcaagctcaggtagagatgcttgaactcatgaatacccagaacaatgaaaacgaaagcaatgctgagataccactttacaccaggcagtctggcaaaacttagaaagttggatgacccgaggactgggcctggatgtgggctcagagtccagctaccttggtattggaagtccgggacaagcattctggaggggagcctgacactccttagttcaattagatgtaaataaaactctgaacagaactgctggtttctggcttctcagcacttctgttcctgagtttttatccaaaagaaattcttatataggtccaaaagggaatatatacaacaatgttcattgcagcatttctggtggtgatggagaattggcacaagcctagttgtccattgctgggaaagtggggagataaaatgcggtgttggagcaacatgaagtttaatgcagattgacctcatctctacaaaaaaataaaatattagccaggcacagtggcatgcgcctgtggtcccaattgcttgggaggctgaagtgggaggatcacttgagcctgggagattgaggctgcagtgagctatgatcatgccactgcactccagcctaggggacagaatgagacccagtctctaaaaaaaaagaacatggatggcaaagagatgcaggttgagttctataagggttgaaaataaaaggtaatttttttgggaaatcaatatgaagtttatttaggtttcttgtttttcctgttttccctgtgagccagatgactgccaattatcccaaaatttatattatcaaaaatggatacctgcttcctagcatttggaaaaataaaataatatgcccctgacatgaattaatgaattacccctctaattacaaagtacagaattctctcttttttttttttttttttttttattttgagacagagtctcgctctgtctcccaggctggagtgcagtgggatgatctcggctcactgcaacctccgcctccctggttcaagggattctcctgcctcagcctcctgggtagctgggattacaggcacgtgccaccacgcccggctaatttttgtagttttagtagagacggggtttcaccatgttagtcaagctggtctcgaactcctgacctcgtgatctgcgcgcctcggccttccaaagtgctgggattacaagcgtgagccacgatgcccggcctggtttttttttttttttttttttttttgtcgttgttgttgttttgtatgtttgtttgttttcaacttttattttaggttcaggggtacatggaagagttcaatttttaaaatatagattaggccaggcgcggtgtctcatgcctgtaatcccagcacttgggaagaccgaggccggcagattacgaggtcaggagatcaagaccagcctggccaacatggtgaaacctcgtctctactaaaaatacaaaaattagccaggcgtagtggcgcgcgcctatagtcccagctactcaggaggctgaggcaggagaatgaggcaggagaatcgcttgaacccgggagacagaggttgcagtgagctgagatcgcaccactgcactccaccctggggacagagcgagagtccgtctcaaaaaaataaaaaataaataaaataaaatatagattaaggggggggaataataaataaagtaagatataaaacacattaccactaacatgcacttcgagaagcagaaattcgctaggactgagaaaatcaaaacctgttctgccattcattaggctgcactaacagagataaagctagactagaaatgacagaaaacattcttctcccaagggcatgctacagctataaaggctcataactcccctctttgagtgaccactcctttcttattcactgaggaacttgtactcaaaattacagactatcagaactttggctgcttgaaatcctatcaatcagtaacaatgcagtatccccctcctgtctggaggacctaagccaccttgacacaaaaaaccagcagtaattttcaacccaggtgcaaaaacttcaagtaaggggtttctgaacacagcattccacctctatctcaactttgtagtttctgaggaaacaagaccctggatccactgcaaagtcccatcctatgcctaccctttcacacagccctgctttgctttgagcctatgaaaactacactccactcgtcccccaaaatcaatgataactctaattttcctcttgtttggtgagcaccctcctcccaccaccctgccaccagtttctctgttgtgtgttctccctcattgtaacaagtcaacagacttggcttaggtagactaagtagtggtcttgggctaattgggataggttgagtttttacttagaattaacataactcatttcagcattcctacgttgtcggaggtggttttgttttgttttgtttttaagacagggtctctgttgcccaggctggagtgcagtggtgtgatcataactcactgcagactgcagcctcaatctcccaggctcaagcgatcctcccacctcagcctcccaagtagctcagactacaggcgcacaccaccacgcccaggctagtttttatattttttgtagagacagggttttgccatgttgtcaggctggtctccaactcccaacaaacttgcccgcctcgggctcccagatgctggaattacaagcatgggccactacaccccggctcttggttgtttctaatcttttaaattactatcaatgttgcatcaacatcttacttatttgatattagtagtgtagtatagtgactaaaggaagactctggagttgaaatctggtttggcaccgactgtgtgactatgagaaagtttcttaaccgctctgtgattcctccatctcccaatctgtaaatggacatacttacactacctacttgacagggttttgtgaggataaaatgagttaatacatgtaaagtgtttaaaacattcttggcaccaagaaaaagtatgtaagtgttagaaaaaaatatgcatatataggcggggcgtggtggctcacgcctgtaatcctagcactttgtgaggcctaggcgggtggattgcctgagctcaggagttcgagaccagcctgggcaacacagtgaaaccttgtctctactaaaatccaaaaaattagccgggcatggcagtgtgcacctgtaatcccagatattcaggaggctgagacaggagaatcgcttgagcccaggaggcttcggttgcagtgagccaaggtagcgccattgcactgcagcctaggcgacagagcaaggttcaaaaaaaaaaaaaaagaaaagaaagaaaaaatatacatatatgtggtgttataatgtatattggtttctgtccacagttcctggctcataacttccatagcccttgtatggtctttttacagagtacagtacactccaatgttgggtatgttaggccccagaggcaggtctcaggaaacagaatctctctttctcctgccctcctttcacctgccccaaggcagaactctaatatttgcccacttttttaattgagggtcttaagaccctccccggagaggttcccgccctataccctgggggaaggaatgctgacatcatgaagcttccataaaaacccaagaggaggccaggcgcggtggctcatgcctgtaatcccagcactttgggaggtgggcggatcacgagatcaggatttcgagaccagcctggccaacatggtgaaatcccacctcaactaaaaatacaaaaattagctggccattgtgactggtgcctgtaatcccaactactcaggaggctgaggcaggagaattgtttgaacccgggaggtggaggttgcagtgagccgagatcataccatttcactccagcctgggcaacaagagcaaaactccgtctcaaaaaaaaattaataaataaataaaaataaaaaatactaaagaataatttttaaatgcatagaaatatactttttcacaataacacataaaagcaaaaagagtaattgtctcagactaaggaatgcacataaaatgggataatactaaataaggaaaagggagatatctccaaataagtttgcattaaaaacaaaattttaaggaggaaatgtcaggggacacagtgcagccatggttctaagtaacgtgatatgagctgtgtatacagtcggttaatttgggatggagggtgcaaaaccaatcagaagggagccatacccaaagcaggaggccaagtcttggggacaaagatgagaggaccaaggatgagaacaagggaaccagacacaggaatggacaggaggggaactgttgactttattgcacatagaagattgcctgaacctggataggggaaagagcagaaagggagttgttggggcaaaatgtaatccaagatgactctgcaccttcctgcctgaatgactaggagaatgatgccaccttcacaggaatagacagcctgcaaggaggagctgctgaacagagttcacttcaggccacactggatcataacggtcaactggcaatggcaagtggccacgtacttcagacaactgggagtgtgtatctggaggcacatctagagacccagttggcttctctcatctgcccagaggagctggagaaagccctgggagtccctgggaagagcttatgaagaggtggccccggccggacacagtggctcactcctgtaatcccagcacattgggagggccaagcgggcaggtcacttaagcccaggagtttgagaccatggagaaaccccatctctaccaaaaatacaaaaattagctgggcatggtggtgcacacctgtagccccagatacttgggaagctatggcacaaggatcgcttgaacccgggaggcagaggttgccatgagccaagatcacgccactgcactccagcctgggtgacagagtgagaccctgtctccaaaaaaaaagagagatgatcccaaagatgggcctctaaagaacatctactccacttagggatctgatggggacaggaggtgagagaataattttatactaaaatcagggaaaacataatatggggaaattggaccagatgatttctgggttccttccagcactaatattctatggttctattaaacagacatggaaaatatgttgctagatcctcagattatttgctatttgcaaattttagacaaatgttttagtaaaattcaggagcaccatggtgtatcagggaatgccaagttatttaaactgcataaatatccatttctttctttgtaaaatgggggtaatatttacttttttggggttgttttgatacaacatgatgtactagaaggaaaattccaagttctttgacatgtctgaacctcagtatcctccacgataaaaaccataacatttacctttcaggatttgttctgaggatttgaaatggtatgtctatagtattttgcacactgtgggctttcagtaactgggaatttttactttttactcttttattttaaaattaatttaagtcacagaaaagtatctgacttcagacacacagttcctctatattcctgtagtaggcaaaattctgcgatggctcccgtgagtcctggcccctggtacccgttgtttaaatcccctccctttgagtatgggcagaacctgtacttgctgttaatcaagaaaactttgcagatgtagttaagatccttcatcagttgactttgagttaataaaaagggaatccctgacttaggtaagcctttttttttttttttttttttgagacagagtcttactctgttgcccaggctggagtacagtggtgcaatccagggtcactgcaacctatacctcctgggttcaagtgattctcctgcctcaacctcctgagtagctaggattacaggcacctgccaccatgcccgggtaatttttatatttttagtagagctggggtttcaccatgttggccaggctggtctcgaacctcaggtgatctgcctgccacgatctcccaaagtgctgggattacaggcatgagccactgcactcggcctagtgagctttttaaaagagggtcaatgccttccctgaattagataaagtggaagcaacagagatgctcttctgctggccattagaagcaaatatccatgctgtgacatgcctgtggagaagggcagcctctgagggcctcaattctacacctgcaagaaactgaattctgccaacaacgtggatgagtttggaagaccccaggcttcatatgaaaatgcagcccagttgacactttgattttacccttgtgagattctaatcaaatactcccactatgccatgcccagacctacagaaactatgagaggctaaaggagtattgtcctaagccacttaatttggggtaattttttacacataaatagaaaactaaaacagttttttgcctccttcattcagaacatggtttttgtttatcttctctctccctgctgtctctatacttgtctaagacctcattactggttgcagcagcctccccactggtttctggtttcctgtattctctttcttctatgcatcctgcacatttcttcagaataaagatacaaaggtcataataacctgcccaaaatattgctcttgacttgctcaagaacctataccaactctcccaggccagttccatcaactctgatttttagctagtttcacagttctcgatgacccaggcctccttaaagagcctgactggctctcttagtccgtctgatgaccaaacctgtgaccgaggacacattagtgaagttaactagtcaggaaaatcactccagagactgcctcctgcaaagcaagtgttcataatcttgagggatttttaaaaaataggttaggaatagtggagactcaatcccaaacctatatgttacctcatccaccctagggacttctggagtttttgttgttgctgttgctgctactgttattaagttgattgctatttgcattgatgaagtttttttaaccattttttagaattaactacaatgtattgagagcctactcagtgccaggcagtagaacaggtatttttaaatacattattttcaacaaaaaaaaatcttataggcttttttttaatggccaataatcccactgttcacataacctctgctgacattgtttttaagtgaacattgatcataaatttaaacagtactgaaagatataaaggaaaaagcaaaatcttttggcccaaggaaattcttctccttaagagtagccactattggccgggtgcgttggctcacgcctgtaatcccagcactttgggaggccaaggcaggtggatcacgaggtcaggagttcaagatcagcctggccaacatggtgaaaccccgtctctgctaaaaactacaaaaattagcggggcatggtggcacgagcctatggttccggttacttgggaggctgaggcagaagaatcacttgaacccgggaggtggaggttgcagtgagccacgatcgtgtcactgcactccagcctgggcaacagggcaagactccatctcaaaaaaaaaaaaaaaaagagtagccactattggtcaggcacagtggctcatgcctgtaatcccagcactttgggaggccgagacaggtggattacctgaggtcaggagtttgagaccagcctagccaacatggtgaaaccctgtctctactaaaaatacaaaaaattggccaggcgtggaggcacgcaccagtaatcccagttacacgggaagctgaggcaggagaatcacttgaacctgggaggtggaggttgcagtgagccaagatcgtgccatggcactccagcctgggcaacaagaatgagactccatctcaaaaaaaaaaaaaaaaaaaaaagggtagccactattattagttttgttatgtgaaatccccggaaagtgttttatttcatatcggtgcatacatatcaatacacacatatccttttttatttccaccaaaagggaccctaacattttattgccacatactagtagatatacaagtagtttccagatatttactattaaaaataataatttttcccagcgatttgaaaagaagtgagaggatcacttgaggccaggagttcaagaccagccttggtaccataacatctctacaaaaaacttaaaaattaactcaacgtggtgatgcctacctgtagttctagctactgggaaggctcaggtgggaggatcagttgagcctaggagtttgaggttccagtgagctatgatctggccactgtactccagcctaggtgacagaacaagaccctatctctaaaaaaaataataatattcctctttactgaagtattccagctaatatatgaaagaagagtgacagaatatcattattttgcaattgataatgaattaattgatctaagcattgagaatcaatcactgctgttaccacaaaaaaagaagcagctagacattacatgtctcctgatagaaaagaaatagtaccacctatgaagtagtcatgtcatggggtgaaaaactaaacctaaatctaatcaagcctctaagtaccaatttacagaaaatagagcacagaggctcatgataaactacatcctgaagacaactctctaaagagcacatattcggttcccctgatccacccatcattctactggaagcagagttgtaaagaaaggcaaactataatgagaaggccacctgcagcacacagaggcaggtgaccatggtagttggtgtcaatctggttggcctgacaaagccatttccactttaagggaagccctgttgcagggaacaaacacacacttttgagggtcagggtccatctgctccagaaagtgcttgatgggcataaaccatgtggtctctgagactttaactcttctgtttttagtgccacacagctcctttctgttcccatagtcaggtcagcctaggagctcattggtttctttaaaggcagtttatacattctggcctaatcctgcaagatctggctctgtctacctgtgtaacctcttgatgctgcactgtcctccttgccctctaaccaccacctgtactagacttcctgcagttcttcctatctacctgaccatgatcttttccactctttccaggcctttgcccatgccatccactgcctggtacacccttcctatccttgtcaagtgtcatcctaaaggttctttcctcagggaggccttccctacacccaccaatgtgaagttacgactccctccattatactctctatatctatacttctacagtcgtaatacttgtcacactttctcatagtcactggattaatatgtcttctcttctagtcactagaggtccaggaaggcagaagccacgcctgttcaattttctgtcctcactacctagcagattgcctgccatcttcacagataataaactcttgaatgaaagaacaaatgatatcacacctaacaatgcttaggagtcagagagaagaaaattggtcccagaatgccgttcttatagaatttaataatgtgcatagatacttaatatttataaaattagtagatacagattttcaatcacacatattaaatgaattattaaacctagtcccctcggttacagggacagtctctcacttaagggtcaatttctgaaacccaaacagagctgccctttaggcctactccagaattattgataagccatattacagagctatgacagtgtccttttggtccttcatttttttttcctttttttttttttttttttgagatagagtcttcctctgttgcccaggctggagtgcagtggcggcagcctccacctcccgggttctagggattctcctgcctcagcctcccgagtagctgggactacaagtgcccaccaccatgccaagctaatttttgtagttttagtagaggtggggtttcaccatgttgggcagactggtctcgaactcctgacttcaaatgatccacccaccttggcctctcaaagtgctgggattacaggtgtgagccactgcgtgtggccaacagaacctatcttaaaaagtggctgtaggctgggcgcagtggctcacgcctgtaatcccagcactttaggaggcgggtggatcacgaggtcaggagatcaagaccatcctgctaagtaagtgtaaggtaaactcttagcttactgctaagtaagtttaaggtaaacagttaagtgcttagtaaggggaagcaatcattattttaacaattattgttattaaccccaacataagcaaatgtttaaagatgtctgagcaggagaaacgatcaaagaggttcttgaggattaatctcaccaattacttcccctccagagttaaaatatcaaaatctatcacctcttcccccccttcctcactctataacatccttcccagtgaacatcatccccaggtggagcccaaaaccagcaactaaggctctctcatgttagtgaaaggattccagctggtgagccccaccactgtggggacaaactcaattgagttgagctatggcctctgggatgaaggatcacagccacctaatcccaccctcaatgtactcagccaccaccacccaggatttatatccagggtgcactctgaagagaataaagccagtggtatttcttttcaattctaaagcatagatatttccccctaaaacacaggaagggtccaggttttcagaatgaccctgtttctcaagtcccttaactgctaacctaggagcttattctctggagagtttctgaagaaaggcttctctttgcctcagtttccttatctgtaaaatgggtgataataacggtactacttcctgaggtcccagtgagaattagatgagtcaatacatataaagggcctaggacactacctggcacgtagtaagtgctccgtaggtgttagcttaactttattatgaactttatttcttccatcttatttgtactgctgtctatttgtgatcatatatttttcaattactaagcattaacagtggccttgtaacagactatttcagccccagtgcacctttggggcagcagtttggctggtggcttataaatagtcatcccccagatcagaggcacccacgcttttctacagacacagtggaagttgtatctgttaatttcattcattgagaaaatacactgtagataaaagaatccagcaaagcctttaaattaattggtaactttattaataacaatagcatctatacacatttgaaaacacacatgtaggagacagttaagatctattcagtctgtgataatgtctagagctcatttggattcatcaaacccctgccatcagctccaaaagcccttagccaaaaacagctgaatcactcatcaaaccatcagtgtcttcctcggcagaatcaagggttggacagaaagagtaaatattctgcacctccacaaaataaaactaaaatgcaattgtcctgcatctgagaatacaagggtggacagtatgagctgcatgactgtgaaccaatgaggcttctcttggcctcatttgtaaaaaggagattaactctgtagtcccgcctatattgcatggcctccagaaaagcaaatgaggtggtaagtgtaaattaaaagctcctctcctttaagaggggaacaccatgaggggagagtaagaaaaggagaaggaaaaggctctttccagtgaccaacacgctgaatttgatgaaaatccataagaggttatgctaaactgagaagcataagggtggatctaccattgccacctcctctttgtagcaaaaaaaatcttaacacggccccctcccagctgttgcactgaggtgactaaggatacattttgaggaagtagctccaagaacatttccattttcactgtgccttcacatacatctaatggaaatgaacagcacccttcatccatccacggaagcgattaagaaaagggtgggatggaaaaattaacccaacaatattagatcaatacgtagtatttaagtgtccataatgtgccaggctgaagatgcacgggaaaaccacactagccggtctgtcaagggcttgagaataccataaacaagaaaacagacgaaccaatttcagacagctgctagaaggaagataaaatgagacaggcaagtatgagaggcgcgaattcctgagtggatgacgtaggtctctgagaggtgacttttgagcccgtatctacatggtaagtgcctcgcagtgacctggggccgtagcgttaccatttaaagcacagaccattaaatgcagaaattatcaacaaaatgagaaataggaatttcaaagtctcaaagtgaacgacggaaactgaaatctacaaattagaaaaaggcgcagaattttgaatattcttgtcgcccaatcaggacaaggctgggacccggctgcgcggccttcgtccaaaatacacagaacggctggtatccacaggaggccccatcgcacggcagaactggtgaccggacacaaaagctgctgccaagcgtcagtcatacagagctgtcacgcagtgtttgcggaacccgggctgaattgtgtcctggagttctcttaaatgacagccgaactcagccacttcgttttagaatgaaacagacccaaggagccaccagggcgcgtgtggggcgggagtgggggcgggtaaagaggcggattcccaacagcctaattgagaaccgactcctgggaaggctaagcagcacaatgagtaaagacacgctctagattcaaaagcaaatccaatgacgcactggggacctcgagttccaaatagttaaaaagctacgtatgccatttcccatgaccttcacactaaaataacttactttatgaaaagaaactaagggaataagtgaacaagctcttttctagtgattaggtgggtggctctgaaaagagcctttggagtcaagcagccggcgactcgagcgagcgagcgccaggtcccggcagggactcacttggagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggaagcctctcccgcgatgcgctcgaagatgtcgttgacgaaggagttcatgatgcccatggccttggacgagatgccggtgtcggggtggacctgcttcagcaccttgtacacgtagatggagtagctctctttgcggctgcgcttgcgcttcttgccgtctttcttctgggctttggtgacggctttcttggagccctttttaggggccggagcggattttgccggttcaggcatggtaagacacagtacaaacgcggcttagccaagaaaagaagtaagagaatgggcgggcctgattcttttataaccaccttatgcaaattagggctccgaaagtcgttcatttccattggtccgtgtgcggaccttgcgttttcagcaatgcgtacgtaacaacaccgactcttgacttgattggccggttctgaagccatattaggaccaatgaaaaactcgttcttgaccccacccctaggaaagcttataaaggctttcctcttggttctctttcaatcttattttgttgcgaggttctgagcgttgtctgtgtttaaccttgatttcagtcatgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggccggcgcgcccgtctacatggcggcggtcctcgagtacctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgttttgcctaacatccaggccgttctgttaccaaagaaaaccgaaagccacaaagccaaaagcaaataaatgcagacaaacaaaccaagaccaaaggctctttttagagccacccaagttttcaaaaaaagagctaatgcgctatttcgtgatcagcccttcatttgacactttggtggctcttaaaagagcctttggggtgaatgagtatggtgtcaagcctcttaattacttgttcttgccaggcttgtgactctccgttttcttgggcaacaggacagcctggatattgggcaagacgccgccctgggcaatggtgacacccccgagtaacttgttgagctcttcgtcattcctcacggctagttgcagatggcgagggatgatgcgcgtcttcttgttgtcccgagccgcgttgcccgccagctccagaatttccgcggtcaggtactcgaggaccgccgccaggtacaccggggcgcctgccccgacccgctccgcgtagttgcctttgcgcagcaagcggtgcactcgccccaccgggaactggagaccagcgcgggacgagcgcgacttggccttagcgcgggccttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttgtaagtatctaccaatcgctgagagccacattaaagccccttatttgcatgccaggatctttaaagagagcaggctttcaaacaaaatactggttttgttttactgagaggcactgtgggtttttgttttgttttgctttgctttgtttagtttacagccgggaaatcccaatatggaccctaaggaactgcagaagacatccttagacggagagttactctcacgaaagagtaggggattctgaagccgatgatccccttgagctctaaactgccaagtcccgccctttctgtctcgtcacagccaaattccctttaaaaatacatgtactactaaggctgcctcctttctcgcccctaaacttaagtcgcccgcagcggcgtgtctccgccccacccccacccgcctgcactcctcggaatccggtttgaccgaggctagaatagatttgtcatcctcctcttgacctccaggaggcggccttcaaacttgctcccttggctttcaaaatgtcgccctgtttttcttcttacctcgccgacttttcttatcctgctcccccatgccactgcccatctctaaatctgcgagtccagctggactgtttccctgtctccaattcttcacttatcccgaagagtcttacccatttatatgctttcaactaacgtccaaatttgtttcagaagctcagacccttatgcctaactgcttacagaatacttcaacctacttatcccaacgagcacctcaaactcaaactctacctcagcctatccgaacgcgaactcatacaaacaacctcccctctttgccctcttttcctgaaatgcaccagcatacttacagatacctaagccgaaatctactctactcttcccttcgtcttagcatatccagtcagttgcttccttaacatcccttcagactttttctccatgctcccttgtccacctcatcatcatcccttagatttcagcaacagccgggaaagggtaattttgccgtcaggcactaatcgctggcatgactccagcggtcttagaaatctttcctgaaagctctcctttttttcttttatcccatataacagatgaacctgaaagctcttgtgtttcttcctcctcaacgtcccatctctgggagttctacatctcctacaccattctcaccctttccttagtatcccttaaggtcaggtagaatgctagagagaaaaaatagacttgtgggttttttgttcgttttttgaggcggaatttcctctgtcacccaggctggagcactatctcagctcactgcaacctccaccaccgcctcctccaccccgcccccacccacccgggttcaagcgatcctcccacctcagcctcccgagtagctgggatgacaggcgcccaccaccccgcctggctaatttttgtatttttagtagagatggggtttcatctctactaatgttgaccagggtgatctcgaactcctgacctcaaatctcgaatgttggccaaggtggtctcgaattcctgacctcaaatgatctgcccacctcgacctcccaaagtgctgggattacaggcgtgagccactgcacccggccagaaaatacttaaatcattctttgacacttttcctgatgttttctcctttattctcaccagtttattcaactggcatttattggatgtgtgctattgggccatgggtgtatagataattgaaagtagtacaaacaagtctgtgatgaaatgcctccagaaaatggaggaaatctggtgaactctgagagttaaattagttaaaatcagctacgtatagagattactcctgataagaatgctggtatagatttgggaaacaccaaagttcagacagaggtgatgagggtgtaacctaagatccttctaatccaattgattatatcatttgagaagatgaatgttaacagaaaggtgcggtccacatagagtccaaacaggtggcaattatagtaggaatatgttatgttttcaccaacactaaaatatatctggcagatgtaaagtttggcctagaaaagggtccttggttatgaaagcatcaaccctttctcacagcctgggtgaaatatttctgaagactatccaagttctttcattcagattctgtgctcaattaacaactttctgattattctattccaagataaaaacataagactgaagtggggggagccagttatagaaagatgttcatcatataattcaatgaatttgcattttggactattcataaattttgtgtgtactttgttagcgtgggcccctccccaagaagccagtcagtcctggaagttctcatagtgtcaacttttcagacctaaagggctgagaacaaaacccagatgataggggaccccaccacaatcctggcaccccataaggccctgcttgaggggcaagatgaccttcctttctttcgctgaccttatttttttttttttttttttcccagacagagtctcactctgtcagccaggctggagtgcagtggcagaatctcagctcactgcaacctctgcttctcgggttcaagtgattctcatgcctcagccgaccaaatagctgggattacaggcatgcgccaccacatccagctaatttttgtattttcagtagaaacagggttttgccatgttgtccaggctggtctcaaactcccaaagtgctgggattacaggtgtgagccactgcgcctggacttgacctctgatttcttttttacttctatcacggtgctctgtgccataagaagggtgaaagaaaaagagattatgttgaaaccctgctatgataaaccctgcagtagtgactgcctacaaagtagataaaattatgtgtttcacaaataaactgaagcttacagggattaaaacaattgctgggccgggtgtggtggctcacacctgtaatcccagcactttgggaggccgaggcggatagcttgaacccaggagtttgagaccagcctggcaacatggcgaaaccccatctctacaaaaaatacaaaaattaactgaatgtggtggggcacacacctgtgacctgtggtctcagctacttgggaggctgaggttggaggattacttgagcccagaaggcagaggttgcagtgagccaaaatagcgccactgcactccagcctgggtgacagagcaagactctatctcaaaaaaaaaaattgctgaaggtcacacagccacatgattagagcctaggtctgcctgactcaaataacatgctcctcaccatgtcattcacactctcactaactagatgttgggcttaaagaagtcatttaatttatccagccattgtttcttcctctgtacaaaaaaaaggaagaaagaattattagatgagatcttctctactcccacacaaatatccttgctgtggccacatctctttgttcatatcctggtgacagcactcaccattctgtgctgtgtgtgtgtgtgtgtgtgtgtgtgtgtgtgtgtgtgtgatggagtttcgctctgtcgcccaggctggagtgcaacggcacgatctctgcccactgcaacctctgcctcccaggttcaagagattctcctgcctcagcctcccaagtagctgggattacagtaatgtgccaccacacctggctaatttttttatttttagtagaaatggggtttcaccatgttggccaggctggtcttgaactcctgacttcaggtgatccacccacctcagcctcccaaagtggtggaattataggcgtcagccaccatacctggcctgtactgtgctttaatctcctttctgtaaccatttccagagaaagatcatgtcttcctcttatttgaatcaagagttcttgattccttccacctggcccttaatagtttccttaaatgtttttggcatgaatacatgaaacaaactcttagaaaattagcattttcttttctaaaatatttagtcaacaaccactctccaaatgacaaccataaatagtagatgatggtaaacagaatgatggaagatagaagctcatcagttaaataaaaataatacaggccaggcacagtggctcacacctgtaatcccagcactttgggaggccaaggcaggtggatcacgaggtcaggggttcgagagcagcctgaccaacatggtgaaaccccatctctactaaaaatacaaaattagctgggcatggtggtgggcacctgtaatcccagctactcaggaggctgaagcaggaaaattgcttgaacccgggaggcagaggttgcagtgagccgagatcgtgccactgcactccagcctgggtgacaaagcgagactccgtctcaaaaaataataataataataataataataatatagcctaccataatacggttgctggaataaaggagaataaatgtaaataacctagtagagagcttgggaacctgagaggccccacagctagattaggaggatatgatggttcattttatgagtcaacttgcctagcccaatagctagtaaaacattttctgggttttgtttttgttttttgttttttgttttttttgagacggagtttcactcttgttgcccaggctggagtgcaatgacgtgatctcggctcacagcaacctccacctcccgggttcaagcgattctcctgcctcagcctcccaagtagctgagattacaggcgtgagccaccatgcctggctaattttgtatttttagtagagatggggtttctccatgttggtcaggctggtctcaaactcccgacctcaggtgatccgcccgcctcagcctcccaaaatgatggaattacaggcatgagccaccacgcctggcccatttttctgggtatttctgaaagagattagcatctgaggccgggcacggtggctcacacctgtaatcccagcactttgggaggccaaggcaggcggatcacctgaggtcgggagttcgagcccagcctggccaacatggtgaaaccccatctctactaaaaatacaaaaaattagcccagcgtggtggcatgcacctgtgtagtcccagctactcaggaggctgaggcaggagaatcgcttgaacccaggaggtggaggttgcagtgagccatgatcggaccactgcactccagcctgggcaacagagcgagactctgtctcaaaaacaaacaaacaaaaagtaatctatggtgataaaggttagaataatgagactaatgattaactgtggcagggtaatactgacttccctggaagtcttctgaggtgctgggaattttctttatcttgatataggcatattcatatgtaaaattcagctctacatttaagatttataggggtttttttgtttgtttgtttttgagacagtctccctctgtcacccaggctggagtgcagtggcgtgatcccagctcactgcaactctgcctctcgggttcaagccaattctcatgcctcagcctcccaaatagttgggattacaggtgcctgccaccacgcccagctaatttttgtatttttagtagagagggggtttcaccatgttggccaggctggtctcgaactcctgatctcaagtgatccaccttccttggcctcccaaagtgctgggattacaagcgtgagtcaccacgcccggcctagatttataaatctcttacatgtacatcatacctcagtaagcacaatttttaaatataaacaaaattgaaggagtcatcatggggaaaacaatgagtactttgttgggcatcccaatcctcatgttacaaatgagtgtttattattgtttggttgttttgtttaattgtgtatgaggtggctaacataatctctcggtgcttaaagcctctaaaagccttaatctgaccacgacagaccttcattaaatagtagatattattatgactatatttttattagaaacaaagacaataagcttgccctgtggagctcgcaacttgcaaagctttcgtttatttttacgacagcaataatagtgaagttgccgtctccattcatacatcaattcactcatccatccaatatatcttattgaacacctaagtatgtcaacactgagcttggcatcacacatctagaatatagtgaatataccattcattgtgcctggatctctctttccacgtggttagttccctctagtcattcaaatttctgtttcaatgttaccttcacacctaggctttccctgacctcagcctcctacctctgcctaacactgtcactggatttgcaaactgcaaggtcctaaccaaagcaggtcctatagatgccatctttgtagcagctttctaatcaatgtacttctctctagcccatctcgtgccttcactcaggttatctttcacccagactaccaacaaagacttttctactcctctccctgcttctactcttcccactcctcaccagagtggcctttctaatagacattctgattcttttctcactgtacactctctccccaggtgatcacataccacaccccagccccacccccatgatctcatttcatcttcaacaacccctaactaagagatgtctcaaatatacttctcacatgctaaaattagtgggaaaaaacttaatgagaattaggaaagtagatacacttagagtatcttccacaattacagacagaaaaggaattttatagtggaaaagcctgacagataccatcttaatcaagtgatcagaactatcactagtaataacaaaaagatcacgtgccctggtaaggttcacagagaagaattcaacattacttctgcagtattccagccaaaaatgcatgtgctaaattttaatcataaagaaacatcagacaaacccagattgagggacattctacaaaataaatgtctgtaacttcaaaattaccaaagtcatgaaagacaaagaaaatctaggaaactatttcaagttaatggagaacaaagaaatataacaactgaatgcaacacgtcatcctagattggatcctggaccagaagatatttcttttcattttatatatatgatagtagtggaacaattggcaaattttgaataaggtctgtagattagataatagtaccgtatctgtgttcatttctagagtctgacagttatattccggctatgtgagaaaatttttttttttaagtaaatatacatcagtcaggattctccagggaaacagaacgaatggtagatattttgatagatagttttattataaaaaattggctttttgattatggaagctaataaatcccaagatccccaagatcttcagggtaagttggcaagctggagacccaggagaactgatgatatagttccagtccaagttcaaaggcctgagaaccaatggtgtagttccagtccaaaggccgagtctaagacccagatggagccagtgtttacttctgagtctgaaggctgagaaaagccaatgtccgggtctcaaagcagtcaggcagaaggaagtctctcttactccggagtgggtcagtcttttgttctagtcaagctttcaactggttggatgggacccacctatattagggagggcaatttactcagtctccaattcaaatgttaatctcattcaaaatactctcacagaagcacccatatttggccaaatatctgagcaccaatcctctagaagttgggacattaaccatcacaggccgtgcgtggtggctcacgcctctaatcccagcactttgggaggctgaggtgggtggatcacctgaggtcaggagtttgagaccagcctggccaacatggtgaaacccccctctccactaaaaatacaaaaattagccaggcgccattgtccacgcctgtaatcccagctactcaggaggcggaggcacaagaatcacttgaacccaggagacagaggttgcagtaagccaagattgcatcactgcactccagcctgggcgacagagtgagactccatctcaaaaaaaaaaaaaagttaaccatcacaggtagagtttaataggctttatctctgaaacttagtctcaaacagtccagaaaataattatatatttgtagataggtacatacaaataaaacaaacagtgaattgttaatatttgggtaatctaggtatcaggataaaggatatacaggaattatttgaactgttttttttaactttagatgcacaaaccttgtaattatccttgacactttccctcccacaaccaagccattaccacaccctgtaggttttactttcctaatatacatcctgtagccacaatttctctccatttccaccaccaccaccaccaccttggtccaaatcatcatcatctctcacctagactgctacagtaacctcccaacttgtctccctgtttccactcttgcctcctctacaatccattctccaccctgaagccagtgatctttgcagaatacaaacttaaagtcagctaaatgcaatgcatgatccttgattggtttctgaaaattaaacatttataatgtttacttagactgtgctgctattacaaaataccactgactgggtaatttataaacagaaatgtattttctcacagttctggaggctgggaagtccaagattacggcactggcaggtttggtatctagtgaaggccagttcctcatagatacgccatcgaggtgaccttacatggcagaagggacagaaggggccaacttaccccctcaagctctttcaaaaggcgttagtccattcttgagggtggagccctcatagccttattacctcctaaaggccccaccacttaataccaacaccatggattaattttcaacatgaattctggaggagacatattcaaactatagtagacaccaatgagacagttggggaaatctgaatatcaactgtatgtgattatagtattgtatgaatgttaaatgtcttggatgtggtaatggtattgtggatatgtatgaaaatgtccttgttcttaggagatacacattgaaagtacatagcaattaagtgtaaagaattttgtggggccaggcgcagtggctcacgcctataatcccagcattttgggaggccgaggcggactgatgacctgagtcaagaccagcctgaccaacatggagaaaccccgtctccactaaaaacacaaaattagccagagtggtggcgcacgcctgtaatcccagctacatgggaggctgaggcaagcaaatcgcttgaacccaggaggcggaggttgctgtgagccaagatcgcaccattgcactccagcctaggcaacaagagcgaaactccatctcaaaaaaaaaaaaaagaattttgtggctgggtgcagtggctcacgcctgtaatcccatcactttgggaggctgaggcaggcagatcacttgaggtcaggagttccagagcaggaggatcacttgaggtcaggagttccagaccagcctggccaacatggtgaaaccccatctctactagaaatgcaaaaaaatttagccaggtatggtggcaccagcctgtagtcccagctactcaggaggctgaggcaggagaatcacttgaacccagaaggtggaggttgcagtgggccaagatggcgccactgcactccagtctgggcaacagagtgagactctgtttaaaaaaaaaaaaaaaaagaattttgggccaggcgcagtggctcacgcctgtaatccctgtaatcctgggtggccgaggagggtggatcacctgaggttgggagttccagaccagcctgatcaacatggagaaaccccgtctctactaaaaatacaaaattagccgggcatgttggcacatgcctgtaatcccagctaatcaggaggctgaggcaggagacttgcttgaacccaggaggcagaggttgcagtgagccaagatcacgccattgcactccagcctgggcaagaagagcaaaactccatctcaaaaaaaaataaataaataagatttctgcacctaactcaagtgattcagcagaaataattattattatttcattattattatacacacatacattaaaagagatacaaagccaagtctggcaaaatcttatcagtgaacctaggtgaagagtggataaatgggttgctcattgtattaatcttgcaaattttctggaagttttaattttttttaaaggctagggaaaacagtgtatgtcatagtttaaatttcttgagtgtgataaggttattgtggttatgtatgagaatatctttgttcttaggagatacatattggagtagttaggggtgaaatgtcatgctatctgcaacttactttcaaatggttcatccaaaaaagcatataaatatattttaaagtatatgtaaagtacttaaatatatgagtatatatgtacaagtataaaataaatataaatgcaaaaaatggtgggtcaagtgaaaggtagagggtgttgctttgaactattcaacttttctgtggctttgacatttttcaaaatgagaagttggggaaaaacatttagaaatatgtaaatatattaaggatacaaaataaaatttaaataattttacaagttaagaatcatcctggaaaaattacatcctgttacatccctgcttaaaacctcagtagcttcccactacttctaggataaagacaaaattgcctaacaagggctacaaggcctggggtggtctggcccgttcctctcctcctggtaccctactcatcaccatcagctgccccctaggctccaaccacacataaccacaccctaactacaccagaaggaaagactccctcaaaattctctctcctcctgtcctttacacatgcagctaccaaagccaaaacctcactatgagggactgagaaatggattctcatgttgtttctgctgaactgtttccctaaatctcggaaatattctctgcccgcctcccattccacctctccaaccccggccaagtctgggtaacttgcctccttagcatcctgtgtttatctcatcgtagcacctagtacccagtattgcaattgtccgctcacttgttagtcttcagtgctctgttgtctccttgaaaacagggcctgacttgactccccagtccccagcactagtctggggcacagtaattatgtattcaatcagacttccattttcttgcatataaaataaaggagttgggctggatgatctacaagatctattggcagtaaaatagatctaataatcccaatcccaactgcgcgtgaattccctttttctttgcattgctgggttcagactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcaggtagaaggggcgtctccggggcttcacagggaacacaggggcttcggcccaaccacaagtacgcagttgcacatgccctacttttgcccattctttgcaaatcccctaaggaacgaacgcgcctcgcgtgcgggcctttctaatcttcgcttgtcccttcacttccacagctggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaggctgtgttcttaatggactgctgaatcagtgccacaggtgttcttgggagaagaaagatacttgtagactagtcgggaagggctttatgagggaagtgatctagttggatctttaaaggaaagcacaaaattaaccagaaaggagaggataggtgctgcaggcagggagaagaacctgagcaaagacatagacgctggactgagaagtgagttaatggacaagacaggggatataggcagggacacatttgaatttcatcttgagggggggaatgtttggcttttttacagcctgttcatttccaaaaagtagtatttgtatttgtttaaaagaaaaatgtttttaaaaaccactaaagcagtgaaaagaggataagaactaagaaaatgattacagatgatgaagaaacctttatatagccttttttttcttttcttttcttttcttttttttttttgagatggagtttcgctcttgttgcccaggctgcagtgcaatggcacgatctcggctcactgccatctccgcctcctgggttcaagcgattcttctgcctcagcctccccagtagctgggattacaggcatgcaccaccacacccagctatttttttgtatttttagtagagatggggtttcaccatgttgaccaggatggtctcaaactcctgacctcaggtgatcctcctgcctcagcctcccaaaatgctgggattacaggcgtgagccactacccgtagcgtttttgtttttgtttttgtttttgagatggagtctcactttgttgcccaagctggagtgcagtgtcgcgatctcagctcactgcagcctccctccgcctcccaggttcaagcaattctcctgcctcagcctcccaagtagctgggactagaggcttgtgccaccacacccagctaattttttgtattttatagagacagggtttcaccatgttgcccaggctggtcttagactcctgagctcaggcactccgcccacctcagcctcccaaggtgctaggattataggcgtaagccaccatgccccgcaatgtagccctttttgagcattacagatattgtcatatttctgaggggagctcgagtaatgtctatagaagcaactttccaataatctcaatgtggaaattattagagaaaaaaacttggttaacatatatcttttttttttttttttttttttttttgtgagacggagttttgctcttgttgaccagactggagtgcaatggcccaatctcagctcactacaaccttcgcctcccaggttcaagcgattctcctgtctcagcctcccgagtagctgggattacaggtgcctgccaccatgcccggctaatttttgtatttttagtggagacgaggtttcatcatattggtcaggctggtctcaaactcctgacctcaagcaatctgcctgcatcgacctcccaaattgctgggattacatgcgtgagccaccacgcccggcccggttaacatatatcttgaccatttctagctaaagaatttaaggtgcatgtggttgggcagtagggagtcattgacaaattttgagtacagacatgccagagagcatctgggggcagatggatctggcagtgatgtgtaagtgagttggcatgggagactggaggaacagagatcaatccagagtgagggtagaaccctgacttacaagtcatctgtgggaatggaaaggaaggagtttatttgagagctaccataaaatcagaaaatggtttgattggaacagaaatggactagagtgagaggggagtcaatggtaaccccaaggcagtggttttcagattttctcaggtaagaactcccatgagattgtttaaaatgaagcttctggctgggtgtggtggctcacacctgtaatcccagcagtttgggaggccgtggcgggcggatcgcctgaggtcaggagttcgagaccagcttgggcagcatggtgaaaccccatctctactaaaaatacaaaaattagttgggtgtggtggcaggcacctgtaatcccagcctcttaggaagctgaggcaggagaatcgcttgaacccgggaggcggaggttgcagtgagccaagatcacgccactgcactccagcctgggcaacaaagcgagactctgtctcaaaaaaaaaaaaaaacgtagattcaaggtccctatccttccaaaccaagaaaaaaaaaaagggttctgattcaacaagtcaagagtggagtctggggtctatatttttaaaaagcataccagaagatttagaggaaagttggttctattcttatgaaacattactcccaaagttttcaaatctgggagacttagagggccctccatctgtaggggaaagatcaaggtagagaggccaatttaggaagtaaatctggtacaccatgttattctgaccttcagtccatctcaccattttaccctccaaggctgttaggagaattggatgtaggtggagagtcacagaagcaggtatagccattttgtattttgaggatttgtttccgttttatttttcgtcaatatttttcactgcatttttcacatcaacagagttgggtttagggttccccaggagagcaagggagatggatgggtccctcccaggggtgcgaggaagagggctacgtccagcatgtggggagtgagggacaagggcacagggcacacactcatacactgggcactggagaaggcagtcttttgagcacagacaccaaagagttaaacagtcaccacctggtacagtgttacaaaatggggagagtgaccacagggttggggcactggacgcagcatgacgaaggtgaattttgattttcttttttgttattttcacttttttccttttaacatttttttaaacattttacaaacatctaaaaactacaacacgtcacagctacagtggggtgaggggagggcaccaaagaaagcagccacacagagtagggtgggatggggcagcctaacctacagaggctattgtgtggaagggtaaaatggggaaactgaggcttctagtccctgcattaggggtccctcactcactgcccaacctctccccactcagaggagctgccaggagggcccctgcttcctgcctctgccccagctctttgtgctttttgatctgctggtttgaccagatgcctggtttctttccctcccctgctcccctccctgtgaggggacaggtagggagcatgggagggcagctgtgctattcccgcctgtgctgtagtgggtggagcctctcactccagaggaggcctctgcttcttgaggagggaaggagatgggccttgtcggatgccctcagatctccctagactgtgggactcttatcccaggctggcctagggctcctccatcccaggctcaacacagaaaccagattaggggaggaactgtgggaggcagggttgtgtgtgcatccgctgaaattacccttggcttatatttgaggacagtatagtgataccccccgccccatggcacatgcacacacatatgtaagtatacatacacattcacacacagtcctgcggagctgcctcagaacttaatctattaataaataagaatcagaaagctaatttcataaaattcaggcttcatatttgcagcccaaattgagaggaaagtggaggccagagggctgaggtttattgcttctcccccagcatccaacaggagatgtgagagggcacccgaggcccactcttcagactctaagaagttcttttggtccatggtctacaccagagccccagcccctagcataattgcatacctgtggtttcaccagggcctaggcagagggaatgatggggaaggcaggaagcctattctggaacccctggaacagggaagcaagggcccctctctaacagggggagaaggatggggctcagccttctcttgtgcaaagtcaagggcagtgggaaatggggagtacagcttcatctcaaaactgggatgaaggagccttccctgtagtccctgcccacggggtttacacacatgcacacgcacacgcacacacagctaagacaccaaacacggggagtggggagtgagggctctggaggtcaggatggcagggcagggaggggaaggaaggagttgttggtctcacagtgtgcctgccaatcccaaagccctagagaccccttcactgcagcacctgcccccgggtctcaggcagcttcagggccagagagctgccaagggcaagggcagctgaggcaaagaggatgggtgcagccttggtgattcccacgaaggatgtgaagatgctgatccccagcacagctgccagcttacacagggcattcaggaagccaaaagctgtggtcctgctcaggagtcccccagtgcagcacggcgcaaggtacaggagggaggcaaaggaagagtggagggcagggaagtgaagtccaggaagatgcaggcagtgtccaagagggagagagaaggttggagagatcagagaggtaaaggatgtacaccaggaatgtaaataaattgagagacaaagggaaaggagaccaaaaattgaggttaacagttaagactttgaggagtagatacaaaagctaccagatttttttttcctttttttttttttttgagacggagtcttgctctgttgcccaggctggagtgcagtggtgcgatctcggctcactgaaagctccacctcccgggttcaagcaattctcctgccttagcctcctgagtagctgcgattacaggcacccagctaactttttgtatttttagtacagacagggtttcaccatgttggccaggctggtctcaaactcctgacctcaggtgatctgcctgcctcggcctcccaaagcactgggattacaggcatgagtcaccgtgcccggccaaagctaccagattttagaggagaaaatggaaatgtatatcctctcacccctaaggatgctcttcccattcagccctccttcctcaccccacccctcccctgaatccactgccctgcctccaacacattccaactacctcttgtctgaggggtagagttcaacagtcaacacgtccagcgcattccaggatgcaatgctgaccccgccaaaaaggcagagcagagcgatcatggccgactcactgttcccaaaagacaggaagaagcaggagacacaggacatcacgctggagccagctggagccaggagaggagagagcaacatgagcctggccacagtgaaacccacccacagcccaccctgtcccatcagctggctttcagatagcccaggatgagacttgttccgaaggtatccaaccaaggtatccaaaaggaaggcttttcactcctcctcaacctcccttataattgtttattaataatatcagtaaccatcatttattcaatgccagccatgggccaaggcaattgatgctttacatgcattgatctagcacatcaaccctatgacacaggtactattatcacctccattttgcagaggaaacaaccaggctcatagaggtaatttgccagaggccagaggcaggtggtggagctgagattcaaaacccataacctcaaagcctgtgccctaaccacttgcaattctgcttacctcctttacccccagagaagcttctgtgccagtccccaccccatcctgcagcaccccctaaacagaaaacatgagagaggaactctctgaccaatctcttccacagcccaaggtgagaagcctgttgactgcctcccgcagcccctggcccctactatcagatctgactcagcctctcccccttaccaagcattctgagcctgccgatcttgtccatgagcagggcagacacgatattcccaggaagcactgccagtgtccccaggaagctcacaaagtataccatgtaggcaccttcgcccgtccctgtcacgtctagcgggcagccctccttgttgtgcaggaatgtactgtttatcagacggctgttcacaaacttgtactcgaacaggtctgtgggcaaaggccaagataagcaggcagtcatagcagatgggagagggaggctgttacggcttatggctcagggctctgcatgtatgaaagttagtaggaggggctctcaaaattattcacagtgctaatcacaaaacatcaaataacatcaccatgggaactagggatctttagagcagaaaatgaccatcatctgtccaacagtgtgactttgtccaagttctcccattaatagtcttagctgcttattcattctttctgtccgtgctagctgactataagcagtagcgatgccgtggacttaggaaatttttctgagaaaaacatttaaaataataaaaagtcctatccattgttgttttcctgcaacatggaaaaagctcgcccagtatgaggtgggaaatttcagtctagctcacaaaaccagcatttcgtgtgcatatactgaagtttgagaatcactattaaaaaggagtggattcatgcaatgatccgcaccaaataccccttttattgattgtttttctttttcccaagaatgctattttggatgatttttaccttcttcaaaagtgcattaattttacctcactgagttataatttcagccaaaggcaaataaacttgatgtttttgtcagatattctattacaggaaaatgtccaacatccattagattttcagaattattggtggtagctatcaggcccctctgccaccttcccacaggggtccagggatctcagcttgagaaccctaagatagtgaatgaaaaaggttccttctcatcaaggtccacccaaccctttggtctgacacccaccagccaccccgccttaccagtgttatagaacacagtgttgatgaatgtgcagttgcggaaaaacgtgttgctggatgtgacatcctcaaaataacactcttcaaacagggaatcctcaaaggacactgacttgagccgcagcccaatgaacctgtaaggccaggatggtgaaagacactcccccgtcatcctcatgccccctccaagactcactctttagcgaagtaatgggaagctgggcattgagaagaaaccacaagtgtttgccccccaaatgtcttgtcttgaacccctagactcataaaagagacgaggtagaaggaacagggaagaagtgaagtttaaaagtccccacatacttgtcattgaagtactgcccgcctcggtggatctgattctccaacgtgaagttaaaagttacatgctctacgcgctccccggggaacactttggtgcgggatgcgtagtccactgcctggagatggcggatcatgtcaggaaaccagacggtcaggccatagtagctgaagagtcaaggacaatggaaacagacaacagggcttcagacaaggctcagagattagaatcaggcagaggagaaaacggaaatgtgtatcatctcagaacaagggagaaatggagtcaacctctgttaggaccttgctcctctccagcctcaccagcttctccctgctcctcccttcaacagttgctgcgctcctgggggacttcagggtctcgcacagcagccactatactttttcttacctcccaagcatttgcttttccctctgccaaaaacactcttctccaccccagccacccccactccacctgtctgactcccattcacctttgaggacttaggtccccaccccagcccaagccccaagtgctcccactgcccttcccccacccttctctcatcaccctgcttcatagcaagtttcgtctcacttcttttttttcttttgagacggagtctcgctctgtcacccaggctggagtgcagtggcgcgatctcgactcactgcaacctctgcctcccggattcacaccattctcctgcctcagcctccagagtagctgggactacaggcgcccaccaccatgcccggctaattttttgtatgttagtagagacggggtttcaccgtagccaggatggtctcgatctcctaacctcatgatccgcccgcctcgtcctcccaaagtgctgggattacgagcctcatcgtcctgcttcttaaccaaaacataaactccaggaggaccttggaccacatctgtttcatcccagcacagaatagaaactgaatcctggtcagcctacagtacaagtttgttgagtgaactagcgaagtagaggagctggctgcaggatcagagggggtctgcatggcaccttccctcatcgcttgtcccctgcatctccattctccccacctctctcccagcccacacaccaccacaaccaccacacatcacccagcccacccatctcctcacctgaatgacatggtgaaccacacacccatcatcatcagagtgatgcgccgatattcgggaccaaaacaggagagaaaattcccccaaacctacaggggaccagacaaagtcagaccttgactatactaagttctagcacccatagatccccacttttctgccctcccacctcccttcagctcacccatcacccacacacatagacttcagtcctgccttcttctccacttcccccactcccttctatctaccaccccgtccaccattacctgcccccctaggctcaaggcccggaccccccagcgctggtaccaggtccctgtgtccgactggatctcaatcaattcatcctcctgatgaatcgtcttaatgtgggttacctggggtcaagagaaggggtgggcagtcacacactctgtgtttcccaacatcggccaggcgcctcagtttcccctgcattagcaaaatgggaggcaggaggtggatatgataccctgaaaatctccttacggtagagtgtggtctgaggtggggggtactcagagaggggccaggtaggggctggggctgcagggcgtggaggtctgagtcgggagggctgtggcttactgagaacactcgctcaggatgtcctttggctcgcatgttggtatcatggacctgcttcagcaccatccaggcctcatcatgctttccattctagagccaaagacacaatccccacatccaagtcagcccctacctgacccagagttatagaccccctccctcccacctggcttctgtagtcacaggacactaaatggttcccagccctcaaccccaccaccaagccctgacctatgggcatgcactcaccactctgaaagagccccaagctgaggtatagcaagacaatcagacttgggcaagagctgcgggttgggggtggggagtgttgtccaggggaaaaaggcaagcacaggtcttgggaattccatagtacagaggaatgtaaaaaccaaaggtaagggaaatgatgggcaagcatgtagtcaaagacctaatcctgctggggttaggaggggaaggtatagggggtgggaatgtctcttgagctgtaaatgcaggacagggccaaggcccttccctgcaaaatcttaagtcatccatgggtgaagaggtcccctggtttctccacccaagaacccctcagggacacattccaaggcaaagaatgcaagataaagtcccctggagagtggactctgtgaggaaggcaggcagtcaaacaggatcaaatcaaactccagttggtgtttgaacacagaagcccctgctgccgtccacactccacagcccgcaccccaccccaccccatgcagctcagccccatcacctctaggaagaaacgggggctctcaggctgcgtggtcagagccccaatggcaaacacagaaggaaaggcgcagacgaggacgaagaccctccagctgtggaactggtaggcagaacccatctgaaaactccaccctggtagggagaaagtgacagcatcagcagagaggccagaggctgggggaacccaccacagggagcacagaagaagagggaggagggagataacctggggtggatttccgggggctgctcaccatagtgggggatgatggcccaggccatagcagctgcgtacacgccaccaatcatccaaaacatgcagagccagctcaaatgctcccctcgtttctcctgggccagaaactcggagaaataggagaagacaatggggatggaccctccaatcctgaagtgcatttcaagaattcagcattagcaaatggccatagtcctgatcccctgccccactgctctggaccccgagccccttttgtcttccaggcttttgaagagactccatctcacacataaagccttacaagctcccatgtgggccagccatcaagcacccatccttgggaccatgggaaacaggcaagcgagtctcagggaaagggaaagagcaaatcttaaatcttgaaaatgaattacagagttggaagggcgggaaagtaattgcagaaaagagaataaatctccagagaaaaaagacaagccaaaagcctccaagggcagatgttgtgggaatggccagaaaggagcttggagttgaagcagagtaagcgggcctgccatgcttgcaaaagtgaaggggcagtgcggacaaggcgtcagggttctggcaggtgtgggtgttagcaaggtttgttgtgtaatgcaggaaatgtgtagactctggtagggggtaactctgggtccacaggagcccaggggtggggctgaggcccactaggcctctttgtggaggcaggctcaaaaatggaactagaggtggggtggaggactcaggagtgggccaaggaacagcattctggacagcagcagacaggtcctgggcagggaggagctggcctgaagatggctgggggagaaaggaactcattcatccgttcaactcacacagatttaaggtgcatttggtgtgcctggcactgtgctgggccctaaagatacaacagtgaccaaggcacagtcctgccctcaagggacttaggaagtgtacactcacccaaccccagaaagtaggcggcagaagaggaaagtgccgtaaccctggacaaaagatgagaagaaggcgaagacgctgttgactgagagcgagatgagcagacactgcctccgacccagccggtcagccagacctccccagaggaaggctcccaccatcatgcccaggtagacgatgaggcctggaaggaggaggaaaacaggcagagggggtgtgagcagacacaccttaattctcccaggagatgagcactgagggagctgaaggatctgaaaaacttctagaaggtaagtctacccagagattagagcaagtgagagaaaatgaatggtgtaagcaaagatagaagatcatctctgcaggccaggggttcaaaggcaggaatgaagatatgggagaacctgcaaactctccactctcttcggtctgtctcatttctcactctgacacacacacagtgacacctttacccctggctcactttgaaggaggaatgggtgtgcctaggatcacagaccaccccagggtcctctctattctccctgctttgatccctcaaagcagcaggagagctctcatttgttcctggggaaaggggctccaattcatttcatcttcccaggaaatctcccacacaaaatccatcctttactccttccagtctcaatatttctggtccaaaaactctcctgtttttcactgccttcataaaaccaaagctggaattaatctttaaaatcatctactccaaactttgcattttcccatgcccaaaccaagccccaggaagaagagacctgtccaagaccccatggcaatttggtggcagagtaaggcctcgattctttctctgtgagtctacggggttcctcctcagagtccctgtcaggaaaggccatcaaagactacatcctgtcccctggaaactcccatctgagtgagagaaagtctaaccagcttctctggcagaagatccaggaccctccccccctcccccaaccaccccaaactgactctccccatttataccaaggagtttggatactggcttcttgttccccaatcagtgaaagggaacaggataaccagagggaaagctatgaagaaacattaaatggtagggaccatcctaccacagccacctcctgcagaatgaagcagaccaccacccaaccactggcccaagccccagtccagctgccctcccgcaagcccctctgtcacattcaacttcaccctgacccaaggccaagaagagggagtgtgtgagggaagagtgtgcagaggaaccctgagccctctgggaacatcttgggtgcagggtcctagggaacccagtggtaaggacaagagcaatttccaggagcaaggaggtttccagagtttgaggggataaggctggagccccccatgtcttacctagcatgcctttgttggagtcggacaggcacatgtctttctcagcgctgggcagcacgaagcccaccacaaagacctccacaccgtcagccatcagcgccagaccaagcacaaaatacagtgtccactggaagcggccgtggccacactcccgtaggatggcttcatactgttgggccagttcttctcgttctttccgtcgttgtgcctccccccggcccccagggggaccctccccatcactcaagcccccccttactccagccaggggcgccccatctgccatccgctcgcctttgcccccagactctgcccggggaatgccctgatattccccttcatagatctcatcatcctcgtcatggccctcagtagcatcactggatgcaccaccttcctcctcatcctgggtcccttctcctcggtaataaccatcactgggagcagggaagtcatcatcatcatcctcctcctcaaagcgggagtacgatcttcgggaatattcgtcctggactctgtccaggcccttcaccaccttcttggccgcatgctttttgacttccttagcaatgtctttggccccacggatgaaagctgcccggtctcggaagccctcttccatgatggggcttggggcacttcactgggtcttctccacctcctgcttctttttcagctttttgctcaaggacttgtagagtcaaaaagacccctccccacagttacttagatgaagcgtgttccagtatctctgggcacaaaaaaaagagcaaacaggtcctagccaatgagtgcctaggaaggaaaaggaaagagaggagctttgacctatacccagttcagttgggtggatggggaagggacagggggagcaggggaatgggaaggggaaggggagccagattgggaggctaagccaggataactcaggaagggtcgcctgcttctcttccacaagcctctggagacctagaaaaaataacagacagcaaaaggaagttgtgagtcctaaggtggtgaagaaggccagtataaagcctctcaacccagagccccatctggaccatgtggtgcagagatggtcttctcgctttaggctcccatccacacactaaaaagggatggctatctgggctaaccgggtcactcacatagaagtccccttactttgaccttggaggcctggcctgtggaatttgctccaaagtcgcagtcacctacccccaaacccaccccagcccttgctttatcaccaatctgcaaagaactaaacaggaaatatgagaaaccagaattcccttctttagtcttgcctgggtttcttactaggggtggagttgaggaggatgtgtaagaggacaagccctccaacctgtggccttccctcctctgatggcatctgaaggcaggggcttccactgtccttccctcaggtcccatgtttacaggcttcaacaaggagggattttctctcaacatagtctaatgggtaaatgctcagcttccagagtcacaaagacatggggttgacttcctgttttggcaaatactagctaagggaccaagcctcagtttcttcttgtttaaaaaggggaaagtaagggtcgaatgatataatgtatctatgctccttaccataagtcacctggcacataaaaatgatgaataaatattaattattaattttgtggtgacagtaatatagtgaaatgccctatactacctcataaggtccccagatgaaagctatcttggatgctctttagggtgagcagcaggaagggacactggcaaggagaatcctggttcagggcaaagcacatgactgttaggggtgacctaagttgaaatcccaactctgccacttactaactgatctcagtcagggtagttaacctccctaagcctcagtgtccatctattttaactggggataattaaattgggagactgtttcttggagttgatgtgagaatgtaatctcacagtagatactctatgttagttttcttccttcctatgatgttgaaagtgggaaagaaacaggaagcagcaagggacaacaggggggtcatacttagatgctgttgcccagcatccttgcaaacagagtcccaagacacccctatctatgtttcaactaattccagtagctgggcccacattaactacctccagaagaacaagggaagatccagaaaagggggacctggaacccaagtaaagtggaggaaagatggaaagctaagaaagaggtgatgactgtccactgccaccttgcttcagaatgtcatagataggccccctttccacagatgggggtgagaatggaaatgactgtcaaatgcatacatttccaacatgaggttctaaggcctacagttgcatcccatccctccagggcctcccttcctaatcccccttaatcctttctgctcctcctccaggagtcaaggaagaaggagtccacaaacaccgcattgcgtaggaggcggatgtagaataaagggggtttgggtgtccccccaaaaaagacattctccagaggaaggcatgggatagcccccttccttcataggagcagaggaagcaggcctagattctgatcagaaatcatccccctaaaaatatcctgcctccggtgctcccacccatccagggccttcattaaaacacacacacacacacacacacgcacacacacacacacgccctggtagaagacggtaagcaatgctatgtggttcagagagaagcactggcaagcagcgccttatcccctcaggacagatgtaagcagtggaccacggtgaccagaagcagtgacccctatgtcaccttttcttcatggttcagggcccaaccatcccccatgaaagagctggaactgcggaatcccctcagcgcatggcaatttgctagctttcctctctttcctaaccaggatctcccctccagccctgaaggaggcaggacccaccaggagccatactctatgtttgttgaccctatttccccctgagaggggcacgtagggcagggaagccttccacaaccacagcaggatatgaggtctcaacagccagcttcctcagggccagcaagcccaggaggtcaggagagaaagaaagaagacaaattctttgagctggtgaggaagtggtgctatttttagcccccaaaacagcacagggtggctaagcctgggggagtgagacaagacttggagaggtggaggttaaaggagacaaggttcagggttacaaggtcctaggctggctgacttcacctgacaggaaaaaatgtgcccaggagattttctgcagagggtggagacaggcaggggactccagagcaaatgctttctttcagaacagctcatccagccctgggtccagaaccccccaccctcccagtcaaagcccctgactttggggtccacccagatccccaggccttcctagctcaggtgacaaggtcattaaaaagcaatcacttatcaaaacgtccgcgggggcgggggtagaatgtgggaggtgcgggagcaccccttccccatgacagcccggtcatcgaacttcagcccccacccaggaccatcaagactgcgcctcccctccccacatcctaccaaggttaggaagataggagcacccacagttctgagggataaaaatgagggtgtcagctgagaatgcacactgaggaatacggagaggcagagagggggacgcagggagagacctccgcatgcacagacatagagaccgcccctatcagcatttgcagcgacccccccacaccccatcttgcctcagctccggaataagggaaaagcccccagaactgactaaatccctgctctgagcacctcctccacccttggtcctgctgctagacaagtgtccaccttcactcaacatcccttccccccaccccggagcaactgccgccagcccccgccatccatgcccccaacacctggcggctctacatctctgtctccccagtatttccattcttcactccccttccctccatccttcacctgcccttcttcccctgccccccacccacccaagtccaggcgtgcacactgaggcagcatccattctccagccccagccaaggtcatttatcattcatcctgggggtggggggacgtcaaggtgaggaggggataggagtttgagggaacctcatcccacctcacaaccccaccaccacgttaatctccgaaggggatagtggggacttggttaaggtagagaaaaacacccctcctccccattcaccaatattatacatatgcgtgtgtgtgtgtgtgtcctgaagagcacaactgaaataaatgtccatccccaaaccaccaccaacccaccaacccccctcacccctagagaggggatcgtcaccctccccataagcaaagcatcggaggataaaatggctgcaaggcaaggcaaagatgcttctgccaggggcggggaggaggtgagcgactgagaaaggggtctcacctggtctaggttccccgggtaaggagtcccgggcgaggacgggggtcccggccgcgggcggaggcggcagcggcgactgctcccggcaccagggaagcggcaatgcagacctgccaccccccttccaccactccagccccgcctccgcccccccctaccccgcgccactgagcatcgggagagaccattggtggggagaggagaaaagaggatggggagggagtcagggcacggggagaaatgatgaaagggccggaggttgtcacaagaacagctggaaatggcacccagcccttcccaggcccttcctagtaaaagatagaaggaactaaagaaaaaaacagtgatgttaggaagacaagtgggaagacagggagatggggaatgtggcagccccttccttagcaccccagtctcagtatggcaggacccaataatttcaggggcttttgctgccttcaaaacacctcccttgccttctccactgctctcaaactcctttttcacaacagtctcccaaatccagagtgctcctattccaagtttacctggacattttagagaaagcagagataacaaggtgtggtttctatcctgaactgccagagtcagagacccctggattccttccatctctttcctcacaaaacagtccaggttacttatttacagtggacacctcctcatcctgtccattcagttggtggtagcagaagtactggggaagttgagggatttttacagacctgaccaaccggacagttccccttccattaatttgctccaatgactcaaaaaggatcctctcaatacccttctccattttctcttactctcctctacctccctcccctcccctccacacacttgtacttcccgggcaggaagaagtaaattgtttcagcttttcccttcatctttcctttgctcttgcatcaataacctggactcagagatccaagacatgccacttggtgacacttgatgaccatccctgccgaaggagtgagagggaatatggtgatttggggaaatacatcctgaatgtgtctatgccagataaggtcaggaccttccagacagcactgacctgggcttggacctgggttctcactgctaacaagctgtcaactcttggtcaagttctccacatctgtgaacttcaggtttctcatctggaaaaggggggcttggactagatactgcatcaggtccctctcagatctaatagcgtgtgattctgccttactaaatgtggaggcttcagaatgctgatatatatacatggagaaggctgacaggctatgtccgaagagaccacacaggtaacatttgccaggttgaatttacctctgacagggacacgggcctgggctttgcagactccaaagctggatcttggaaataatcattcatgccaacaaagttcacaatcttctgaaatataaagccataatacataaatattaatttatcataaatatttaactgtcactcagactgaaaactcatatctacatgtctagtacattctctccctgaagccaaatcagaatcataatgtcaatgtataaatgcacaatgacattactggaggatttgtatctttaatggcatctggccatctgcaataagcagccatgccaatgggtccagaaaactcttcttggcaacaatcttctacccccacctctttgctattggcagccttgccagcactcctggactactctgaatgtgacggctttccaggatggtgcttggactggcctcagggactctccctttactagactttcattgctgacccgtcttcaggttaacacacattctttttctttttttttttttttttgagacagagtctcactctgtcgcccaggctggagtgcagtggcgcaatctcagctcactgtaacctccacctccggtgttcaagtgattctcctgcctcagccttcccagtagctgggactacaggcacgagccaccacacccagttaacttttttttttttttttgagacagagtcttgctccgtcgcccaggctggagtgcagtggcacaatctcggctcactgcaagctccgcctcccgggttcatgccattctcctgcctcagcctcccgagtagctgggactacaggtgcccgccaccacacccggctaattttttgtatttttaggagagacggggtttcactgtgttagccaggatggtctcgatctcctgaccttgtgatccgcccgcctcagcctcccaaagtgctgggattacaggcgtgagccactgcgcctggctaacttttgtattgttaatggagacagggtttcaccgtgttggccaggctgctctcgaactccggacctcaagtgatccactcacctctgcctcccaaagtgctgggattacaggcatgagccaccacacacagccaggttgacaatattctttatttaaatatgttaacattttctttttttttttttttttttgagacggagtctcgctctgtcgcccaggctggagtgcagtggcgtgatctcggctcactgcaagctctgcctcctgggttcacaccattctcctgcctcagtctcccaagtagctgggactacaggcgcctgccaccacgcctggctaatttttttgtatttttagtagagacggggtttcaccgtgttagccaggatggtctcaatctcctgatctcatgatccgcccgccttggcctcccaaagtgctgggattacaggcgtgagccaccgcacccagccaaatatgttaacattttcaattaggttatagccaagtccagcaggagagcatttggccagcagggagccatttcttccctttaaggtgactttgcctactctccactgataccttatttgctaaaatagaaatcttgcatacttttagagtgaaaacttataccatcagtcctccatatccatgggtttggcatccatggattcaaccaactgtggatggaaaatgtagttaggcctatgatggttgcatttgtactgaacatgtatagacattctcctcttgacatttatttcctaaacaatacagtataacaactacttgcatagtatttacactgcattaggtgtcacaagtaatctagagatgatttaaaacacactggaggatgtgcctaggttatatgcaaatgtgccattttatataagagatttgagcatttgtgaattttgattatctgtggagggtcctggaaccaatcccttgagaatacacaaatgactgtatatattttcaagttctgagggaagacctcatcattttcccccaggtgccagtgccctgtcccaccaaccactcctttgtagtcccctttgctggggccatttaattttagagttcctatgggctcagtcccaggggcgggaagccttctactctcttcttgctcaccacaggcagtcccgactttaatactgcctatatgctgatgattcccatttatatctgcagtccagaccttcccatcaagcccagactcaaaatctctgtctattcaatatcaccacacgaacatctaataagcatatcaaactggggcagctagaatttccgagccaacagcctccaggctgaagcagctgcctccccttacctcaattttgtttcaaatggttccctgccatgatgtgaaaaagggctgaaaaatggtttttgggagctccctaactggctctgacctcagcctgcctccaatcccaaacagctctagtgcattatacaccatgctatttatcaatctgtttctcctcagaaacatcccatccacctggattgaatttctccttgcctgggaaaggtctatccttccttgaagattaaatgcaggtatcacctttttcccaggaagttttcctggacttttctttttttaaggtgggaggtgggggacagtttcgctcttgttgcccaggctggagtgcaatggcttgatctcggctcactgcaacctccacctaccagatttaagcgattctcctgtctcagcctcctgagtagctgggattacaggcgcccaccactgcacctggctaatttttggtatttctagtagagacggagtttcaccatgttgcccaggctggtctcgaactcctgacctcaggtggtctgcccgcctcagcctcccaaagtgctgggcttacaggcgtgagccactgtgcctggccgttttcctggactttcatgccagaataggtaactttcttcctgctctcaaaatattttgtttcattaacaatctcttatgtgtcagttttgacagcagaactgccttgcttatctttgaatcctcagctgccaccaacagacatcctttgcaggtaccataaaaatgttaatgagaatgatggacgagaacaagggggccatgctcacttcttgcctagaatttagtaaagttcacagttacataagccagagggcacttcaaggaaggggtgacttaacaggattaatgtggcaaagaacatgggggagaaaaaggccattggatttggtctactgaaaagtctttaaactgagatttacacgtgatgaaaatcaagtttggaaggactgagaaatgagaaaaaaaattgaaatacaaactccttatctgagatgactgtttacagacatctgtaggaacagaacaaaatggaacacgtatggaacatttactgtctccatttactcattttgttttgtaattatgtaagacatctatattgttccaaatgaaaaacacattaacacagtatactcagagaatccagcttccctcaatatccactccctccccagtgttatcaatttccattagtatttggtttatcctttttttttttttttttttttgagacagagtctcgctctgtcgcccaggctggagtgcaatggcgtgatctcggctcactgcagcctccgcctcccaggttcaagtgattctcctgcctcagcctcctgagtagctggtttacccatttttaaaaacgttaatacatatatatatatatatgctacccttagagaaggtagcacactacacacattattttcttcacttggagatctctccacagcagtacgtagagatcttcacttggagatcctttttaaagctttttttacattcctttttacagctgcacagtactctgctgcatgaatttatcagtttattcaaccgtccctttactgatggagatgtgagtttccaatctactgccattataacagtgctgcaatgaattgcatagtgcatgttacttcatttttgccagactatctccagatacatctgttcactttaaaacaatagtccggctgggtgaggtggctcacgtctgtaatcccagcactttgggaggctgaggcaggggtgatcgcttgagcccaggagttcaaaaccagtctgggcaatatgccgaaatctcacctctacaaaaaatacaaaaattagctgggtgtggtggcacacacctgtggtcccagctacttgggaggctgtggtgggagaatcacctgagcctgggaggttggggctgcagtgagccatgatcgtgccactgcaccccagcctaggcaacagagcaagaccgtgtctccaaataaaaaaaagaaacaaaaaaaatgacgatcctatgctatatatattgggtccctatcttccaaactagaagataagctctacgtaaggaaacaattactctagtgcacagcaaagctcagcaactgcaacagcacattacagaataagcctttaaaatgtggagtaagcacccttgctcctactcctaccttaccattcttttcatgatactgacatctcttcttaaaagaaaaagagaaaagttactgttgtcaaggaaaacaccacaaataaacaaggagtttagttttattttctctgtgcatttgcaaaatactcaggaccaacataaaaaagaaatacctcctgtggaaaaagttacattaaaaaggggaatggagtgggggtgctgaaagggattagtacctttgccccaaggagctacagcatctctgattggtccaaggaatagaaaagatattgggaaaatgtaacaggaggaaggaaaatgtgaatttactgagggagagggcctcgaagtgggcctcgagggggaactggtggccggggagtgggtctgggtggagggagaggcccccgctggtagccatagggtgggggtcgtggagggccagtgtatccatgggggggcatcagtggaggaggtccacgcataccatgcggaggcataggacctgggtgacctgcaaagagtaaaagaaaagttagtaagggcacgggacaaggggtgtgcctacaggaagctgtaagaacatgataagtgcagatgagggaggtggctagagccgacttacccatgggagatccgaatggaggccctcgggggggcatgcccattggaggaggtccaggatgaggcattccaggtggtggtcggggcggtggctggcccccagagcctgggggtccagcgtggggatgtcctaagccatgagggccatggtgtgcaagctgcatctgagacatccctatgaaaataaaatagacacaagaagaaaagagacaaagagaaggaggcaaagaaaatagagaaaggaagaaaacaaaattagaaagaaagtgacatcagaaagagaactatatagaaaaaagggtatagaaaataaggctggctgggcacagtggctcatgccaataatcccagcactttgggaggcctaggtggatcacttgagcccaggagttcaagaacagcctgggcaacatagtgagaccccagctctatcaaaaaatacttttaattagccaggcatggtggtgtgtgcctctattcccagctactcaggaggctgaggtgggaggatcacttgggcctgggacgtcaaggctacagtgagccaaaactacgccactgcactccagcctggatgacagagtgagaccccatcaccaaaaaataaaaataaaaaaagaagggtggtaaaaagtgctccctatccttgaccctattccaacagcacaaaccaaccaatcaaccaattactcaatcaactccttaccctatttgcttgcttcttccatgatttaggtactgtaatagtaatgatgaagtatataacaagtggagtaataactctgttgataggatttgagaaagtagcagaggacataactgtctaagcaaagatctaattctaaaggatgaatacttcaggaggataagatcatgggaagaaagcatccaagcagaaagattaccatgtgcaagtcacaggtgtggcaaacagcacagtatgttccaggaaatgccagttaactcagtaatcaggagcaaaatgcagttatagaaatgaggggcaggggccagatcataaagagctgtgaatgctatggtaatgagtttgggttttactctgtaggtcaaagggagcaacagaggaattctgagcaagtgtgtgcacatctgtgtcttaaaagacctacactgtgaaagtagatcaaagttagggaaaactggagtcaaagtggcaagagattactacaacaaattaagtgtaaaataatgaggcaatgagagactgaactagggcactggccatggggagagatgccactgatacaaataagacttggtattaagagtggggtgatagggagcagtcaaacatagctctcagattcatgaattaagcacctgaaaaaaaagaacactagaagaagaatggatttgaaggagagggatagaaaaatgacgctatctattaagcagcagcatcaaggatctggaatatcaacagctacggactagagatacagacctaggaggcatcagtatatacccaattaaaactatagatatatgcagaaaagagaaacaagcacaaaaatctaggcacaagtagacatgagtctatcacggtagctgagattaagaagtcagagagaggggtggaggatctagaaaagcaaaagcaaaaagagacaagaatttcaaacaggaggacacaactagtttcaagtatatcagaggtcaaactagataaggagcagaagcgtccccgagatttggcaattaggtcaccactttgaggtggagtcagagaagagaatggaactaaagattaaagaaataaaaactggcaagtagagtctacttgtcagaaaaacttaagaaatggattcagggtggtagatgttagagagcattttgtatgtttttataatagaatgtctgaaggaaaggaaaactctgaaactgttactgttgaggaacaaagggcagcagggtgagtggtaacagagatgctctaccaagctcttccctccctttcccaacaaagcacacctacctggatggggcatcccacccggtgggaatgggtgaggatgtgagtgtccatgaccaggatgtcctgcccctggggttcctgccgatggggggccatgtcctgcagccccaggaggcataggtggtgggggcatggctgggggtatcccaggtgggagggctccaggaggtggcactgggggtgggaaggagccaggaggaggcatgcctatagaggaaatggaaaaaggaagagttaatggtagtgaggagaaaatgtctttaaagagcctgtcctgatctggcctctccaggcagggtgagctctttccccctcctcccagtgctctaaaatcaaaagcaatgttagaaaagtcaaccaacttcaccctcctaaagaaacccaacaactttcttcttcaccactaccatcacccctcagtcctcttcccatcaactcactgactcaatgtcccctgtccccctttcagacttgttttcttcttcctcctgaccctctcccccaaccttaagacaaacatattttaaccaaaagctttacctggtggaggaagcccagaccccaatgatgataccacaggattgggagcagagggtggaggaggtgcatctgcaaacagctgatgagggcgatcagcctgggagagcgggttctgagctgccagaagtcgttcggctgctgagccatggcgctcacccttggagtccttcttgaaggcataagatacggtgataggacggttacagaggtactgcccattcatggcttcaattgctgcatccgaagcatcaaatgaagcaaaattaataaaggcataacctttggagttgcctgtgtcagggtcccgcataattttgggggtttgtaagatgaccccaaaggcgctgaaagtatcataaagcaacttctcatcaatctcagggtccaggttcccaatgaaaatgttggcccctacatccaggtttttgttgtgagctgatgctttgttcacccgtattggcttcccatagagtttgatcatgttcatgatcttaatggcatagtcagcatcttcctcactcaagaattccacaaagccatagcctggaaaagtggagaagaggaggttaacaacgtaagtaaagagactgaaaatggggtaaaattcatctaccctctaatcacaaagaacaagaaagaaacaacatcactttacttaagaatggttccagaaataaactgaagagaggcttaaaagaaaaaaatctttaggttgctcatgttattccaaaacagttgtgaatactgctgggaccctccgggagcaattcgccccttgtcatgtactcaccttggtgctggccagtgactctatcctttggcatgtgggtgttgactactggtccagcctggagaaacagttcccacagcagcggttcactaaccttctcatccaggccccccacgtacacagtggcatcttgaagggagggagcaaaaagagcaagcgtgagagtgtaacgggaaggaaggaagtgatggaaacatgaagatggaacccaaccaggggaactggggaccgcggtaggggacaggagcaaaaaaaaaagtttaaacccttaaacttctctcttcccaggacttcgggaatcctctgaagtctaatttagtattgtgagtgggtttttttgattttttgagtgagaagtcagcaggggaccggacttaagtatcacacccagaggcctcagccagcacccggccaccccgcccccaacaggcagagggccggtctcgcgccctctggggaagggaggagtccagtctcccacccctgcagagacactgctggctgtagtcggggcctcctagccacgctgagcccattccagactttccccctccagttaccctgattccgctcggagatcggcccggcagccatggcgaaagagatcccgccgtctcccagcagcggttccgccttctgacctcagcacgacttccacttccggggcgaagacggacgtagcggtgggcggggccgcggaagaggaggtgcctggaagcggctgcagccatcttaggagcctccgaaacttaacctgggtcgggcggtagagtcctcggctcgcgtcctgaggtgccgctgctagttgtcttagcgaggagggcggaacggaaacgctcaggccctcttaatgcactgctagacttgaaagaatcacactgctctcaaaagtgtaaattcgaaagctaaaagaacaaaaatttcagttttaatatattttgtggacagtgattcttcttctgttgtccagagaaggatgtgctgaagagttccccccaacccgaggacttgggggctttcaggcgcagagggagccttccctctcgcctgcagccttcttgcagatttggcctcacaaccctgatttgggctggaggtatttggttttccctcaggggaggagactgcgaaatgtctgagcttagagtgacgtctgcgctcacctcgtcctaattgcatggggagggtgagggctgctccgcgttggtgtgtgaccacagctgaggggtggatgggatcggagctctagagtctggatctctagaacactctggccccatctgcctctaaatgggagacacacacaagagaaccctttccccaaattgcacttgaattttgcagagcctcaccaaacccagttcccctatttccttagcaataatatggtggatgccttcctctcttgggtcatacaccccttttacccaccactttcctacctaggagaatcctttattcaaacacaagaaacaatgccagcaatgtgtataaatactatgctttaatgagccccttaaatagaaattccactacaaaaatacagaggagatagggtgtttcctgtatccgcctcattcccatagaaaactataagggaagaaatagaacttggaattaaagcagcagcaaggcgaggtgagaatgcgatttctaggccatcttgttgggactgatgaacagcatctctgatctcatgatttaacatctggttatccagaagggatgggattggcctaaaaaaaccgatcaatttctggattgtttttgtttcttaatccttcaaatgacaagaagcaaaaatatttgtagaaactaagcaagacaagagttggagcagttaacaccactatctgcagcagaaactcagaccttcttagtgaacttaagggctgaagtgtgaaagctgaggctgcaagtgcagatacaaaaaaaaaaaaaaaagattagacagaaccctcctctaccccagatccccctctgccctgcctttgagaatgccagcaatttcagtgggattgagaatggtatgtggatctcttttcttggagtgatcctcaggagatattcttggtgtccatttccgtaataactcctgaagatgggatagctcatcctggaggccagagattgtgggagctgagaggcccatctggggaggaggcaaagaggaacagagaagaatactgttgtagctctggccccctgcttctctgctacttctggtgtctttaattctgtttcccctttcagctatgccctaaattccacttaatctaagccacaagcactttcccgcacctcctacactcccaaaccttgtttgatgccaagaggagtagaacttcacttcccagactcccagaggcttcagctccttgcctttccagctcctgttcatctggttcagcagagtcaagtcccttgtcccactcccagtctattttcccttcttacctggacctcaggccttcccctcaggtagcagcgtctccagagcctgatctggggtcccagatacccaggcagcagcagccctggaggtaaagggcaagctccccaatgtgaggggagaccccattcctggtcagccaggctttcagaggagatagcaggtcgagggagccaacgagaagagactgccagcagggaaggactgtcccgccaaggacagagctgattcaggggggtcaatgctcctctagagaagagccacacagaactggggggtccaggaaccatgaagcttggctaaaaggaaaagaaaatcaactggcaacagagagaccagataaccctagtttccccaatctggatcaggacagggtgtcctgctgccacccactcactgcactggtgactagaactacaagcctccccatgagaactcttctaccctcctcattaggcttcaactaggcctcgggactgattaaggttgattttagggcaccttatgtgtgcacgagacaggaagatgagtaaacagacttgaggaaggacaaaaagggtgccctctgtgctattctaggtcttctgtcttcctagggacacccagggactataagtgacagctgcagaagagtagtggagtagctttccctaaggaactcaagacattttgtctttcacttctcactgtctagtagcatgagcctgtgggaacgtcaagggaatttaggaagtttagacacttcacctgtggtctagggagccaggaatctggacagtgttctgggtcatagccaggattctggaattgtagtatctgtgcattgctataacgtaaatcccagtcccagacagacagctgcaggttaaaagagttcccagctggaggctgggagtatcctggggtgtagacttgtgtataggagtttaactggacagaggaagcaagaaaaaggatggttacacacaatcctcccacatctagagacaaatcatgagattctcacctcttattctaggaaagatgtagggcaaaagtctcgtcctgaaaatgagaataaatctccccctccccactcacagacctcacttctcataaaacaaatcaagaccaaacttcagagagtacatctcaatggaaaaaaaaacacgagtcaaaaatagaagtcactgacctgtccgctctgctttccgcgctcccagggggtatttctcaggaaggtaagggtgtcaggaaccctgacactgtcatgaagagcaagaaggaaaaactcagagaattcaaaatcagctggaaactgctggaggagctgccagacacaatcaaggaagaggagaaacaccggagcctgaaaagaaattaagaggttggaagggattattgggacccaaagagggaggatgacgagatgataagggaatggggaacacagggaatagggggaacttatggaagtcagggaatgaaaatctgaattgagggtagcaggggcttgtaaggcctcactcatcaggatcttcgtcccagcctaacctcggggcccttctgaccggattcacctccaatggattatacaaaataatttctcattctcttacttccttagtaatatgcccccgatgccatcccgaatcattctcacctcttcactggccccagttcccccaagccgagtcaggaagggatgtccagctgccacccactctcgctgtactagtgattggaagccaaacagtgttcgggcttcgggggctgaaagcagctggacgagtgaagagaggaggccattgagatcacgatcaccgcgctctgggtgataaagaggaagaagggacaaagaagaggggtccaagaaactagggcagaagagaatgagaagagaaatacggcaaggagaagtgagaggcacagaggggaaaggtttggggtaggaggattgagaaagcacatagaagtgaagagaaaacaaagaccttgaatgattcacttcctggactccacccggatagaaatacccagtttcacatgtaaggggcagaatcacaattctcaaaccagcttccacactgcccttcccaccccaaccccagtctccatccgctgatggaaggaaaggaacaaaggggctaagaccatcctagtgtcagggaccacaagttgtgatggggaggcagaggtagcactgaaggatgagagtagagctcgcaggtagttcccaggaacaggagaggaagaagccttatgggtctccctccctgaatgcaatctggtcaggtgggtaaagaaaagaggcaaggaatggaatgggcttaaccaaggaactcaccttgaagtattacagaacgaaccctggatgtcactaatactgaaatgtcactggcctttcgaagacaagccctggaggagcaggtgaggaagagggaggaagaatgataagcctaggggaatggagtgattttgatgggtcatgggatggaataaggccgactccaaatcctacccctcctccttctaaagagcagaaaatggcagtcttcttgggaaaccgaggagaagaactaaagaaaggccatttaggaccccaagttaacagaaggttgaggaaggttgaattataaatgatggctagaagaagcgagggagtacctgacatagtccagccatcgtgttccttccagggctgaaagccatttatcctcagctacagatgaatctgatagagggtagaaagatcagaagggcaagagattagaactcaggattcaggattcaggttgatagcctgctgggttaagaacaggaatgaaaagtaattgtaaatggccaggatggtttctaaaattaaactgtggtgatggttgtacaacattgtaaatataataaaactcactgaattgtatacttcagtgaagggtaaattttatggtatgtacattatgtctcaataaagctgtttaaagaataaattggggtcaagaagacaggaaaccagtgagtctgtgggagaggtgggagaggtgggaggtgagtagaaaacagtctcactggccgggcacgacggcttgtgcctgtaatcccagcgctttaggaggccttggtgggtggatcatctgaggagtttgagaccagcctagtctaacacggggaacatggtgaaacctcgtctctactaaaaatacaaaaattagccaggcatggtggcaggcgcctgtaatcccagctactcaggaggctgaggcaggagaatcgcttgaacatgggagttggaggttgcagtgagccgagatcacgccactgcactccagcctgggccacagagggagactccgtctcatctgccttttttttttttttttaagacaagtttcactcttgtcgcccaggctggaatgcaatggcacattctcagttcacccgcctcctgggttcaagcgattctcgtgcctcagccttccaagtagctgggattacaggcatcggccaccacacccagctaattttgtgtgtgtgtgtatttttagtagaaacggggtttcaccatgttggccaggttggtcttgaactcctgccctcaagtgatctgcccacctcggcctcccatagtggtgggattacaagcgtgagccaccatgcccagccgagactccgtctcaagaaaaaagaaaagaaaagaaaacgggctcattggactaaagagctactcatctacagcaagcaaagggtaaaccaggttaggctcagcagacctaggggtgagggtgagggttaggggtcaaaggttattctcaccaggcaggcagagggccctcagcctcaggtgggcaagttggacatctgcaaggctgggcagctcatccatagtgtctaccaggacaacatctgaatgcccagcctggagcatcaactccactgctctggaggggagggagtcaggaaataaggagtctaccctgagcacctaacccttgattcttctcatcaagcctccctcacctgatatcctccttgttagggtcactggctgtatagaagcctccacagcggagaagatcactgcccccagggtgatgccaggacaagcgcttcacatggggcagaagagggtcattgtgggagaaatgcctagctccacgctacccttgcccccacactgacctcacagaggttcctccctccacgatgtccctggcccacatgaccctctaatccacagccattaccctaaccatcacactgaccggtccacggccctgatgaaagtggccaaatgctctcctgacctcactgtccagaattcggttagggacccagaagtaacgggggaggctgtgaaatgagagtgatattacagtttggctcagtgacttcattataatggaaagctcttattacaaggaagctgcttcagagggaccattccaagggatttcaggtttagggatctaggaggcaagggagatagctttgtgggtgtcctaggaggctggagtttgtgggaagtcctagctttagaggatcaaggaactaagggaagattgggagagcagcagggttggggtgcactgggggatcacctggtggctacgtcgaacctctcgttgaccgtgctgaccctccagcctctggctgcctgcttcttccgctcagtctcccagtcttccgctgtctccatgagaggaattggtggttttctggagccagaaccctggcctagaacaggagtgagacatagaggaggaaggagaaaatcagagacagcttctcagctctttgtcatcagccatcctctgctttttcagactcttccttaccctaaagcactctcactcaccagccttgctcagggttatccccgaatactgttgggcttgattgctctgagctctggcttggacaatggccatggtcacctgcagaggaaaggacattccatccttttggcttaggctgagtaagtgaaaagaaggaaatggagcccatgtgttgctccactctctttgccaagaatgaagaagaacagtgaagacagtccctagagaagggggcttcctcaggtcatggggactggggtcgggagaacaaatctggaaccacagaatcctagaatgatgattctgggaggaatcctggtttttcagaggaggaaacttgcccacagtcacactgctggtaattaatagagtaaggctagagcgcaggctctttactctcatcacgcaatcatttatcccagccttttagcctttccttgagagaagcagggggaatgatgagaggatcccaggggctggaggagtctcagaaattgtcagggagaggatcccaaggttctgaggtgaggagaaagcctcaggttaggggcctcttacctgaaaagcctgaggctctaggcctccagcctcaaaaccaactctgagcagccggaagtctcggccatgaatcagaatctcctcagggataaatttatgcagggaccctggacggaggagctggactcgggacaagccgctcactgaagtcaagaggtacagaacagtgtaaccatggaccagagtctctccagaagggactcttgcagcccatcccactccatccctgctgttttctgagaacagaggaaggatgaggagggagttccaacaaccccagtgaaccccttcaccaaacccccccccaacttaccagcctctaatcgtccaatgttgaccagggcaaaatcgtattcactgttcaagggagtgtcctagacgaaacacgtgactgggtagacatctgaaatcgccctcattttcctaccctggcagccccaaccccttctagggggcaacaaccctagagagagttcccactgattatcaatgatacattcaaaagacagcccttaacccataatgtttgtctaaatcctgctagactcccctacccatttcccactagctgtcatttctgtggccccaaccatctcacctgattccactgccatccacagggctggaaggtgaccctaaagttggtacagatcagggttccagacaattctggttccaggcccttcctcacccctggggcccatgctaggatctgctcccctaaaggggaagaagggaagccctgttatgactgttcccagtgttgcccacacttggatacacccacccctccaagaaagggagatctaaatagggaagattaaaatcctccccaaagcccactacaatgtaagcttatgaggaaagataaatgttttttaatttctgtaactagaacagagcctagaacaaggcctggcacatagcaggcactaactatgtatcgaataagtaaatttgaaaaggggtaacagggtcaaggaaacagaaggaatgtcaaggtccagctctcagccagctctagaggctgtcagggaggacagcgagcctcaggcagacgtacttcgagccacgagaggaacacaggggtatctttggtgagggcatgaaacaagattggcgtaggatgaaatttggaagtctttggagagtgatagggcattattacctgggaggcatctggaggccaggcaactgctaggctgacgactcctgggctccggcatcctattttcctggacagactttggtccagagggttgaggggggtctagagttaacccctaggctccccaactccccagaggcagctgcctgtagaggcctacactcacactctcgggggaaactgagatcagtgtctgtggggagctccagacctaacagggctggtaaacagtaaagggaggggctggttaatggataatgagacaacgaacttgagactgagaaagacggaccaggctccatcagcagaagctgatagacagacacaccctcctcctcctcctctagagcctttgcttcccccttttatctccacctcatccccgttctcaccctcttgccgacaccccccaaattccttctccttacccccatctctggctcctccttctggggggcaatgttgaaactctggccccggcccccccaccacatttctctggctccatccggggacacagcagttaagggtgggaaacctcaaggatgctcacccacctcggggagaggctgagtcttgttgagaagaggggtgttagggagaggggtagggggttggacacaagggaaaggagcatttgacgtgcacggagcagagtttgggggtccttggaaaggtgtgtccagcccagcctgagaagtctcctcggaaacttcagtcgactctggagagggcgggagagatgcccaaccccttaaaggagaatacacacaattctggaaaagtggagaggaaacggtggagtctgagacggacgggtggggaagaaatggggactgagagaaaaacgactcccttctttaccccaatcccagaccctgttctcttcctgttcatgagtactggagaccgtttgaggggagcagttctattgattatgaagctggaatcatctgggctacctgtctggagtgtctcagtgatgacttcccttaaaagctccgttcttttgtcttctcaaaggggtttggggcggggagaggggtaggaatgtgaaagtggttcaagcctccttgccgcctcttccagaagaaaatgaaaattagacctggggggatttttgtcagcagaggcccaagaattaggtgaggaagcagggaaactggttaaagtggttttgcatatctttctctagagggcatgacacagacatcatgtgaagactgcagtggagaagtataaaaagagatggaaatgtgtccaagatgcagacacaagtacagtttgtgtgcaagtcttggggatgtgggtgggacaaaaagatcttaccagttaatcttgcccatcacgtagatacacaaccaataggcaataagtgcccattcccgtatgtgactccacccctccaacccagacaccagatctccaaatgaatgattcatgttcaggactttcacaggtgagggctggaaacctctcttcagctcagcagtccatcccccgtccctcccatctgcaaccctagaagcaaagatgggtaaggaaagctgggaacaaggagagaaggagctgcagctcctttaaaggagggggacttggggacagcaaagcaaaaatctttatttagacatgaaaaagacagaaaataaaatacaaaataagagttaatgagctgctgttttattgcttttgaatctacagaggcagcaatccttagatgggggccccagttttccaaagtgacactcaattttcccctccccccagtacaccacccttctggcctcagctttcagtttcctgtcttggctgcaactgtggaaatagtgaagatattgtgagacagaaagtcagtctggaacaaagaggtatacacctgctaagaaggtggcccagaagcctgattctagaagtcctaaaggctacagagcaccaccaccccacctgcccctaatgcattccatgggcctcaacctcttgggggaagaaaatatttcccaaggtctgttgtaaaaagaaaatagggaccaggcgcagtggctcacgcctgtaatcccaagcattttggaaggccaaggcaggcagattacttgaggtcaggagttcaggaccacctggccaacatgatgaagccccatctctactgaaaatacaaaaattagccaggcgtggtggctcacacctataatcccagctacttgggaggctgaggcaggagaatcgcttgaacccaggaagcagaggttgcagtgagccaagatctaatgactacgctccagcctgggcaacagagcaagactccatcgcaaaaaaaaaaaaaaaaaaaaaaaaaagcataggaagaggtgtgtaccataacttttaaatcccattatccactttccttctcaccaccatccttcattcaagagcctcattctattctttagcactttgaggtgtggagacagtggaggaacacggagaaaaaaaatcggggggtaggggtgtggtggctcatgcctgtaatcccagcactttggaaggctgaggtgggtggatcacggatcacctgaggttaggaattcaagaccagcctggccaacatggcgaaacccccgactctactaaaaaaaaaaaaaaaaaaaaaaaaaaaattagccaggcatggtggtaggctcctgtaatcccagctactcgggagcctgaggcaggagaatcgcttgaacccaggagacgaaggttgcagtgagccgggatcgcgccattgcactccatcctgggcgacaagagcgaaactctgtctcaaaaaaaaaaaaaaaaaaaagcggggtggggggaaatcaggaggagaaaagaattgggcgatttggatcaatacttaaccaggaatggagtgggcaggagctgagggttaaggctgcctctcaccaccccacacacccccagtagaagcactagatgaagggaagggtggagaggcaaggggctatatcagatttttccattttcagaatcctgttctggctgcaggtttgtgccaggagtaaaggctgctgggaggggcagccggaggagggaggtggagctgagtgactcacaagatgagtcacagatccagttataagcacagaaagaggccaaggtccttcccacccctactcctcttaactgctgccagccagcttccgttgctcttttgtactgccccttacccacttggccaatgcaagagatggcacagagaaagtctacatggggacatcgtaatattttgttacccaactgatgtatggtggcaaaataccctgtgatttgcagactggctgtctgcaaagtagaagagacagaatgcctgcatgactcatccagatctatagttgaaaggcctggagggaaagaaggaaattagaaaaatctggagtgcaggtgattccaggccgggaaggggcttctaattctgtcttctcacctgtggctatatgtctggggcactgactcattggagaaggaagacacagaggccagtcgcggtggctcatgcctgtaatcccagcactttgggaggccgaggctggcggatcacctgaggtcaggagttcaagatcagcctggccaacatggtgaaaccccatctctactaaaatacaaaaattagccgggcatgattgcgggtgcctgtaatcccagccacctgggaggctgagacaggagaatcacttgaacccaggagacggtggttggagtgagccgagattgcaccactgcactccagcctgggcagctgagcgagactccgtctcaaaccaaaaaaaaaagaaagaaagaaaaaggaaaaagaaagaagactcagagtccagaggtgtctgagtaattcagagacaatcatctctgaaatactctttattgagaaaaaaaatgtgactggaaccttggacacatggctaaaaggagttaagaatggcaaaagctaggttctcagaacacattcaaaaccagctttattcttttgggctcagtatcaccccgcagatatacaacacgaagtcactgctaattcttgtttgtctgtgggccttagtttcgcttgatagaaaaaaaaaaactgagctaatagagggaaggtacttcccttccactgccctctacagcactgagtttaacaccatctccactccttaaaaagactgaatctttaaaaaatctttggatataatctttttattttgttgataaaaaccagtatggaggaaaaacttctggttaaatcttgtaactttcaataaatgcagcataggttaagggagaagcggaggcctatcctacagtaatacttactccattggagatggggcagagagcacagcagggagggagtagcactgtctaacatcaaaaagggaaaaacaagaaccctgaaaatctcccctctccattaaaaacttcagtaggtaccccagttgccctggattaaaggaactaagtgcacttaaatttaagcctgagagatgatatcatccctcacttggggttaaagggtctaccttcccccttcactcacacacccctccttaactaaggaatttttctgcccatttcgagtgcaggccatatgccccttctttccttctccccaacccagtaacgacatgggcttgcctcttctattccctcatcttcccaaaataccacaaaccaagctgaatctatattaatttcccaggcattattccttcacctccccccatcccaccaaaaccctccccgaaagaatgaagcaaaacaaacttcactatctcctataaaaaatatccattgtctcagggtctctcatccttagaatggagaggtttttcaatgcctcaataaatagttaccctcccaaataaaaaaaataatttatttcttaataaaaagctataaggcctaaagccccattttaccatattcacccctagaccacccctcaaaatttccatctttttttatttgaaaataaagcaaacggaattgggattggctaacttataaataaaaacaaacatgatacaaggttttttgttcatttgtccttagtttttaaaaacaaaagtgttaactagaatctaacaacagatcaaatccaaacacagcagtccagtggagaatcaaaacttttccggctttattctctgggaaaacccctggtctgttttcattcctattggtccaggccaccattctatgatatgaaggcctaaattaggaaagctaggtgagctgtgcaaattcagggtgtctgagccacctgttgtttggtgtgtgatgggggtggaggcgcacacagtggtgttctcgctagtgttcaaatcacagaaacagggacgtaactagggtgaggtgagcaaagcactcaccttgggcacaaaatttaaggagtgccaaaaaacccagtaaccaagataaatactattttaatgcaacatttttaaaaaatcacaattaatgtaaaaagtctatgatggacaatgtatcaaaaatttaaataagaaggattcatccccatacttattcaattcagcctcacttccctcctcctaatctcagtcctgtcagatcctgtaagatttcgctattttatccaacataaattttttgcattaatttttttaaatactgcattttttatagtatcttgattaatgagttttatagtaacccttaaattttgcaacttaggggagtgctcatctcataccaggttccagacctgcctagacatatacacatcccttcctttggaatctcactgcttccttaacacaaatctattttcaaagaaaaccctaagaattaatagccataggaaattattaaatcagatttggaaaataggtgacttctgagtttgttgaggagaaaataacctttataaaccgtgagcatttccaacaaggacaatcttgactggctaccgaggaggaaaacacacacacatatgcacgcacgcacatgcatgcacgctcaagtgctttagatcaaatgtggggattacgttccaagggatgggttatgagtacatacctcaaaagagaaatccaaacacagaaaaacagccccagttaatactctggacacataagtacacttattccccttcttcacatgcacccgggagtgtatacaattgcatagttgactttttttcccggaaaaaaatataaagaaaaaggaaaattggcccaggataggtcttccggtttaaagctcttagaaatggctctggccagagcataggctgttcagacttgtgctttgtgcaaaatgcgaaggagctccccctactgtgtccgcatccccactcccagcccctagagaacagggaagggtcagggaaagggagaaacctaaagacagatcagctcattgggagtcatctgtgctctgtggttatagttcactaaaatatatttctctaactacctttttataaattgcccctatatgtttcaacatcagtcctaatatcaaaaatatctcttcttagaaagtatttttaattattttaataaactaaccacagattaaggtcagctatggcttaacaaaagaagccgggatgttaagttcattctccaaaagtagagcaaagggagaaagaaccacttaagtaggagggaaaaaaatcattttttaaatgtttttgcttgctggggtctttttatttcttttccttaaaaaaaaaagtcaataaaataagttgctttctacagaaacgcagcagccacagaggcctgtaatgctctacttaggtttttggttttgtttgaaacagcctctggctaaaatgtctgtcctcccacccctcccaaggtgcactcaaaccccaacgtatggttattgctgtggttaaaaaatagatcagctctgccccaattcacctggagaaaatgcaacacacatgacggctgttctcaccacactcttccctttaaacaaatacaattaaagacttagatgaggaaaagacagggggtaatcagcaatctcttctcaaactgtaacagatgacatatgactgcttggaaggaaataaaccttaagaggaaaaggatttccctcttaagttcctccctttcccatctaaacaaacggatttaaactacccccacctcctaacaggcacccatgaggacacattactgccttgtctttccagatccttcaaggggaagaatttatccaaccttaatttctagcttaattcaaatcaatagcaaatgtgtccaatttcccacttcccctccacacttctcactccaccatgtgctttttcccaacctaaagaactttggttttattgactgagaacctcctttgcccattcctccccaagacttctgcccacctcccacccccacacaccaaaccttcccctgctactttctcttaggtccctggatgggacccaggaggttataagacagaatcgccatcttttccccttgtacctcaaacctcatcaagtcaagctctgcagaggaatagtacagcccctgaggtgccatccagccccgacctgctcttgccagcctggcagcactcctgtgtgcacacacttaaaagtttccagccaggctcccacaaacattactgcattttccccctcaacatggggactgtgttcttgatgagccaattagttgagcttaactttgtttagcctccttgcccttcagtgttccacccgttcagaacctgtgcaccaggagctccccatccggttcccgctccctcctcctcagttcttccctgtaacaacaggaacagaagttgtttgtctcagggtgtccatagaagctgcagttcggttgtttgcatttggtctgagttgggggaaggccccggagacctccagcccatccatctggctcagggggctctctgtagccattgctataggaatcagccactcggtaggggggtggtaacaaggcacccctgtgaagtccatccttagagtggctgcctggctccagagaagggatgctgtcctggtgggggtagggtcgcccaggagggcactgtctggggaaggtggcatatggtggtaggcccccgacacatggaccccctgccaactgcctccggggttcctggcagtggactccgcccccagacggccgagggatagtaaagtccccagggtagccagtggaaaatgccattgccctggactctgctgggggaccggtcggctgctcttccctagcatctggctctggctttttggctggaggagggccaccccctattcctccattcatgatcttcctctctgcctccttctgcttctgttctgccaggaatctctcctcagcatcagaaaggtagcgctggatcatttcctcctgatactggtgacggtgacccatcttcagggttccaacaaaaataaacttcccctccccttgcatggcagtcctcagaatgctcaggctctgcatcacctcctggctatacttgctccctccgttaccaacagactcagctgggggcttctcagacacaggcccatccccagctgcctcctccttgccacccttccagctcttcagtgagtttttcttcttcttctccagtgtctcagtgccgctgcttcctcccaaccctgtccccacccctccaggctttgaacccttgctgtgcatcaggccccccatgttcttcttgagcttgctgcccaaggttttgccaaagctgcccagtttgttagccacagaatctgctctcttcttgtccttctcccgatctcgctttgacttctccttccgccggccgccctcgttgctggtggaactgctgccaactgactccttgtctgagtctccagactcaggagtggaccggggctcatctccagctgaggcggtgggggactcaggctgggccagaggagcctggaagagacaagaacactgttgacagttatcccagcagcctggggtgggggaatcccccagggacctctagcccatccatctggctcagggagctccctgcagccatggctatagaaattagccaggtagaaaaggatggacacctatgaactccgtcctctgagtgattgcctagtgactgccttgctccagagaagggcttctgtcatgatgagggaagggtcacccaggatggcactgtccttcctgggttccagtcagtcagctttctcccccactgcaatctgactcccttctgtaataaggagatagtagaataaagccttactgttcatttagaacaatgagcaaccatatgatacgtggcttccgggtgagaggcccagacattagaatgttctttattatacatttctctatgccaaattctgctcgaaactaatctcaagaaagtcttgactaatcaaaactaaccaagtctagccactttgcatcccctcaacttttatacattctgcattggagttatcaatttgaccctactcctgtgctcctgttctaactcagagcccactgaattaggagctctttaagctactccgtctcctagtgcccaaaacagaggtctatctacagaagactttggacgaaataatgatcatctcaagttcaacaaacagtccagaaaacctttcttaaagaatatgttaagccaggcacggtggctcatgcctgtaatcccagcactttgggaggccgaggtgggtggatcacctgaggtcgggagttccagaccagcctgaccaacatggagaaaccccatctctactaaaaatacaaaattagccggacgtggtggtgcatgtctgtaatcccagctactcaggaggctgaggcaggagaatcgcttgaacccaggaggcggaggttgcaataagctgagatcgcaccattgcactccagcctgggcaaaaagagtgaaactccatctcaaagaaaaaataataataataataataatatgttttaggtcaggcgcggtggctcacgcctgtaatcccagcactttcgggggccaaggcaggcggatcacaagaccagcctggccaacatggcgaaaccccatctctactaaaaatagaaaaattagctggacatggtggcgggcacctgcaatctcagctactcgggaggctgaggcaggagaatcgcttgaacccaagaggtggaggttgcagtgagctgagatcgtgtcattgcactccagcctgggcatcaagagcaagattccgtctcaaaaaatatatatatgttttagtatcagataacagagactggctggagaggagatgtggaaaacaggagactaacggtttttaaaaagcaggaaagggctgggtgtggtggctcatgcctgtaatcccagaactttgggaggccaaggtgggtggatcacctgaggtcaggagttcgagactagcctggccaacgtggtgaaactccgtctctactaaaaatacaaaaatcagccgggtgtggtggcgcacgtctgtaatcccagctactcgtgaggctgatgcaggagaatcacttgaacctgggaagtggaggttgctgtgagccaagattgtgccactgcatttcagcctggctgacagagcaagacttcctctgaaaaaaaaaaaaaaaaaaaaaggcaggaaaggccaggcgcggtggctcacacttgtaatcccagcactgtgggaggctgaggcgggcagatcatctgaggtcaggcattcgagaccagcctggccaacatggtgaaacctgtcctctactaaaaatacaaaaattagctgggcgtggtggcgcatgcctgtaataccagctactcaggaggctgaggcaggagaatcgcttgaacccaggaggcggaggttgcaatgagccaagattgtgccattgcactccagcctgggtgacagaacaagactccatctcaaaaataaaaataaaaaatacaataaaaacaggaaaaattgtctttggaacttatctgacatcttctagttacttctaaccttgaattgtaagccaccactcagaatagattcagaaggaaaccatcccagatctccttgttctgtcactgaaaatgaaatgaagacacaccagggtagatgtgggagaagtcttcacctgtgcatcagaggacagtgggatccacttcacattcatgtagctatgcagcagatgcaatttgacctctagggacagaattacactatgaaaaagagaaaaaacaaattactgtcaccttttaaaagcaaagcaatttgatatagttgggagaaagggtgggagagggctacatggcttaggactcaaatagggttgggtttgaactatttctccaccaattaataagctttatgaccttgagcaagtcacttcaacctccctgaaactcagctgcagctgagaatgggtatagataatatctatcctgtagggttgttgtaaagattaaaacagtgtttggaaagagcccagcacagtgtctggaaaatgggaaatactagatagtagccattatcattgttgttgttgtaaatattatttagaaggagcttttgataaataggtgagaggttatttttaaaaagccataaactctggattttaaaatcaaactctcttagctgggacccagtggcaggagcccagagagtgaagcactaggtaagtgctaagggaggagcttttgcattcatacactctccatcaggaagttgatgcaggaggcagaaggaaggcttaacaagccacagggaggtagagtgggggctgagagggtagggaacatatttttcttgctattaaattccagaaaggcaaaaactcagagcaaactatttttatcacgtatttatttatttattttttggatggagtttcactcttgttgcccatactggagtgtaatggtaccatctcagctcactgcaacctccgcctcctggattcaagttattctcctgcctcagcctcccgagtagatgggattatagacatgcaccaccacgcctggctaattttgtatttttagtagagacgtggtttctccatgttggccaggctggtctcaaactcccgacctcaggtgatctgcctgcctcggttgcctgttcactctgatggtggtttctcccaacatgctgggattacaggcataagccaccgcacccagccttgatcaactctttaaaactcctctcacttgggctaagacatgtgatttgattatcctgattttctttctttcttttttttttttttgagacagactctcactctgttgcctaggctgtagtgcagtggcacgatgtcggctcactgcaacccctgcctcctgggttcaagcgattctcctgcctcagcctccctagtagttgggattacaggcacgcaccaccacgcctggctaatttttgtatttttagtagagacgaggtttcaccatattggccaggcttgtctcgaactcctgacctcgtgatccacccacctcagcctcccaaagtgctggaattacaggcataagccaccatgcccggcctgattatcctgattttctgatcaatgttttagagatgaatcagtgtatgaacacttttcctattgtaagaaaagaacaagttgagatgctaggattcccatctctttcacagggagaaaaagcagctgcaccatgaaagagtcctggtgcccaacctctcctctacctccccatcttcccaaaactcatcttagcttgtgactgtcttgcctgagctgaggaaaaatccctgggagatggatgccacatgtggaagaaatcccagcacaaaatagatgaaaagactaggcctggcttacctggccaatcggacattgtcactatcatctttgccccactcccagccctttccagggtccacagcaaagtgcaagggcagcagcttatactctgaatctgtaagtgggatcacagctggagaggaagaaacatatcatcaaggaatctccttaagagagaaaggtaactgaacacagacttatttcactaaaatcatactaaggtctttaattgtagtcacttctcaattcttacacgtgaattaccccggtattaaaactaattggctagttttcccgctaccacgcagcatatgttttaggccacaaatctccctgagtccccaccagtcagtcaactaactctcatgatgttctttccagttaatgtatattcagagaattcagtcataatttaagacaaattagaaaagcatcatttagaagctcttacaccttaatcataagcctttactccagaagagggtatataggtcttgcttttctcccaaccctttttttttttaatttgaaaactctggcgtaacttctggcttaataaaacagtatcaacatgtgctgtctgggcttgcatgtcacttaattctttcctcctacattagatctcattcaattttttcaagtgaaaataatgcagaccaaaagacatgtcattcagcaccttgttccttggtattctccttctgctccatggacacgagtgcagaaaagtgggcctgatcataggcgagcaccagaggggagcggtgacactggctggctgggacctccaaaggcagatagattcctccaaagggaataggggcaaatgctgcaggaagccatgaagattattatgaaggctgtgtttctgcctagtggacaatccctacatcccactctgccaactgagtccctccctgctttcattccaacatgtttaataattctttcctaagaagccctgtcaactaatcccaactgctttactcagaatctcttgagaattttgcactattctaattgataacttgctttttccccaagggtctatatatcccctttcctgccttccttccaatgcttagcctaaggctttgcaaaagggggtgctcagcatggagtgaggactgactggctgactcaccttcccctccggagtccctcagcatggtgtctgccacgacgactatgggcctcctaagcacatgagcaaggacaaagacgtgaaactcttcaaggctctcatatacaggctcctcagaactctccaccctggaacgacgggaagggagagagtgaaaagggtgcagtaaaaatgagagagtagaaacaggagaccctgaagaccagttctgcagaaagggaaaagaagaatgtcctttcctggttttccaatcttaaggctgccactgatatagctgattattttatgctaccatggctgtttctacctccgttttcacagatggggaaatccaagaaaagagatttgaaggctctagggttaaagcagtgttaggaatttggaggtaatccctatctcttaatattcttcctgttcaatagcctctctccattctcttcatccagtagctcaatacacaactgcatagcttcatcctacttattttatatactacagccacccacacatcacactcatgtcttacaaaaacagccaaacacaattcctttcctatgttcctttcctcactgaaagaacagcttcaccatctatccagtagcataatcagaaatttggaaatatttattgtgcttttatctctcaccttccagtagtcacgtgatttaaccaattccatctcccgtgtgtttttttgttttttttttttcttttttttttttttgagatagagtctcgttctgtcccccaggctggagcagtggcgcgatctcggctcactgcaagctctgcctcccaagttcacgccattctcctgcctcagcctcccgagtagccgggactacaggcacccgccacctcgcccggctaattttttgtactttttgtattttttttttttttttttttttttttgagatggagtctcactctttcgcccagactggagtgcagtggtgcgatttgggctcactgcaagctccacctcctgagttcaggcaattctcctgcctcagcctcccgagtagctgggactacaggtgcccaccaccatgcctggctaatttttttgtatatttagtagagatggggtttcaccgtggtctcgatctcctgacttcgtgatccgcccgcctcggcctcccaaagtgctgggattacaggcgtgagccactgtgcctggcaattttttaaatttttagtagagacggggtttcaccgtgttggccaggatggtcttgatctcctgacctcgtgatccgcccgtctcagcctcccaaagtgctgggattacaggtgtgagccactacgcctggccttcctgtgtgtttcttttatctgtctcccgggcttatctttagtctaccacactgttcatccatggccctttcctggattactacaactgcatcttatcccactcctttccacttcattatccactggagtcagcgtgttcaaatacggagggacaaatttgctcctgtcattcacatactcaatattcaatggcttccaccccctaaagcaattttattcaatattggatgctgattacaaacaaggatttctgggccttacctctgtccaactcaactggacttttctggggtggaggtccagaaatcagctttttaaataactctcccagattattcttatgtacaataaaatctgcataggttataatttttaaccattatggaaaatttcaaaattttaaacatattcaatactagaaatgataatatactaaacactcatgtatccatcacccagctttaacaattataaacacatggtcaaccttttttttttttaaacagaaagtttattacagcatattacaggcttgtgtcagtactaaattgatcaataaacagattctagcctgcactttcaggaatgcacccaaagctactcctcagatctagagtagcatgggaactgcttgctgctcctgcacaattttttttttattatactttaagttctagggtacatgtgcacaatgtgcaggtttgttacataagtatacatatgccacgttggtgtgctgcacccattaactcgtcatttacattagatatatctcctaatgctatccctcccccctcccccaactccacaacaggccttggtgtgtgatgttccccaccctgtgtccaagtgttcttattgttcaattcccacctatgagggagaacatgtggtgtttggttttttgtccttgcgatagtttgctcagaatgatggtttccagcttcatccatgtccctataaaggacatgaactcatgcttctttatggctgcatagtattccatggtgtatatgtgccacattttcttaatccagtctatcattgttggacatttgggttggttccaggtctttgctattgtgaatagtgccacaatacacatacatgtgcatatgtctttatagcagcatgatttataatcctttgggtatatacccagtaatgggatggctacgtcaaatgggatttctagttctagaaccttgaggaatcgccacactgtcttccacaatggttgaactagtttacagtcccaccaacagtgtaaaagtgttcctatttctccacatcttctccagtacctgttgtttcctgacttttttaatgatcaccattctaactggtgtgagatggtatctcattgtgattttgatttgcatttctctgatggccagtgatgatgagcattttttcatgtgtctgttggctgcataaatgtcttcttttgagaagtgtctgtttatatgcttcgcccactttttgatggggttgattttttcttataactttgtttaagttctttgtagattctggatattagccctttgtcagatgggtagattgcaaaaattttctcccattctgtaggttgcctgttcactctgatggtggtttcttttgctgtgcagaagctctttagtttaattagatcccatttgtctattttggcttttgttgccattgcttttggtgttttagtcatgaagtccttgcccatgcctatgtcctgaagggtattgcctaggttttcttctagggtttttatggttttaggtctaacatttaagtctttaatccatcttgagttaacttttttataaggtgtaaggaagggatccagtttcagctttctacctatggctagccagttttcccagcaccatttataaaatagggaatcctttccccatttcttgtttttgtcaggtttgtcaaagatcagattgttgtagatgtgtggtattatttctgaaggctctgttctgttccattggtctatatctctgttttggtaccaataccatgctgttttggttactgcagccttgtagtatagtttgaagtcaggtagcgtgatgcctccagctttgttcttttggcttaggattgtcttggcaatgcaggctcttttttggttccatatggactttaaagtagttttttccaattctgtgaagaaagtcattggtggtttgatggggatggcactgagtctataaattaccttgggcagtatggccattttcacgatactgagtcttcctatccaagagcatgaaatgttcttccatttgtttgtgtcctcttttatttcattgagcagtggtttgtagttctccttgaagaggtccttcacatcccttgtaagttggatttctaggtattttattctctttgaagcaattgtgaatgggagttcactcatgatttggctctctgattgtctattattggtgtataggaatgcttgtgatttttgcacattgattttgtatcctgagactgctgaagttgcttatcagcttaaggagattttgggctaagacagtggggttttctaaatatacaatcatgtcacctgcaaacagggacaatttgactttctcgtttcctaattgaataccctttatttctttctcctgcctgattgccctggccagaacttctaacactatgttgaataggagtggtgagaaagggcatccctgtcttgcaccagttttcgaaaggaatgcttccagtttctgcccattcagtatgatattggctgtgggtttgtcataaatagctcttattattttgagatacgtcccatcaatatctagtttattgagagtttttagcatgaagggctgttgaattttgtcaaaggccttttctgcatctgttgaggtaatcatgtggtttttatctttggttctgtttatatgatggattatgtttattgatttacgtatgttgaaccagccttgcctcccagggatgaagccaacttgatcttgggggataagctttttgatgtgctgctggattcggtttgccagtattttattgaggattcttgcatcgatgttcatcagggatagtggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcttggactttttatggttggtatgctattattgcctcaatttcagaggtgctattggtctattcaggggttcaaattcttcctggtttggtcttgggagggtgtatgtgtccaggaatttatccatttcttctacattttctagtttaattgtattgaggtgtttacagtagtctctgatggaagtttgtatttctgtgggatcggtggtgatatgccctttatcattttttattgtgtctatttgattcttctctcttttcttctttattagtcttgccagcggtctatcaaattttgttgatcttttcaaaaaaccagctcctggattcattgattttttgaagggttttttgtgtctctatctccttcagttctgctctgatcttagttatttcttgccttctgctagcttttgaatgtttgctcttgcttctctagttcttttaattgtgatgttagggtgtcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacccagtagtcattcagcagcaggttgttcagtttccatgtagttgagcagttctgagtgagtttcttaatcctgagttctaatttgattgcactgtggtctgacagacagtttgttataatttctgttcttttacatttgctgaggagtgctttacttccaactatgtggtcaattttggaataagtgtgatgtggtgctaagaagaatgtatattctgttgatttggggtgaagagttctgtagatgtctattaggtctgcttggtgcagagctgagttcaagtcctggatatcctttttaactttctgtctcgttgatctctctaatgttgacagtggggtgttaaagtctcccattattattgtgtgggagtctaagtctctctgtaggtctctaaggacttgctttatgaatctcggtgctcctgtattgggtgcatatatatttaagatagctcttcctgttgaattgatccctttaccattatgtaatggccttgtctcttttgatctttgttggtttaaagtctgttttatcagagactaggattgcaacccctgcttttttttgttttccatttgcttggtagatcttcctccatccctttattttgagcctatgtgtgtctctgcacctgagatgggtctcctgaatatcgcacactgatgggtcttgactctttatccaatttgccagtctgtgtctttttaattggagcatttagcccatttacatttaaggttaatactgttatgtgtgaatttgatcctgtcattatgatgttagctggttattttgctcgttagttgatgcagtttcttcctagcatcgatggtctttaaatttggcatgtttttgcagtggctggtatcggttgttcctttccatgtttagtgcttctttcaggagctcttgtaaggcaggcctggtggtgacaaaatctctcagcatttgcgtgtctgtaaaggattttatttctccttcacttatgaagcttagtttggctggatacgaaattctgggttgaaaattcttttctttaagactgttgaatattggcccccacgctcttctggcttgcagagtttctgccgagagatctgctgttagtctgatgggcttccctttgtgggtaacccgacctttctctctggctgcccttagcattttttccttcatttcaactttgggaatctgacaattatgtatttcagagttgctcttctcaaggagtatctttgtggcgttctctgtattccctgaatttgaatgtcggcctgccttgctaggttggggaagttctcctgtataatatcccgaagagtgttttccaacttggttccattctccccgtcactttcaggtacaccaatcagacatagatttggtcttttcacatagtcccatatttctttgaggatttgtttgtttctttttactcttttttctctgaacttctcttctcacttcatttcattcatttgatcttcaatcactgataccctttcttccacttgattgaatcagctactgaagcttgtgcacgcgtcacatagttcttatgccatggttttcagctccatcaggtcgtttaaggtcttctctatgctgtttattctagttagccattcgtctaatcttttttcaaggtttttagcttctttgcgatgggttcgaacatcctcctttagctcagagtttgttattaccgatcgtctgaagccttcttctctcaactcgtcaaagtcattctccgtccagctttgttctgttgctggtgaggagctgcgttcctttggaggagaagaggcactctgatttttagaattttcagcttttctgctctggtttctccccatctttgtggttttatctacctttggtctttgatgatggtgacatacagatggggtattggtgtggatgtcctttctgttagttttccttctaacagtcaggaccctcagctgcaggtctgttggagtttgctggaggtccactccagaccctgtttgcctgggtatcaccagtggaggctgcagaacagcaaatattgcagaacggcaaatgttgctgcctgatcctttctctggaagcttcatctcagaggggcacccggctgtataagatgtcagtcagcccctactgggaggtgtctcccaattaggctactcgggggtcagggacccacttgaggaggcagtctgtccgttctcagatctcaaaccgcgtgctgggagaaccactactctcttcaaagctgtcagacagggacgtttaagtctgcagaagttcctgctaccttttgttcagctatgccctgccgccagaggtggagtctacagaggcaggcaggcctccttgagctgcagtgggctccacccagttcgagcttcccggccgctttgtttacctactcaagcctcagcaatggcggacgcccctctcccagcctcactgcctccttgcagttctatctcagactgctgtgctagcagtgagcaagcctccgcaggcatgggaccctccgagccaggcacgggatataatctcctggtgtgccatttgctaagaccgttggaaaagggcagtattagggtgggaatgtcccgattttccaggtaccgtctgtcacggcttcccttggctaggaaagggaattctccaactccttgtgcttcccaggtgaggcaatgccccgccctgcttcggctcacgctccgtgggctatacccactgtccaacaagccctactgagatgaacccggtacctcagttggaaatgcagaaatcatccctcttctgcgtcactcatgctgggagctgtagactggagctgttcctatttggccatcttcaacacttggtcaatcttgttttactacacctcagatctatttacctacctcccccatcacggggctaccaccagagaattttgaagcaaatcctggacattatataatttcatccatttttattttatttcagtttctatctctaaaaacataaaggactaccttttttttttttttttttttttttttgaaatggagtctcactctgtcgccagggctggagtgcagtggcacgaactcggctgactacaacctctgcttcctgggttcaagcaattctcctgcctcagcctctcgagtagctgggattacagccgcctagcaccacgcccagctaattttttgtattttcagtagagacagggtttcaccacattggccaggctggtctcgaattcccgcccacctcggcctcccaaagttctgggattacaggcgtgagccactgcgcctggccaggactacctttttaaacaaccactataccattaatatcacattttataattttaacaataatcaaacacagagacattgttcacatttccttaattgtcttatgatgtccacacatcccaactggttgatgtctttttttttcttttagagacagaggtctctctttgtcacccaggctggagtgcaggggtgctgtcacaactcactgcagcctcgacctccccagctcaggcaatcctcccacctcagcctcccaagtagctgggactataggcatgcaccaccatgcctggctaatttttttttttttaagatgtggtctcactggccaggcatggtggctcatgcttgtaatcccagcactttgggaggccaaggtgggtggatcacttgaggccaggagtttgagatcaccctggccaaaatggtgaaaccccgtctctaataaaaatacaaaaattagctgggcgtggtggcatgcatctgtagtcccagctacttgggaggctgaaacagagaatcacttgaaccctgaaggcagaggttgcagtgagcagagatcacaccactgcactccagcctgggcaacaaagtaagactctgtctcaaaaaaaaaagaaaaaaaaagaaaagaaaaagaaagggggtctcactatgttacccaggctggtttcgaactcctgggctcacacgatcctcctgcctcagcctttcaaagtgctgagattacaggtgtgagacaccacacccggcctgatatgtctttttagtccatttaaacctacaagttcctggtccctttttattttccttgcagtttacttactgaagatactgggtcatttgtcctgaagtttccaaagtctagatgggctactttatattccagttcaataccgaactacctgtagttcctaaacatatcatgttgttacacacttttgtgcccttagcatagttcccctctttccttctaatatcctcttagcacagagctctctagacactgggctgtggaagcccagtgaggactctatgcaggtttcctcctcccctacttagccatacttacccaccacagttggctccattggtacctagatgcattcggggttcacttgaggcaagcttgatcagttcattccactccttctgccattcatcttctgtgtataccagccctgactgtgtgaaggacaggcaggggacattgggcaattagaggctgggttctaagaggcaatacctattccaccttattcactgttacttactccctaatcccttagcacttggtttacaaattgtactacaaagtcaaatctcttatctcttttacagtcaagatccatgaactaatagtctatgactattaaacttctttatcatccattctttttgacctactgcaatctgtcccatttctgccctccatcctgctcacccacctgccacataacatttcacctacctgattttggcaaagaacaatgaccttctaattgccacattcagtggaccctggttcccatcttagccttcacatgggttattttcctctttaaattttctttgccattagcgtccataaaattactttctattcctctaaattctgtctgcccccaaaatactagtggtgtgtcaatgattttcaccttggttccctctgggtgatctcttctactgccataatctcatccactaccatctgtatggtatataccatctatctccagcccagatttcttaatttcttttctttttctttctttccttttttttttttttttttttttttttttgagacagagtcacccaggctggagtgcaatggcacaatctcggctcactgcaaacttcacctcccgggttcaaatgcttctcctgcctcagcctctcgagtagctgggattacagcacccaccaccaggcccagctaatttttgtatttttagtagagacgggctttccccatgttggccaggctggtctcgaactcctgacctggtgatctgcctgtctcagccacccaaaatgctgggattacaggcatgaggcactgcactcagcctagacttcttaatttctatattcatatatccagctacctactggagactgccacctgcccatggctacctcaaactctgtaaagtcaaaatagaactcctgttttttcccaaacccactcttcttcctattttcctaccttagtgaatagcaccaactatcacccaaacatccaagctcaaaaccaaggaattatctaatattcctttctttctttcacccaccccacacctggataccttcttttttttttttttttttttttgagacagagtctcactctgtcgcccaggctggagtacagtggaacgatctcagctcactgcaacctccacctcccgggttcaagcaattctcctgcctcagcctcccaagtagaagtgctgcatacaaagcctactttctggcccctacccacttctctagtcagatatatctcactgaatcagctgtagttcctgaaatataccatgttgttttataccactgagcttttgtctaagctgttccttctgcctggagtagctcactttctgtcaaccttgtgaacaatttctcaacttttaggacagaactcaggtatcattcctccaaatagtcttctaaatctcccttggcagatcaaccactccttcctttgtatcctctctccctaactgctatagagttgttgttgtttttttgtttgtttgtttgagacaaagtcttgctctgtcacccaggatggagtgtggtggcatgatcttggctcactgcaacctccacctcccaggttcaagcaattctcctgcctcagcctccggagtagctgggactacacgtgcacaccaccatgcctggctagttttgtatttttagtaaagacggggtttcaccatgttggccaggctggtctcgaactaccaacaggtgatccgcctgccttggccttccaaagtgctgggattacaggcatgagccaccgcatccggccagcattaactgctatagagacgtctattgtaagagtcatacatgttataacctgttgcaattatgtatttacatgtccatctcctcctctatgctaggatcatgttttatgcaatacacccaaggtctattttgtgactataatcaataaacatatgctaagtgaaactacaatttttatcaaaggagagcaggcaatggtacaagcaattttaaaatacattggctttaggatgtatataatgataagggaaataagtttaacttattaattttatttggctgacattagtattaaaatgagtctatacggcttaaccgcacactgacagagtagaaggaaatcactggaaacatgaggggtactgggaacaaatttaatgggaattttttaaatgacacagctattttcaatttgtaaaatgctatcacaaattttacttcaattaaaaataaagagagcaatgcccaggttctatatggagtgctgcagtcactccaatagacacatccagatccggctccctcttcctggccggtttctgcttcctgttttaatgtacacagccactaggtggtgtacaacttctagccttaacatttaagaaactattactgagcctcaccaccaatttcaacataaaacaaggaagcccaggaaatcaaaacttatttagtgtggttttggtactggggagctaaaggaagcttccccagttcattatcctcctcctaccattcccactcccaaggtgggtaataatgctatgaatggtctaagctaagacaattatgaaagccacattttcagtatgaactttcactgtgctgagcaaaaggactaaaactattgctccattactagccactattctctatgcatgttggggactttcagatggaaaggctgactttgagagggaaaggctggctggccaaggatagaacgtgggtatttctgggtttcctggctaaataccattataatctaaccccatctttagaataataactaattgctttaataactggaattgggcacacttaattttctgggtgttgctgtcatttctacttaatagttggcatgttctggtttggccttttcttgcctctgcagtggttaaggttccggtattatctgaactcaacagtgaagaggacaaagctgactaccacaaaactgactactgatttgctctggattctaaattctaggctagctctagctcaggcaaaagctttccacgagatccagccaagcttttggtgctaaaaaagaatgtcaagtacttatgtggccttgcccctgtgggtttatttccctcaggaatcttctggggaagactggctgctcaaggagaggattctgatcttaatatcatctacttttaacaactggattatttgtttttgaggaagaaacatagcatgttctacttacatattaaatcttcaggatataaaattctaaataactaaaacaaaaaaactcttctatattgtcaagttatgacagcaataaaatgagaaaaaaagaaaggtggatgaaaaaggaaagtttctgaagagatattgccatactaaatgccagaaagatccagccataacatggcaaaaaaaaaatagatatacataaagagcaggagatataaacatagcacagaatcacaggaaaaggaaatagggagcctcattatttttatgtaaaggcataatgtcattattgaagggaagtaatcagcaaactttttctgtaaagggccaggtagtcagtaagtatgggctgtgcaggccacatgttactactgtgctgctggaggaagaaagcagttacacgtgtaaacatccaagaaatgcccagggctgtattctgataaaaggtttttttgtttttgtttttttttgttttttttttttcttacaaaatagccatagtttgcgcaacccgttttggagagggcaagtacaaacaatctgttgttactgccttatataacagcagcctcaacatttgacaaactcctgagaagtactgttcagactcaattaaataggtatgctttttgtgtgtgtgtgtgattagaatgctggttccttatgctttttaaaatttaaaataaactaaaactgagtatatgaaaaacaaatggtatatatgtcctaaaagattttaaccattcacatttctataggggctgaaaacataagtctttaaaaattgatctagccttattacaagcaaaaaaacaaaacaatacaaaaatcctatggaattgtcataactcattttgcaaaacactgccactaaaagctataaagcacctactgggggaaaagcacaatgttagataacctctctgtaggtctcatgcccaccaccagttctcatgaccacatcagaaggcatttaccccattggtgttaactgcattttctccaattttcaggatcataaggggagtcacactgacctaaacacttggaaatattttctactggcaggcacccagtgactttggcagcttggtaactttaggaaacaaggcgctcccacccacgctctcccacctctttattctgctgtgtctgctgccacctccagcgccttttcaacgcttccttctcaactcccttctccatcagtgcatacaaagctttccgcagcatcaagtcccgatcatggaaaccccacattcctgtggcaaaaaagcataatggtaagatacctcagcttgactctgctaatttttgtatttttagtagagatggggtttcaccatgttggccaggctggtctcaaacccctggcctcaagtgacccccctgccttaccctcccaaagtgctgggattataggtgtgagccatggcaccaggctgcaaataatatattaagttgtaaattgacttaattttttgtttatttggttttttatgggtttttttggttggtttttttgagacagagtttcactctgtcccccaggctggagtgccatggtgtgttcttggcttaccgcaacttccgcctcccatgttcaagagattctcctgcttcagcctcccgagtagctaggattacaggtgtccaccaccatatcaggctaatttttgtatttttagtagatacagggtttcacgatgttggccaggctggtctcgaactcccaacctcaggtgatccacccaccttggcatcccaaagtgctgggactacaggcgtgagccaccacgcctgaccttttttttttttttgagacagagtcttgctttgttgcccaggctggagtacagtggtgcgatctcggctcactcactgcaacctctggcccccggattcagcaattctcctgcctcagcctccctagtagctgggattacaggcatctgccaccatgcccagctaatttttttatttttagtagagatggggtttcaccgtgttggccaggctggtctcaaactcctggcctcaagtgatctgcccaccttggcctcccacagtgttggaattacaggcgtgagccattgagcccagcccttactttaaatattaagcctatttacagtggggcatggtggctcccacctgtaatcccagctacttgggaggctgaggcaggagaatcgcttgaacccaggggtggaggtcacagtgagctgagatcacaccactgtactccagcctgggcaacagagtgagactccgtctcaaaaactaaataaataaataaaataaagtaagtgtgtgttacaaaggactgctaaaaacatacctttttcatacaacaaaagaataaatattaagtagaattgtacacatacacacatctagctatacactgctggcttactcctactcattactcctggggtcagctttcaaagccagcccaagctaatatctgtgctctcttcactatctcactagcaaaggtagggctcactcccatttcctcttgtgccaacataaacacacagacacacacgtaagcatgcacaatctcgctctgaaccatcatttccgcctaagatcaaggttatctggatcaagtcctacacatgagatttgactcaactgcttcctttctgcaggtgaatggaggactgctttcaagactcaccaagggaggctgcatgcaggaggcagttcccatctccagtagttgccaaaggaagcagcctctgagaggtgggatccacactcacccaccagttcaaacgccctgtagaaacaagatagtggaggaaaaggagattatccatgaagcccttccaccttcctatttctgaaacagactccaaagcagcctcctctaggaggcctacccagaataaaaccatcacttgattactctttatatcttcctcacttatatctagtcagtcagaatcttgtgagcacaattggttagatcagtgagtagggtcaattttgtcccaaagggacactggcaatgactgaagatatgtttgcatgtcacaactggtagcaggatgctactggtatctaatgggtagaggccagggatgctgctaaccatgatataatgcacaaggcagcttgcaaaacaaagaattatctagaccaaaatgtcaatagtgccaaggttgagaaaccctgggttaaatgacgaggccaaggacataagttgaaactgttgactgcttggactggccctgattccttccctccactcaggagaccagtatgtatcacagcaacaaagctcagcaaaaatccatcatgaacaaaacaaaaacaactcaaagcatgtatttaaggtgttttatgagtatcatctgcatatatgacagcatgtcatcacgtgtggggtgtgactttaaaggaatgagcaataagataaagtacataaaatatccaagaaaataagtcttaattccatgcagtcatcccacaattgccaacccattatttacatgaggaaaatatcttatgagtgatgcataagttttcttgaactactgtggagcatagtttttgaactactgaatgaaaaactggcttataaactccccagaccagataatttaccaacttaaaaaaaaattacaaatagatgtatatggttaatatagaaggttacaaaatgaaaaataaaagcttcctttccatgccctcatctaactccagttcttatcccacacaagcattttaatgcctgattagcttttccaaaattcccagctgcctcaccctatgataagaattaattttaacaataatttaagataaacacaattacaaacgtaaatacatttggggggataggttcactactgtgcatcatctacagcattggtcatttctgttcacaagggtgttccagggccaattataattagttgtatttttttcatgtattgatttcgaggtattgattcctaggccttttcacatgtgtatctggtttctcttccatcaaccaggaaattcccagagtaaagtatctaatctgtatccattctttgacagcacaagtttatcccactgactcctgactttgcaatcagataacacacttaaactggaagctagcgatcaagtccagcccctccacaaggctgcctgtaggtggagagtagagggaagagtgtgggagaggaagcactcactgacctgcctgttccaaggcaaccagcatggactgctcaatgaggtctctctctatgaagctgcggaagtcttcattgtatacagtgagatctggaagctggaaggcacagatgggcatttccagggggtgctcattgctccccccacccccaccattggaggagacatgggaccgggccagggaaacaatgctggagctggcgtgggagatgcccctagacaggcgtttttctgcaatgagaaatggagtcaccttagaacatacacagcccacttggagaactctacactgatgtggtgatagttacctctcaacagggtttacagtcagagaaaaactaagtctaactgactactgaatttcagaaccctttttctgaagccaaatacaattggagaaatagagacagtatttttgtaggcactcacattagcaccaaattattcattcctctttctgcccttgtttggaatttgcctgatcttcccctccctctgactgtcttcctccacttccatatttcccagtgtgatagggacccattcatttagcaatttggtcattgtttggtgggaggagagggaataagggaagtgaggtttcactagactagagttagtcaaataacctctctggtaattctcagggtcttgggaaataccttttctaaagggtattttcattctagaaagattataaaagaaatccattatagaaaagaaaatcctttgggaggccaaggcaggtggatcacctgaggtcaggtgttcaagagcagcctgaccaacgtggtgaaacactgtctctactaaaaatacaaaaattagccgggcatggtggtgtgcccctataatcccagctactcgggaggctgaggtgggagaattgcttgaacctgggaggcggaggctgcagtgagccaagattgtgccactgcactcctgcctgacaacagagcaagaccccgtttcaaaaaaaaaaaaaaaaaagacaatcaacaacaaatcttacacatttgggaactttcttcctacatcaataacattaatttatattgcttactacaactactctcaatacccatatttatcagaaatttatagggacagtcaattcttaacagtctatagagaacaataatgtagatagtaccccacatcatttcatttgttttgaatacatgacacttgtaattcccaagcagatattccactgtgattataatttgctcaatgtagtattacagttcatttgtatggcttcaattatgtaatgatttaatgatgatccaaagggggcaaaatttcaaaagcatgttgggctgttcttaatacaacatttgccagatatgatacacaaaataaactgagttgtctaaagttatcttatagtgatgttatttttcaaatattttttagttttgtttgtttttgttctttgagacagagtctcgctctgtcgctcaggctggagtgcagtgctgcagtctcggctcactgcaacctctgcctcccaggttcaagggattctcctgcctcagccttctgagtagctaggattacaggcacacgccaccacacccagctaatttttttttttattttagcagagacggggtttctccacattggtcaggctgttctcctcaaactcctggcctcaggtgatctgccagccttggcctcccaaagtgctgggattacaggcgtgagccaccacacccaccttaaaaatattttttaggtattcgtaggctgagcatggtggctcacacctgtaatcccaaaactttgggaagccaaggtagaaggatcacttgagcccaggaattcgagaccacctgggcaacagagtgagacctaatttctacaaagaatcaaaaatttagctaggtgaggtggtgcgtgcccatgctcccagctacttgggaggctgaggcagtaggatcccttgagcctaggaggtttaggctgtagtgagctgtgttccaccagcctcactccagccttggaggacagagcaagaccctgcctcaaaaacagtaccatgtgcctatggtaaaaaatcaatataccatcaaaaggtataaaatgatttcacaaggaagtcttcttatcattcaaaattcctgatcccttccccagaggcaaacttttgtatccttctagaaatttttatgcatacagaagcatatacaggttttggccgggcacgatggctcacgcctgtaatcccaacactttgggaggccgaggcaggtggatcacaaggtcaggagatcgacaccatcctggctaatacggtgaaaccccatctccactaaaaatgcatgtacagcttttaaaatcatcttttaaaacgcaaatgagagtatactacatacattgcattgtgtcttacctttttgaaaaaaattatatatttttttatatggagtctcactccgtcacccaggctggagagcagtggtgcaatctaagaggtttactacaacctctgcctcctgggcttaagcaagtctcctgcctcagcctcccaagtagctgggattacaggtgtgcaccaccatgcccagctaatttttgtaattttagcagagacagggtttcaccatgtaggccaggctggtctcgaactcctgacctcaggtgatccaccagccttggtctccaaaagtgctgggattacaggtgtgagccatcatgcccagcccccttctgaatagattttagaaatttttccaaaacagtacaccaagttctgcctaattctttctaatgattgcagagtattccacaacatggatgattacaatttacttaaccattcctttactaatggacattaaatgttttcagggccaggtgcagtggctcacacctgtaatcccagcactttggggggccaagtcagatggattgcctcaagaaaaaaaaaaaagtttcaagatttaattattgtaaaataatgctgctgtgaatatccttatatgctgcatttatgtatttcttttttttaatttttattcatttatttatttttttttttgagacagagtctcactgtgtcacccaggctggagtgcagtggtgtaatctcagttcactgcaacctccacctcccaagttcaagcaattctcctgcctcagcctcccaagtagctgggattataggcatgtaccaccacgcccagctaatgtttgtatttttaatagagatggggttttaccatgttggccagactggtctcgaactcctgacctcaggtgatccacccacctcgacctcccaaagtgctgggattacaggtgtgagccactgcacctggccttatgtatttatttagagaatacttatgtgcacatacacatatatgataaattgctagatatgaaattgctaagtcagagtacatatgcattttaattttgatagatattggcaaatattaacaaattaccccccaaagaggtaatgactctttcaattctacctttatgtgaactttatatcaacaaggagattgttatcctccttcctctatttctttcacagtatctgaggaaggcttttatacaggataacactaaagatgcagagacgcagtgagggactgcagcacctgggcagactgaggccacctcagtctgggtttggctgggagaaggggaagaaatggaatcacctccaatggatcactagactttatgactccatttaacaatcccctcccttcctactccatatacggaaacattccagtcaccccagtaccttgaacgatgtcatcctgccgctggaggatgggtcggggagggcgagtaggctctctgtcagaaaaccctttttcaggggtcctggagccaccactcccctcactaaaggatgggggtaggtttccagcatggacttgacgtagctgttcaaaatcactgagggcggcattcacatcccaattctttcctgtcaggagacaaagcaaaaagcaaactgtgcaaccatagtatagagacacaaagatcacactaactatcctatcaaaaccagtatgcaaatacgcatgcacataatcattcttcttttccttaccctgctttaattttctttataacacttcaatctaacttatcaaatgtctttacttacttatttgttgtctatttcctaagtaagtgccatgaaaatagaaactttgtccctctgaactaaaagagcccttaaagatctagtaaccgaaaattaaaacttccttttacagataaagtctagagaagtaaattatttgcccaaagtcacagctagttcacaccagacccagcaggactcaggcccaggtctcctaattctgagatccaaagaggttcttagcctacatgtactctagtgtgtcctaaaccactaaacctgcatataagatcatgggcttgtgcattttctagtgaaagagttcatagctgtcatcagcttttcaaaggaaacagtgtttcccccaaatttaagaatcaccattctactaaagaaatgaccttaaatgataagatttgtcataatggatttttctgatgctttctccagctaaattattcaacaaatatgcattgtataattgctcacatttctttctgttgtattccatctactaccaccttaattcaattcctatcacctactgtcctacctccgatccattccaaagaatcccatgagattaatctttctaaagcacagttgtgatcattttagttccataatcgagatttttaatggcttaccactgcctacagaataaaactcaggctctttggcttgatactcaaggctttgtatgtcctggcctacttttctggcctcttctctgtgcttcaatttccttatccgtgaaaatgcagatgatagtagcagtgcctacctcatagagctgttatgaagattagatgagttgaaagcacttagaatagtggttggttttactcacaattttacgtctaaatcattactgatgattttacttctaaatcattacattagccaattgttctgactccctttgctcactctgttccagtcatcactgaccttgctgttcctagaacatgctaagtccactctcactctagggcctttccactgactattccctctacctagaaggctctttccccaatatatccacacagacaactcctcattagctttaggtatttgcttaaacatcacattgttagtaaggcctaccctgacttaaaaatcacaacccacttcatcattccctttactcttctccatagcacttaacagtttataatatactttataatttacttagttatcacatttgttgtttattgaccctctctcctgctagaacatgaaggcaggtatttttgtttgttttgttttgttggagcatctagaacagtacctggcacacagtagtcactcaataaatatttgttgaattaatggataactcttctcctgaatcaatgcatgaacgagtgacatctgccttgagcatcggatctatacttccaactgtctgcaaatctccttaaaatcaggtcttcctaacaatccacatggccaaattgagtatccatcattttccttcccaaaacttgctgcttctcctcttcctatgttccctaaatcagtaatggcatcacaatccctccaggccctgaaacttcagtcatttttagctcctcaagtttcctcagattgcactcttcctcttccctcaccaccaagtcaatttgtacccctaaaacatctctcaaatccatttcttattatccatttttattgccactgccccatttgaggtcctcataatctttacttagtctttggtcttttaggaaggaattctctatctggtctctctgctcctaatctctttcctttctaatttgttctttataatacgatagtttacttttgatttctttctctcattttcaattatcagtattgaacagtcccattagccaggtgtggtggtgtgtgctcgtggtcctagctactcaggaggctgagatgggaggctcacttgagctcaggaggccaaggttgcagtgagctgagatcacacaactgcactcctgcctgggtgacagagtgagaccccatctcatacaaaacaaaacaaaaatcaaatagtcctattgaaatacaatcagttaactgttgttgttgttgttattgttgtttttgagatggagtcttgctgtgtcgcccaggctggggtgcagtggcacgatctcggctcactggaacgttctcctcctgggttcaagcaattctcctgcctcagcctctcgagtaactgggataacaggcgcgtgccaccattcctggctaatttttgtatttttagtggagatggggcttcaccctgttggccaggctagtctcgaactcctgacctcaggtgatccacctgcctcggcctcccaaagtgctggggttacaggtgtgagccaccgcacctggcctcagttaacttttaaaagaaaaaacaagcaacagagagaaaatgaggatgaggtccttttatgccccttctaattttttttttttttttttgagatggagtctctttctgttgcccaggctggagtgcagtggcatgatctcagctcactgcaatctccacctcctgggttcaagcaattctctgcctcagcctcccgagtagctaggattacaggcacgcgtcaccacgcccggccaagttttctatttttttagtacagacagggtttcaccatcttggccaggctggtcttgaactcaacggagtctcgttctgtcacccaagctgaagtgcagtggtgcaatctcggctcactgcaacctctgccctcctgggttcaggcgattctcacgcttcaacctcctgagtagctgggattacaggcatgtgccaccacgcccacctaagttttttgtatttttccttctaaattatcttaattccacctccttctatctattgctaccaccatagtctgcaacatcatcatctgtcacctgaactaaggcaatattcctaactgttttaatcatttcttctctggccagagtgttctctacaagtacattgttaaaaactcaaatccaatcatgtcactcccctgattaaaatccttcaccagtttcctagtgaacttaaaataaaatttaaactcctcgtcatggcctacaaaggccctacactctttttttcttttatttttctttttttttttttcttagtaactttttttttttttttttgagacagagtctcactctgtcaccctggctggagtgcagtggcagaatctcgactcaccgcagtctctgcctcccgggtttaagagattctcctgcctcagcctcccaagcagctggaactacaggcacccgccaccacacccagctaatttttgtatttttagtagaaacggggtttcaccatgttggccaggctgatctcaaactcctgaactcaggtgatccgcctgcctcagcctctcaaagtgttaggattacaggcataagccactgcacccagcctctttctttttctttctttttttttttaagagatgaggtcttgctatgttgcccaggctggtctcaaactcctgggcttaattaagcgaccgtcccacctcagcctcccaggtagctgggattacagtgaatgccaccacacctggctagagcccctattttctgcttcctgcctatctcaccagcttcctaccacttttgcaccattcttactacctcattattaatagtttctccaatgtgccaaactctcttgcaccttagggcccttgcataaactgtttattctgcataaacactctcttctacatccctttgtcttgctgctcctacttgtccttcagggctcagcttaaaaatcactcctcggaaaaggccttcctgcactctagatctaagttagggttctttcttcactctcacagcaccctcaatgtttctttcacagcatgagtgtatgtgtgtgtgcacacatgtgagcatgctagcaataatttgtaacataattgcttacagccatactctgaaaccagattgcctagattcaaatcctacttaaacctcactgagcctcaggttttaaaattattaactccaggataataaaactttattgtatggtggttgtgagaataaaataacatatctcaagtacgttgcacatattgaacactcataagtgttcaacacatgttataagaggaatgcagaaaggttaaggattttatgaaagaggaaacatttgagctgaatcttgaaggatgaggagaatagaggaaagaaatgctccagactgaggaagtaacctaacatgatcaccaagaggtgacaagtcaggcctggctgcataggaagtatagggaaaagtagtaggagaagaaactaaaaatgcaaattaggctgggcagggtggctcatgcctgccagcactttgggaggctgaggtgggtagatcacgagtcaggagtttgaaaccagcctggccagcattgtgaaaccccatctctactaaaaatacacaaattagccgggcatggtggcgcgcgtctgtagtcccagctactggggaggctgaggcaggagaaacgcttgaatctgggaggcggaggttgtggtgagccaacatcgcgccactgcactccagcctgggcgacagagtgagactctgtctcaaaaagaaaaaaaaaagaaaatgcaaattaaggacaaagttgtactaaattactaaactggaatttaaaccctgatcttctgtttccaaactcatgctctcctcacgggtagccaagcaaatgtctaattgtcacaccttgctaagggctggcaatttaaaatattacctatgtatgctaagaacttgccccttccccataggcctgcctgtttgtgtcattacatattttcatctattatttgtgactctaaacagaatcctagggacatgattctaacccttcaggaccttaaaatctagaacattcagccaggcatggtggctcatgcctgaaatcccagcactttgggagaggccgaggcaggcggatcacctgaggtcgggagttcgagaccagcctgaccaaaatggagaaaccccatctctactaaaaatacaaaattagctgagtgtggtggtgcatgcctgtaatcccagctactccggaggctgaggcaggagaattgcatgaacccgggaggaggaggttgcagtgacccgagatcgcaccattgcactctagcctgggcaacaacagcaaaactccgtctcaaaaaaaaaaaaaaaaaaaaaaatctagaacattcaaacttatgtgtataaagatataagtaaacaaaagcagcaaaatgaaaacattaaattgattcactcaacatagaattacccataatgtatgttatgtaaggaaagaacaaaaccatggatgatcccatcatgaaaaccctaaagtcacttctatataaagaggaagtcttacagatctaaaattatgcttttaggccgggcacagtggctcatgcctgtaatcccagcactttgggaggccgaggcaggcagattacctgaggtaaggagttcaagaccagcctggccaacaggtgaaacttaatctctactaaaaaatacaaaaattagccaggtgtggtggcaggcacctgtaatcccagctactcaggagtctgaggcaggagaattgactggacctgggaggcagagactgcagtgagccaagatcatgccactgctctccagcctgggcaacagagcgagactctgtctcaaaaataaataaataaaataaaataaaataaaattatgtttgtaatggactaatataaaatttcacttgcattgcctgagcataaactgacaatggagaaaactaccccagtaagttcaaggtgaaaaagggattttaaaatttctaattatgacgggttatacacaaagtatatcattagaattaactatagggcctaacctacacaaagtatcttcctgatcaccttaaatggtccaaatcatcctaatgataaataccacattttactttctcttttctcattctcccctacaactcctcaccttctaggagatctcgcgctagccctggctctgctcctgtggaacggacaaaatctgacagaacagcatccatgtccagggtcatgtgatcctcaagtactttcagccagctggatgtaggtagaacatagatcaaaattcaggcctccacctgaggaataaataaatacataaggctcaaattacactggaacaggataatcacagtcccatgtcagcagcttcctaaccaaatggggaaactatcctagctcattcatttcagttgaattttaaaatacagcactttaaaattatgaagagtaacattttatttcctaactcttcattaacatctcaacatctacattaaccaggaacctgtaataccactctgaaaaatgcttttcctgtacttttcctgagtactgcttttctaccatgagtttgcttacccaaactaaagaaggaagcaacaggctaccaccctaaagaactccccacctgcaatagtctctaacatggcacctttgtgtatttccttactggcacttgaatactctcaaattattttaattagttgctgtctagccatctcctctaatatatgtttcttgaaagcaggaaacttgtatgtctccttcactaatgtatcccctgcacgtatcacttggcacagtgctaggcacactggccctcaataaatatttgttgagtgaatgaacaattactatacactggataatttcagagttgactagtgttttgatgctagcagaggagtaaactgatagctaaaattactcaaaatacagtattaggccaggtgcggtggctcacgcctttaatctcagcactttgggaggccgaggcaggtgtatcacctgaggtcaggagtttgagaccagcctggccaacatggcgaaaccctgtttctactaaaaatacaaaaattagccaggcatgatggcgggcacctgtaatcctagctactcgggaggctgaggcaggagaatcccttgaacctacgtggggcagaggttgcagtgagccgagatcacaccacttcactccagcctggtcaaaagagcgactgtctcaaaaaactaacttaaattaaattaaagaataagttattccacaaagcagagtggggacccaaaaggttcataacaagattcaatctctgtccattaacctcttgaacccaggaaacacatctactccaaacacgtctttctccacacaggacagatgactgtcaaataagttcaactgaaaaagatctcttctttcagactttggcagaaactatgtccctaacctgacagcctggcaccaatccaacattcctctgaggttaaaagtcagagggaagcaataacagagtaaagaacaatctctgatcaaattctgccaagtttacagctttctatagaagactcattcattaagttgccaggtacacttgccctaccatacccaccaatcccctgccttttgggaaaggtcaaagcataattgttgaaggcaaaaagtggcaaggcaaataaacaaaaaagatttgtgggttataaaaccagcaggtcactaacttgctaacactggattttttttttttttttgagacagagaaagatggcaaaatagaaatttttctctcttgtcctgttctaatagtacaagagatccatgagcgcagggacacgatttcttcatttttgtaactccaacatctagtgtagcatctataatatggtaggtagtcaaatgcctgatgaataaatgattcaatgactaagccaatttccacatcagctaccaacaaaccaaccaatttgaagcttagcagatcagaaattctacggcacttcttatcaccattctatttctaagttttaaaaactctcctttccaaagggacatcaaccatgctgtcacaactcttacctccctcacactacatgagtttacctacatacacctatatgtattaactaggtgactttggtcaaattacttacagggtttcagttgtctcttctataatctagacttgtattagatgactcataagatactttcaaggtttaaaaaataaacttcttcagttcactatagcctcatgatctatgatctttgactatcattctagatattgtcaattttaaatttacctgagtttcaacatcataattatcagaaagaattactaatacataaagaacttttggtctaagatacctcaaattcaaaatgtcaaattcaaaatgtcaaattcaaatgtcaaattcaaattcaaaatgtcaagtcccttaccttcaggaattaggaattaaattccttcagaattaatagatgaatgaatcctccccctaccccccagtacaggcaagaatttcttctccaaacccattttagccacagccttaggtcagaggaagtggtagcagctcaaataacttatacacatgaataatccaaaaccaagtgtatagctgcaaaataaatttcaatcttctctctttaaaaaaaagcaacgcaactgtaaagccattttaataactttctgaaagaatgtgagaaatatacaataagtacacaaaatagtaatcacaaacaggtgctcagcaaaaaggaaaagagttgactaagccataggcatacaggcaatttcacagccagacagtcttctgggtgagagaagtgaatgaaaactagtgttatggcatcatagatctcacatgtcaacacagcacacaggctattcttctcaaaaaacattttaacaaagtaatttagaggttcaacattatctagaatgccttgctctttagcaaaaatttgaagcactaagccaaacttcctaacagcacattcttacatttgatgtctccaggtgcatgctgtggaccctgacctaaccccacccaacaggtgagaacaacagcttttgttacatcaccactaataccttgcttaagcttttcaaattccaaatggagatatcaaaccaatgattaaaacacagtgtttgggccgggcacagtggctcacgcctgtaattccagcactttgggaggccgaggagggtggatcacctgaggtcaggagtttgaaaccagccaggccaacatggtgaaaccctgtctctactaaaaatacaaaaatttgctgggtgtggtggctagtcccagctactagggaggctgaggcagaaggatcacttgaaccaggaaggtggaggttgcagtgagctgagatggcaccactgcactccagcctgggcgacagagcaagactctgtctcgaaaaaaacaaaaagtttgggctgggcacagtggctcatgcctgtaatcccagcactttgagaggctgaggcaggaggatcacttgagcccaggagtttgagaccagcctggacaacacagtgggaccctgtctctaaaaaccttttttaaactaattaagcatggtcgtgtgtgcctgtagtcccagccacgtgagtggctgaggtgggaggattgcttgagcctgggaggtcaaggctatatagtgtgcgacaactgtgcccctactcttcaggctgggcaacagagtgagaccctgtttcaaaaaaaaaaaaaaaaaaaaagcaaaccaaacacacagtttttggctctgtctcagggaggaggaggaggaggaagaggaggaggaagaggaggaggagggggagggggagaagaagaaaagcagtggctttcaacctttcaaataaaacagaggaggttttcaactatttgttaactgaatggtgtaaagacagctctcacctggcatcatcttccaactgaaagggactttagcaattacgtaatccaaatacctgcccccatgcaagaatccttctattacatctctgacaaatcacatagtctccacttggatacaaggtctgacagggacctcattactttgctataatgtctactttattactggacagctttaactgttagaaaatgcttttctaaactaaaacaaaagctatcaccagcctcacaccccaactataactttcacataccggttttgattctgttctccaggacaataaaatctacttcccaaggatgatggaattttcatgcaaaattgttagacaaagcatttctttacataaacatttgttgtagatcagcatcatgatgttgttatgagccaaacagtggccttattttacaaaatcctgtcttatatcagtacttgcttgtacctatattcattcataaatatttgtgctgacctcattgtataaacttaacaggctgaataaattatgttgttcaaaattcgcttctgctatctttgcctctcacccctacttccacttccagaccatcttgaagtaatgacgcagtcaagaataaaaactaacaagttaatattagttaagcacttctaaaaacactcttactcggccaggcacagtggctcacgactgtaatcccagcactttgggaggccgaggcaggtggatcgcaaggtcaggagatcgagaccatcctggctaacacggtgaaaccctgtctctactacaaatacaaaaaattagccgggcgtggtggcggacgcctgtagtcccagctacccgggaggctgaggcaggagaatgacgtgaacccgggaggcggagcttgcagtgagccgagatcgcgccactgcactccagcctgggcgacagagcgagactccatctctaaataaataaataaataaataaatataaaaaataaaaacattcttactcattaatgacaaaactcttgcagcaggtctcattattcccaatttataaacagagaaaaaaaaaagacttcaaaagtcaggtaggtggccaaaagtctgaacctagatagtctgaacccatgctctttcactgtaccatactaggggatgcattactgattcctggaactcccctgattcttgcccatttaatttgttcaccataggaaaaggttgtgcctatctctcgtatttatcaaagacttaaacacctgccttatataactttatttatttatttagagacaaggtctagctctgtcacccaggctggagtgcaggagtttgatcttggctcactgcaacctccaccccccaggctcaggcagtcctcccacctcagcctcctgagtagctaggaccaaaggcacttaaataactttaaatcctaccatcttcctgagcaatttcagtatccatctgcacaactcgcctaacatttctgccttagaatttcattatctcttctaatactaagaccacctccacaacaacaactcaaacctggaccctgccatgtcctgaaaccattccacctctaaatcttaaactcaaacattttactctggccacaacctcatctccttccagcttctcctctctactttttttttttttttttttttttttaagacggagtctcgctctgtctcccaggctggagtgcagtggcctgatctcggctcactgcaagctccgccccccgggttcacgccattctcctgcctcagcctcccgagtagctgggaagctgggactacaggcgcctgccaccacacccagctaatttttttgtatttttagtagagagggggtttcaccgtgttagccaggatggtctcgatctcctgacctcgtgatccacccgccttggcctcccaaagtgctgggattacaggcgtgagccactgcgcccggcctcctctgtacttttaaacctgcctgctcactaagacatccagtctcttaaccaccttattcattaattcaacagaagtatttggagtgcctttgtgtgaggcactatgctcatgagtaaaaacacaacagtgaactagacacaatccctatcctcaaaagcttccagcatggaggaaaaaaccacaaaatcctaccatcttcctgagcaatttcaacaaccacctgcacaattcatctaacatttctgcctttcataatcttttcaaatattttcacaaacaattataataaagcaatgttagagaagggagtgttatctcctatagggagtcaggaaaagcttccccaaggaaattatgtttcatctatgaattaagattaattaagattaagcagcaattggagagacaaattgggaaaggaagaacgctccaagcagaggaaacatgcgctaaacttccgtggcaggaaggaacataaagatgagaatgttgctacaggaggatgaagagagggcctagtggaccctgttaaagatttgagatcttatcttaaatataatgggaagccactgaaaggttgcacgcagaggtagaacataatcagatgtgaattgttaaaagatcaccctggttacaatgtgaagagtttggaagaagcacagtggatttagggagagaattgattagaaaattcttgcaaaatagcgctaaaccaggataaaagcagtgaaggttgagggaaatggatagattccactttatctcttcttacctaacaaagtaaaaccaataattgatcacctaatttactttcctgtgaaaatttagtttccttatccatttcatctgtccaacttggatggatcccacattctaacttccctgctaaccttgcagagcaatatgactactaacatgttattcagccaccttgcttttattgaaacactgctatctttgctttagtacctcaatcaatcttctgagctactatcccataccttcaccatgctccttgagcctcccacccaagccacatcacctccccttactcctgtcaaatgaccttgcctcctacttcacagaaaaaaaaaattacaaagcaaagcaagaggggttcctttaggtttcctcccctgctcctatttgttggcggttactctcctcttccctgcaaatctccttgtcctcaacctacaaaaataggcttctgcagaaagagaatggcactggcttatatataagatgaacacaatcatccttacttctgctctctttgtagcatttgacacttactgaccactcttcctgcttctctggccctgtgtcttggtcgtctttgtggactcccatttctgtgactgaaccaaacttagtgcacccaccattctagccttaggccttccatcttctcattgaaacttcattcacagccctaagcacccaaatgttcatgactccaaatgtatctgcacccccaaattctttccacctcacctgggaatcatacaggcacttaaaattcagtatataaaaacatgagcttattctctcatctctgtctcccatcctttcaaactattcctcttccagtactgcctattgtagcaaatagtccccaatcatccaagtcacaagccagggagccgccctggacttctctcttgccttatccacacaaataatctttcactaagttttactaattttaccttaaatatctctcaaatccctgcaaaaccttccacaggctacagctcttttattctatctcaggttttcataacctgcaccccaggaaatagctccctaactcctccctctacctctctccgtcaattgattggcctccacaggcaaccactatgagcaatttaaaatgccagtattatagtattacatcccactgttctaaattcttcaatggattttcaatggctaaagcctaagactcaaattcctatacagaggccaggcacagtggctcatacctgtaatcccagcactttgggaggccgaggcgggcagatcacttaaggtcaaaagttcaagaccagcctagccaacatggtgaaaccccatctctgctgaaaatagaaaaattagccaggcgtggtggtgtgtgccttttatcccagctactcgggaggctgaggcaggagaatcacttgaacctgggaggtggaggttgagtgagccaggatcatgcgactgcactccagcttgggcgacagagcgagaccccatctcaaaataaacaaacaaaaaaacaaattcctatacagggtcgggcatgctggctcacgcctggtggcttgcacctataatcttagcactttgggagaccacggaggaaggatcacttgagtcctggagtttaagaccagcctgagcaatgtagcaagaacccatctctacaaaaaaattaattaattaatttaattagtcgggtgtggaggtgcactcctgtagtcccagctactcaggaggctgaggtgggaggatcacttgagcacagaaggttgatgctgcagtcagccatgatggcaccactgcactcagcctgagggacacagtgagaccctgtatgaaaaaaaaaaaaaatctatacaggacaaacaaggcccttcatgatctggctctacctaattctccagccttttctacctcccattattcccttccttgtactgggagttcccgaagtgtactatgtgcttcaaatctcagtccctttgcacatattgttccctctaactggagtaactcctaggtgtagcaggtgaattctcacctcttctttaaaactaacttaagtactacctcatttgcaaaagttctctgacttcctaaattgcccacttctttcttggtgcccccactgcaccctgtatgctacttctaccataatgtttatcaccctgcatggtagttgtgtttatttacatgtttgtctccccactaaaccaggaacaatttgagggcaggaatcttggcttgttcatccaatattccccagcatccaagcacagcaggcaatttttgttcagatgaactgaagtatatttgtatggtaccccatcacacacacacacacacacacacacacacacacacagtactgttgatagtctatcagtgttgtacacagacaagtctaaaacagtaactcatctcaaagacatatgtttaagattgttatacgactttatttgcaacaaatttctcttcctaaacattgtttagctcagagtaatattaaaatcagtctgcatattccaagtgtccaacttacttaataacagagaaaaatgacccaaaattaaagaccatggataataaccctctattaaaatgccagagaaactactgaccgtacattctctcatttacaacatcccccaaagcttccagagtttcactctctaaccgtctcctgattccactgaagcattagagctgcatttgagtcctctccaactcttcccataactcactggaaaaccacaacattcaagactgtcaaaaactttaaaaagtcagagactcctccatgtctatgatgtcagtcccaaggaatccagacagagagaaagaggagggacagaggcacttagaactttcacataattcttgattaggtgggagggagagatgaataattgtcttggcaatttgtttttagttaatatgggtccttcaagtcaaagaaacaaaatataaccttcttagaaaatatgaccaattttactatattttttcttttttcttttatctgtggatctagtcctgaatccagaccaatcctactctaaagggatctatataacactaaatgttacaatccagaagtaacaagatgagtctcaaagtaagaagagaaagaaagtaatatgttttaaagctttagatattatttcatttaaacttccaaacaactctgagaacttggtattgttactccacatcacagatgaagatactaaagctcacagaggttaggtaatatgcccaaggcaacacaggtaaaagtggcagacccaggatttttatcaacccagcccagctgactccagagaacatacgctcacatacaatgccacattttgtccagggaggaggactaagaaaacacgggcagtccaccatgtggaagtccaccctcactgcttcaactcctctcaactccacatcagaagaaagaactggctctggattcagacagatcttggttccaatcccagagctactatttaagggctgtgtaatcataggtaagtaatataaccattttgtgcctcagattcttcatgtataaaatgggggaaatgtatgcatttcagccctcctgttaggattaaataacatacgtgaagccttagggcagcttattgatatacaataaatcctcaacaattgtcagttgccttctttctgcccaattcatttccatacactctcactccactggtgcccaacatagccccctccctgtatctttcctttaaaagcttcctctacccctcccaaacaaacccttcagtcccacgaccatttccaaaacagagtcttgacacatacacacagtgcccagcccatcatttccaatccagtgtctttcaactcaagccttcaagaaaataccctaaagggggtcccttagttgtaccttccaccagatggtctctcaaaaataacagcaaaagaaaagtgtctgtcccttcctagatgtacacagctacatagctcattcattcccaaatctccaggaacagcaatttcatacatatttactggaatcccaatgtcttaatctaccaatcctacctcccccacctgtacctcttactacttctactcattccaggttcaaagattttgtaatagtctcttaatctcatgtatattatctatttttttgattattggaaggaaatgtttacatatccttctactcaccctgcatacttctgggttgttttctacctctaatgcaggatatactttgggaatgtctactttctccccctaagtcaaacatggaataaaaaaaaaaatctcaactcaatcatataaccactcccaaaacaatttatttgtttatcatatgctattgtggatacacaacattaaggtctcaggaactagtccctggtggcttcatcactaccactagtatgtgtgtgtgtcagaaaaaaatttaactattttttcaagaatttctagttttgtatcaggcctacaaacagcaggcctgatataaaactccaacagacaaatcccatcaataaccaaagggtaatataaagatcagggactagtgaacagagaacttggaaattggcatttgtctcttcagtgctactgataaaggctccttaaattacagttatttgggaaatttaataatttggaagacttgcaaaagggaagtaatctttgggaaaatgggggcagggagagtcatacagaaagtctgttattataatattggcacaacaatagtagcttaaatagaaacaagaatcatgtcaatgtttattttttttagatccagaccagcatgtctatttgcaacacacaatgaactgttttattcctttcaactaaggccaaggatagtccaaggtttgggctctcaacaaattcaacttttaaaagaataacctgcaaaaacaaaagttctacttgacctattaaagattctaatcattgaatttttcacacaagagaaaaaaacactataaatcaagagactaggctaatagcaaaacacactatctctctagaatcaattctcaaacatttattcagtagctgacaatcttctctccctttcttgatttctttagtcatttcactataaattacagaatttccattcaaggggagaaatagaagaaaaaaattcaaattactatactgtctactcttggttatccacaggaaattaatccacttcataaatttcttctggtaaattaatttccctcagcatacaagtactaattaatttcttataaagcctcaaaacaggccgggcgtggtggctcacacttgtaatctcagcactttgggaggccgaggtgggcagatcacttgaggtcaggagttcaagaccagcctagccaacacagtgaaaccctgtcttcactaaaaatacaaaaattagccaggcgtggtggtgggcacctgtaatcccagctactcgggaggctgaggcaggagaattgcttgaacctgggaggcagagtttgcactgagccgaaatcgtgccactgaactccagcctgggtgacagagtgagactctgtccaaaaaaaaaaaaaaagcctcagaacaattagaaatttgggccaggtgcagtggcacacacctgtagtcccagtgagacccatctctacaaaaaacaaaacaaacaaaaaacccacaaaaattagctgggcatggtggcacacactgtagacccagctactcaagaggctgagccaagaggatcaatcgaggccaggcattcaaaactgcagtgagctatgatagtgccattgcactccagcctgggtgacagggtgagaccctgttaaaaaaaaaaaagaagaagaagaaggtggggggcggggggagggagggaaatttgtcttttataaaattatataattcagttaaaagatggatacttcttattactatcgtcattttttaaaattctccatctttaagttccatagttccatctttgctagccatacttaaatctcatttgatctataggcccagtattcaaaacatccacctggcatctgctgttattatttactgtcttgtgatactagttgaccttcctgatactcacattttaactctccaatctgactatcagtcattcattcaaaatttaccaagttggtctaccatctaccaggcactgccatggggcctggagatatcccagtcttaccttcaaggcactctgatctgatgagagaaatataaacatgttattagtgcccattgggataggaagagatatagaagcaaccagtttacccaggtgggttagggaagcttctaaacttttagccaagcctttaaggacgtgtaaaagctcaccaggatggaggacaagaatacattcaagacagaagtaagattcttgaagtctgcacctttcttttatacttgaaaacattctaaacaggcctaacacattgcttagcacatagtagatgcctagcaaatatttgtggttctaaactattcatgctagtccgtatatgtggataattgagagttatctacacctaaaataggcttgtgagttacatactggtttcaaatttgtcccatcaagatgtataaataggtctatatgaataaatataacttatatttgtatagctgtctgttcactaatagcttctctgttataattttttgtttttaaagcactttcataaataacctcataataaacatttttcaaattaaatactttttgaggtttttaatcccatctattctgatggaaaacatatacacatagaaaagtttacaaagcttaggccaggtgcggtggcgcatgcctgtaattccagcactttgggaggccgaggcaggtggatcacctgaggtcaggagtttgcgaccagcctaacatagtgaaaccccgtctctactaaatacaaaaaattagccaggcatggtggcacatgcttgtaatccgagctacttgggaggctgagacaggagaatcgcttgtacctgggaggcagaggttgcagtgagctgagatcgcgccattgcactccagcctgggcaacaagagcgaaactccgtcgcaaaaaaaaaaaaagtttacaaagcttaaatgatacccagatagcacagaggttgggcctatgtattcggacttagaatgcggggctcatatcagttttctagggatttatagcaaaaccagatcagtctagatgtgcaaaccccacaggctaaataactcttactattttgttttttaaaataatatccatattcactacattgtctcctagccactactaccctccccacctcccaccaaccccacaaacacacacacattttccaggttggtgttaaaaagcagaaactctaacccagtgtatcctgggcactatttggccctctcatttctactgatcgtaccttttataataataatttttcttttagaagaaaccaagtctcttttatttatgcacataaaattagttacaagcatataacacaatctgatagttctagtttacctgggaacatagaatatatacttcatttatataattaatatttcacatttgggtcttatgtagaacaaacctggtggtgaggtacagaaagtcagtctgttttcctgattgacactttagaatcataaacttttagaactagaacatcagagattatttttattccataccctcaagttacagatgacaacacacagaaccaggagagtgagattaagtgacttgtccaaattcaaagagctaactatagtaaaactgagtaccgaatataaatctgcttactcccattccagtaatctttccttgacttcacatgtaccactagccctcaattttccatgggatctactttgtggatttattcacaaaaactgcctttccccagccacccagctaaatctcttactcctacagatgtataccaaagaaaaagatgtatacctaggaaatttaatcacttaagcaagccatatttaggaaaggaaatcatctataaagtaaatcatggggcagggcacggtggctcatgcctgtaatcttagcactttgggaggccaaggcaggcggatcattaggtcaagagatcgagaccatcctagccaacatggtgaaaccccatctctactaaaaatacaaaaattagctgggcatggtgcacacctgtagtcccagctactcaggaggctgaggcaggagaaccacttgaacccgggaggcggaggttgcactgagctgacatggcgccactgcactccagcctggcgacacagcaagactccgtctcaaaataagaaaatcatgaagtcatgccaaaaccaaataatcatttatgttttgctcatcactactaaaggtataactgaatttgtaagtattcttctaatgttataactattttgtagcaagagggtaggacaagattatgtgtgacatcaggataatttttctcttctactgatagtttgaagctacttatcatacaccatccagaaatcacagctatatctaaattgttttgtgtgcatgtgttttttttttttttttttttttttttttttagacagagtctcactctgtcacccaggctggagtgcagtagtgcaatctcggctcactgcaagctcggcctcccgggttcaagtgattctcatgtctcagcctcctaagtagctgggattataggtgtgcaccaccacacctggctaatttttgtatcataaagacggggtttggccatgttggccaggctggtctcaaactcctggcctcaagtgatccacccgcctcagtctcccaaagtgctgggattgctggcgtgagccaccgggctggcctatagctaaattttgaacaggacaaaacataaaaccaagagagaaataaaccaccaacttttaacatactgtattacttctccttagccaaaagtgttggccgggcatggtggctcacgcctgtaatcccaacactctgggaggctaagatgggtggatcacctgaggtcaggggttcaagaccagtctggccaacatggggaaaccccatctctactaaaaatacaaaaattggccaggcatggtggcacgtgcctataattccagctacaagggaggctgaggcaggagcatcgcttgaactagggaggtggaggctgcaatgagctgagatcgcaccactgtactccagcctgggcaacagagactgtctcaaaaaaaagaaagtatacagcctgaaagcatcaaagcaataacttccctcacattcacatttattcaagtttatttgtagggaggcaatatttcctcttcccctgaggaaggcccaccatcagtacagtagtgcccaggtcactgcaattctctcctgatgaaaaccttaacatcctgactcaatcattcaaaaagcattcttaatgccaggcaggctgctaagtgaaggggatgcatcagccaataagtcgttatctctgctttctaaaagttcatctaatggactggttccagagaaaaccccaagatagatatcagccaactttcttaacaaaaggtttattaagtgccagaccagagacagaaaaagatgaagaggaaattttaaaaggtgagaggctttttcaatttactaaacaaatttattaaacaatttactcctttggattattaaagtcatgtgttcctctccaagaatgtcaatcatcagaaattgactgtaaaggtttttttatgataatatctaaccaaatattttggtcaaaggcactgtttccttaatcttactaatctgggaaaacaagcagatactgatctacatcgatacattttaaaatatctattatataatatctgtattataggaatgtggttgatcttaccaaaactgggatgagttgcttcctgtgcagacagatgcttccaatagaatgtactctaagcctctagggtcaaacatgtaaatcctgtttaaactttcttgccccatactgagtgggtacaagtagtatgggcaatgcttcacaatgaccacaattacataggccaagttttcagtgaaggtttctgtttttccttctcctttccacaaaaactacaaaaggtatcaattagtacacaagccatctggtaaacatccattgtgttctgagccttcttgaaattaatccaagaaaccaacccttctaagagtgagtcctatcccattattatttttaacactattattggtagtggtggtggtgataacaagtgctaactttgcagttcataaaatactttcaaatgtattattacctcattcactgaaaaaaatgaagaggggataaaaggaaatatcataggcaattatctcaaacatcaaaaacaaaacccagccgggcgcagtggctcacgcctataatcccagcactttgggaggctgaggtgggcggatcacgaggtcaagagatcgagaccatcctggccaacatgttgaaaccccgtctctactaaaaatacaaaaattaggtaggtgtggtggcatgcgcctgtaaacccagctacttgggaggctgaggcaggagaatcgcttgaacctgggaggcggaggtcaggttgcagtgagctgagatcacaccactgcactccagcctggtgacagagcaagactccatctcaaaaaaaaaaaaaaaaaaaaaaccccaattttttgtttttttaagagacaagagtcttgctctattaaccaggctggagcgcagtggcacgatcatagctcactgtaacctcaaactcctgggctcaggcagtcctcttgccttagcctcctgagtagctaggactaccggcgaatgccaccatgcctggctaatcaaacccaatttaactggaattgaagagcaagcattttcaattcaagaagttatttctatcaaaaaagcattggactgactctagcaatgcaaacatcacagaaaaaatttccctgtaaattatccccttaaatgctaggtctaattgattcagtgtataaatgttaagattacagtctcagcaagaatttgacactataaatctttgtttacctcaatctttttcccaaatgctttacccacagttaaatacttaataaatattcttctacagaaggaatactaacaataaagaagctgctctagaaagacaaactgacaacatttagcattcaaggaccttttgaagatttaacgtttattgtgcacctaatccaagtaccatgcattacttgtgggttagatacatccacataaatcatctcgctaacctcatcaactatgcccagatactcctggatccccaatactaaattgattagctttccaataccagacagttctaatactggcaaccttggccgggcgcagtggctcatgcctgtaatcccagcactttggaaggctgagcaggtggatcacttgaggtcaggagttagagactagcctggccaacatggggaaaccctgtctctactaaaaatacaaaaattagccaggcatggtagtgcgtgcctgtaatcccaactactaggaaggctgagccaggggaatcgcttgaacctgggaggcaggggttgcagtgagccaagatcgtgccactgcactccagcctgggtgacaaagcaaacctccacctcaaaaaaacaaaacaaaacaaaaaaaaaacactggcaaccttgatcccacctaattaatccttagaacttaactggaactcaattcctactggaactcagctactcgctctaagtcttcagcattttttttatgctttctacgagataatgctcaaaataaatccttgcacctgttctgaagatgctaactccagagtaaagaccacacatcccaggtatggcacacggtaatagtggccgtaatctaaaacaagtcctctcttagatagcacaagctaaagaataaacctagaatgctaacaaaactgaatttcagctgggcaaaagacattggatcttggtattgtttccaacctcaaaactcttttctagtcctctgaatacagaaagctttttctatttgaatgaattgagcaggcaagtttgactcaagagtccctacctgcatactcatcagagagaactgagggaaaacaaaaaaaattccaactcgcatgaccacattacaatgttaacaacacattactcaccattgtgctacaagaaagaacctgcaagcaggcacgaactttcaggaagccaaaaagaaacaagcaaacaacattctcctagttctcaaagcacaaactcattcaaatgccaaagcaggtcacactgtccagtttatacccaggtacaagtgagtggagagggagaagggagaggcaaggggaagagaggaaaagcattattgtgcaagtatgcttttcagcaccaagacacatttctttcttggattcatcaagaccatttttaacaacaacaacaaaaaaaaactggggttccacctatttttatgcctttatatattcacagagaacatccaatatatgtaaacagtggcataatgtaacaatggttgcagacattccttttggaatccgttagagctatatctaaatcctacctgttactttcttgatttgtgaccttgggtaaattatttaacgtctctattgcttagcagatacttcatctgacattcactatagcatcctcaggaccttaaacagtgcctaaatcacactaatacatactttgaatgaattaatctgtaaggttgcataacagtatctattttatggcattgctatgagtataaatgaggtgttatataaaatgtttagtataactcaggctaggatcttgctactaaagagtaaagttttcttccctttattctccagccaggtcagaagttatgacagacgagctgtggccacgaataagataggataagcatggaagaagccaagcattagaagatgtttattactatcatcatgggccatacctaggatgactggtgcttattctggagttagaagcttaataacaggcacaaggatttcttgtgagcattacctagcagaaaacatttaaaaatgcttaaaactgtgacagcaaggagctgagttccaggaagcagctgagttcctagtcaaaaaatccgagaatatttagtcttggcagacgaaattaaataacagtgccagtcccttacggtaggtgcataacaagtgttagctgattcagaaaattgtattttcaatcctcaagtatctgttatcacatagataaaagtctggcaaaagaagaaaacaagaaaaggggtaggaacgagtcacatcttaaatatgcctgactatgtattttaaaagcaaatacaaaagatctaaggctattcaacgctgtaaaaaatctcctattagcaaaaatactcaattgatttatagtatttactctccctttcaggtaataagatctatgtcagtaaattgtttttaactgctgacagggtaaataagtctcaaagatttgggtctaaagctctcttccttttactaaaaaaaagactaatgggcctttgaggctacttcacccacagctttcaactcaagcaagcctaccttcttgcagggagagtggggggacactaattgtatcttcaaattgggagtcagagagactatgcacttaaatccaaaatctaaagaaatctttccccttgaatatgacgaattgaatctcagaagatagctctaagaaacccaggccactattgcattaagagcctgatagactaagtacacacattttgtgtctaaatataaggaaaacccatacggaactgaaacagcttgtggttaaacctcaccataatgtggtcttcaacttcccattttgttttccaggcattgttctgtttttaaccacttgacccatctcttctcaagcaatgtgatctagtagaaagagcactaaacaacaatcaaaagaacggacgatacacaccaagtcctactacttactaggcatgcaaacataaaccagttacttaaaccctgaattcagtatccactgagaatgctgagccagactcagtacctttcaaagctgtctaccaaggtaccccacttcggagaggcatcagaaacccaccaaacccagctctccttattgctattacccagactgaaaatgtgtgatcattcttacctaacctttttcacgataatcagttaccaaattccccttatctctcttcaaattactcaaatctctccccctttctgcattaccattacccttgtagacagtctttttcctggactattataacagtcctctaactggtatcctttcctctattttataccacaaggctgaatcagttttcctaaaatactaattcatacaatacaattccctactcagagatttttcagtataagtataaaaaccaaattcctttggctgagatttaagtctcactccaatttatctaactctctaactttactaactttactgatcttattgccctcctaggtaaaacactgtgctacaaactacttttcctgcccccaaaacaaggtgagctcagctcactggttctccaccttgaatgtttccccgctatatttctctcttctctaaggtctagattaccataaaggtaaaacttttccctatctattccctttaaacttctatatagctatgtaactgtactcctcacttggtacttagtaccttggacttgtattactatttatctatttatgcaaatattcagtgttcacaaataattagtgagttcttaatgactttgactgtttctataatatactggaagcctaacttttcagagaacagatatccaataaactgttgacagtaactactaccttagacaagtcatttaaattttctgggtctcattttcctcacctagaaaatgacaatatgtaaatctcttttcagttctaaaatgctatatgatattagatatactgctacatagcctgtatttgtttctcacattttttttctttatatgcatttatctgtatgtaaccatgtcctatgtaacccagaatataaattcccaaggggccagttctcctcctgcttatttatttactgggtaactcctccttggcatctccttagtgcattgtccccagattccagtgcacagccaagtgttcggtggaaaggaatttgtagtttcaatcaagcagcaaacatcaagggaaatttgcacagatgatttaaatctcaattttcataatgaactagtatattatacaaaattacaaagatgtgagaaagaaggaacttaaagttgttaaaatgacaggacaccttgtgccaaatagccaggaatttattttaggcaagcaaagaagctaggacacagaaactcttaagtctaactctcaaattctattttcagagttctaagaaggggtatggaaagtctctattcatgtcagtaaacaacagggaccaagtattgttcatgtcagagaatcctgtcccttagaactgatagaaattttcaggaaattgatggtttcatacttagccaggtgagctaccagttcaagggaggcaaaagcagatgctcacaatggaacacataagaggagataagtttctaaaatatatttttgttggagctaggcatggtggcacacacctatagtcccagctactcacaaggctgaggtaggaggatggcttgagcccaggagttcaagaccagcctgggcaacatagtgagaccctgtccctaataaataaataaacaaactacatttttgttagttagcatcattgtattttcccactgtcgtgtcttaattcttcacatgcgactaccttcatgtaaatatcaatattaattaacactaaagcctcagaggaattcgctcttccttttcttttgatgttagctgttaatgattcaaaaggcactagtagactaactcatttaaaatgaccctgacttttcaaagaactattttagaacacagcactggcactttcaaagctgcattctatctataatattctctaagtaggtatctgtagagtgtagcctggatacaactttgattagttaatataaaaggcttataaagaattctaagccagttgtgggaaagattatatcctgctggagaaaaaagaaaatcaggaacgtttttgtggaagagatagtttacactgggactttaagaatgggtaagtttaaaaacaaaacaaaacaaaacagggcaagtgggagctgggcatggtggctcacgcctgtaatccaacactttgggagactgaggcaggcagatcacttggggtcaggagttcgagaccagcctggctaacattaggaaaccctgtctctactaaaaaatacaaaaattagccgggtgtggtagcgcgcacctgtagtcccagctacttgggaggctgaggcaggacaatcacttgaacgctggaggtagatattgcagtgagcaaagatggcaccactgcactccagcctgggtgacggagcaagaccctgtcttaaaaaaagaaaacaaaaaacaaacaaacaaaaaaacaggacaagtggggagggcaatggagaaaacaggtttaaaatttaggtgactgaatgaactagatctacctgtagacacatctgaaaagcaatgttgagaaaaaaagttacaaaaggatacatacatgatcctatttatgtaaaatttcaaaacaaaactgtatgttgcctatgaatacatatgtgggaccaggcatggtggctcatgcctgtaatcccagcactttaggaggccaatgtgggcagatcacttgaggtcaggagttcaagaccagcctggtcaatagggcaaaactccgtctctactaaaaatacaaaaattacctgggcactgtggcacgcacctgtaatcccagctgctcgggaggctgaggcaagagaatcgcttgaacccgggaggcagaggttgcagtgagcagagatcgtgccactgcactccagcctgggtgacagagcaagactccatctcaaaaataaataaataataaataaataaataaataaagatgtggcggggcagaggaagtataaaacatgaaggaatgaacacatcaattcaggccagtagtcatttcttgagaaagaggaaggaggaaaggatgcagggtggaacttcagctatatctataacatttaatattttaaagggagtaagacatctaacaaatatgacaaaatgttaatgtccatcaagttggggttgtagactcaaaattgcctgagtttttcccctgaacttttctaaatgtttgaaatatctcattatgcaaaattgtaaaattaataaagggccaggtgatttgatgaatagaggagtcaacacaaaaacagtcaggagcagaatggtttcccaaaactataaggagatatctgacttgttcagttttagactgaagaggagccttcacatccctcaaacagcagcgcttagaacagggtagagtgaggactgacaaaaatggacaagaaggtttattgccatctcaaatcagatagcagaggggagtgaaaaaccaccttcccacataatttaaatgctagtgtaaccaagttatctcccctaaaacagccaagaaagcttccagttacacaggaattcagataagtactcactgtgagtagctattctgtgcctcctttctacccaccccttccttctcccaaatactcacaaacaaaaacaaaatgtacccttgcccacttgagaaagaattaagacttggcagctctgcttaagtggacagcttccaaaccaaggcccttctctggggaagatgctgacagagcccagagaaaagaatttaaaaatcacaactcagacaagttttgaggaaggcctatcaatggaaggtatccatccttccacacgtccttaagtcccaatttctcccaggggaatctaaggacttagaggatgccctctaccctgttctgttctcctccagcaaaagtgactaaaacacaaaatccaaactctcacttagcactttaaaaccaaacaatttccctccacaaaaatccaatgaaaatgaaaatacagggaagatgcagaatctgagtatttaatattttaaagagagtaagacatctaaaacaaatatgacaaaatgttaatgtccatcaaatttgggatgtaggctcaaaattgtttctgtttgggttttttccctgaacttttctaaattttgtttagatattctttttttttttagataaatatacttttaatcagtgcccaatttatcatagcttatttaacaagtttcagtggcacaaataaaactaagtttaaaagaaaacaacttaaagggagcttagtggcagagataaagacatgcaacaaaacaaataccttgacattcttctacatctgaatcactacagctgaaaaatcctaacacctcattcagcccagtccagggcaccgaactgcccctcttcccaatggtactctcagggaacatctttctcagtcagacctaggaaaatacctctattcactttggactggttaaaaaaagacggtagaatggaatgatgttaagtccttctatctgctagtacaatgcaatgtggcagaatgacacaaacactgaaatgggacttgggagagaagagagaggtgaattcacctttattaatcacctagtacatgctgaagactgaattctagactaagctatcacagaaccacttctgtgatcctgagtaaacctcaggtattctatttgaaaatgaatgaggaaaactaagaaagcatcgcagccccgccagttgtctgattccatgaatctgtaaatatgatcactctcaataaatgtgttcagtataatgaagttattgaaaggaattctgctttctccatctccaatccaccctacacaccactgacataatctttctaggatgtgaaacgtattaaatggctcctgatatactgcagtataagataaagctccaggccgggcgtggtggctctcgcctgtaatcccagcactttgggaggccgaggcgggcggatcgcgaggtcaggagatcaagaccatcctggctaacatggtgaaaccccgcctccactaaaaatacaaaaaattagccgggcatggtggcgggcgcctgtagtcccagcaactcgggaggctgaggcaggagaatggcgtgaacccgggaggcggagcttgcagtgagctgagattgtgccactgcactccagcctgggtgacagagcaagactctgtctcaaaaaaaaaaaaaaaaaagataaaactctgtatgatccagcgttgcctacctcttcagcctgccctccatcccatcctccagccataatgattaagtaaaagttacctgaagaagtctggccttcattcctttaagcttttgttcatggtattttctcagactggaatgtaattcttgtcatctgtagagtatatccttaattcatctttcaagactcagctcaaatgctaactcctcagggaggctctttccaacctcagcatgcccaaggcagaactgacccttgggctcccactctccctgctgcatacttctatcacagcatctatcacacttcattctatctatatatttacatatctgtctcctcccactagacccatacgctcctcgtgggttccttgtctcccttacctccatctcagtgcctaggatggtgtttacaagataggagacatgtttaggtttagacgtgtttaggtttatcagtaccattttctttgcccttctgctctttccctaaactttagtcctcagagagcttattaattctcttggctacagctaccacatctaggccatgaattgcaaaactgcatttccaaacctacccccatctttactccagctcacacccaggacagccttcatttggacatttcattgccactttaaatccaacacatcgcaaattatactcatcatatttccccaaaatgaggaaagcttcctaacttctttatttcactcaatgtctcagacacccaggcacaacgtgtcacagttgtagttgactcatcacccttcttcatctcccacatccacccctcattaatttccatttttccttcacagtctctttttcactctttcctctccttagcctaccctccacaactctaactcgggcctcatcacttcacacacccccagtgtcaatctccattccctcccagccaacctgtgtattagtatcatcatactgctattctattcaaaaatcttctaccatttaaaatataaagttgaccgggcacggtggctcatgcctgtcatcccagcactttgggaagctaaggtgggcggatcacttgaggtcaggagtttgagaccagcctggccaacatggtgaaatcctgtctctactaaaaatacaaaaattagctgggcatgctggtgcacgcctgtaatcccagctactcaggaggctgaggcacgagaatcacttgaacccaggaggcggaggttgcagtcagccaagattgtgtcactgcactccagcctgagctggacaacagagcaagaccctgtctcaaaaaaataaataaataaatacataaataaataaataaataaattttatatatatatataaacttataagcctagctttttaacaccctctataaacatagctccaaaccaacctacccaccttcatttcactactgctcactgccactcaggttagtctcctcaccgccccaagaacatctcaggtatagtcctgtttccaggctttcgcttgatccctttcagctccaatatgaaatgttttgttatcctcttcatcttcatcccttgtacctaatacaataacacttattcatttatttttttatttattttggagacagagtcttgctctgtcacccaggctggagtgcagtggtgctatctcggctgtttgcaacctccatctcctgggttcaagtgattctcctgcctcagcctcctgagtagctgggattacaggcgtgagccactgtgcctggcctatttttttattaagatctgaaatgagttataattcctctgtgacataactacctgagtactcctctccccaaatacctacggtatgaggtctgcactatgcaactaacaatatagtttcacattttaaaattttgtgtggcatattaagaggctcagcaagtattcattcctttttattcttcttactcccaactggactgtaaactcttcaaggacacaaagttgtcatttttcctaatcctccatagcacctagcaaagaattaaactcatagtgggtcactacaaataacagtttagtaattttcttatctacagctatttcttagaggaaataaagggctaaggtataatcctaaaaaaagcacagttgaaaataatccctatctagttgtataaaataagattcctgacttttccacctgatttctagctcagaaatactacaatctcctgactcaagaagtaaataataatcctgtgctcgtgacatcagtttggtaatgattataaagaggtgggggagagtggcagggatggagaaaagcaagtcaactggagaagaaaaaaaagggatgaaagaatggcatgtgattttgtttacttcttaaatgtggacacttctgcccattcctttttttttttaattggacatactttcaaacaactttcctacaggaggaaaagtctgacagattttcaatgaagctgatatctggaagagcctctacaaagcacaagtcctttgagaaagccggcttaatcttcaacaacacaacataatgtagtggcattcgtccagatactgtgaatgaaggctcattctggctggaacacaagcatcacctgccagtcattctcagacataagacagacagcctaggaggccacattggatccatacagattttgaaaagaaattggtctatcaacatattcagtgtagtctagtcttaattatctacaaatggattattcattttacggatttctaaggccaaatctttaatgcaagaatgactgttcttcatcatcagtgtactctccccaccatcaggtaatataagcttagaaatgcaaatttatttcaatattagtatgatccccaaaaatgaaaataaatctagtttaaaaaataatgtattttcggcccggcacactggctcacgcctgtaatcccagcactttgggaggccgagtcaggcggatcacgaggtcaggagatcaagaccatcctggctaacacggtgaaaccccgtctctactaaaaatacaaaaaattaaccgggcgtggtggtgggcgcctgtagtcccagctactcgggaggctgaggcaggacaatggcatgaacctgggaggcagagcttgcagtaagctgagattgcgccactgtacttcagtctgggagcaaagttgtcatttttcctaaacctccatagcacctagcaaagaattaaactcatagtgggtcactacaaataacagtttagtaatttttcttatctaaaactatttcttagaggaaataaagggataaggtataatcctaaaaaaaacacagttgaaaataaccaggaaatgtctttgttaagttctgaattacctacaacagtgctccctacattagcagagacaactgagagttaaatgcacttgaaacataatgctgtccttactataagctcttgaggagaatccggccatagtcttgagacttccccacaggttggtgcactacgagacaggaacaagcaggctcagcatagtaaggtgtgtaaacacaaaaacttctacaaggaatcttatgcctcctggctgtatcccttcaggttaggatggtacagaaaataagagtcacaatgtacggatgcctgcctgattccttgtccctgagttcctgaaccaaagggctcaatatttctcattaaatccgtcctttgttcaaggacctacaatgattctattgacccttctatcaacacccaacagagtctggcttctgagtcccctccaccctcttgcctgctctactcatgacttgcccaacccacattctctacagtcactctcatatattccccccactcacaacttagtcattcatatcatcattgcacactgtacattctatactttctgtttggaagatcctttcttttcttttattcccaacacagtaactatttcatttacttgaatgctcacattttacagataaggaaaagaagttaacttgtccaaggtcacatggtaaaaaatagccgcaaggtctgaacgaagacccatctaactcaatagcccatacctctttatgactcatccatagcctcccaagtccatttcaaaatttactgactcagaaatctccccaatttatttcactgattcttactttgttactttaagtcttctcagcccttacatacttatcagcacgttaaatttgcttttgtctatatgttgtttcctaaatgttaaagctcataatagtctgccttcccatatttatacaccacctttcccatccaccctcaaccccaagagcaaagacacatgtctttacatcttttatacctccctaaagcctgtcactggagcatggagactgctttatccagagaagtgttcaatcattactcagcaaggatgtcttatttaaaaacaaacaaacaactctcttctattatattaaaaagtcaactgaattcaggcattcatgagaaaaactgccctgtatctatcttccagttacacaaatttttaattacctgaatttatcagaggctacaaaaaagattccacagtctgctattccacagctcctaagttcccataggaaagatactgctgaggtcacatttcaaagcgctgtttaaggattttccctttggtgggatgagtgtttagggtaaggagagtgctactcatacacacatacacccacactataatggccagtgtcttttagcatgcttaagatactcaggagctccaaaactttgacaagtggcacttagtgccctcataacaatcagaatacttattttggttacatacattgaatctcaaaattgcaaataaagcctcctgagaactaggaatagtggtggactaccaggcagctctccactcattcctaggcttcttcaacccctttgatccccatgccctggaataaagtatgcagttcaacttagggagttgctagatgcagatataaatagaatttacccagatatcatcactaatattggcaccaatcaactcacacagatcaaaacaattattgatcatcaacagattctgggaaaggtgtatgtggtttttaaaaattagattttcgtctccaaattaagtcgttttttaaataggggtctcaaaagaaagattaaacaaataaagctttgggaaattttccaagttgttggcaacataaggccactaaaggccacctaatgattagcattcattaccagtcaccgggccttatacaagtcagtagatagccagctcttgctttggcaaagttttacatttttttccgagggagtcttcagtattaaaagcaaggaataagtcaaataaggcaatgacaataaaaaattagtttggcactatcttccttccatctttccttctatcttgaaagtgtaatgtccaaagcagatatctgttcaattctaaattattcatgttaacggataattattggcagaaaggtggtgataatcaaaaatgagggtaaaatcgaaaaaatctattttggttttggaatatatgttttcagcatatttaccttcttaattattcctagtatgagctaatatttgcattgatttgcaatctctaagtacatagtaactggccactttgtcagggaggtgctctgaggcaagctgggtcaatagtggaaattagaacggtcgggggtattcagcctgcagaggagcaacatcaagttcatttattttacagttttgttcagccttcaaaatatcaatagactagcacagcaggttggttactgaacgttaaaagaactacttgaaaaacaatgaagacaaagcgtataattaattcttcattgtttgcgcataatgtatttgtaagttatacacagcaaatatttaactacctctgattctccctagccacccagcttccgtccctgaagtcttctccccatcaggaatgcaatctcatttagtaggaagaaaattttctacatgttttcagaagttacatagcatagaaacttttttaaatatttaggggttagcaactctttggagccagtcttaccgccacctctttctctactctgtccttttccacctttgaaatagattctgaaagacaaagggatccagcctcctcaaaaatctcctaaatatacagtactagaggccaaagactgaaaaattagcagcatgtgaatttctaagcaaagcgttacgtagtacgtataaaaagataaggaaaataaaagtcaacgtcctgctaattctaggctttgcattcgtgaaaagctgcctgaaaagtttgtggggaacttcttccataaaattccaccagtcagtttctaatttcaaatttttacatctttattgtgcccagagaagccacctaggttagacaagaaagactaccacgagcggggagaaagagactctgagcgctggtccttgtgagccgacaagctaaaaatacgccggcccagtaaacaaatcccattccatcccgaccggagccacaccgttaacctagtaattatgagaagagtgagatcacgcagcccccggcttactcatcatcagcttctaaagtttccatcggctcatggcaacttttcttttttctaaagttcttaagactgccctagaatccgtcaacctccgtctctctccctctctcacacacacacacaaacacacacacacacctttttctcgcctttcctccattactgtatgcaccttagtttggctatcaataggaagaataagcttatttgcttttcattttagtattatattgagattttaaatgaactttatcctactgtggggataatacactgcatcttaatcaccttaaaactccaccatccctcccgaaagtctagctgacaaggggggaccgtccaaactggccagcacagctcaggaagggaggccgggagctggagagcgcggggtaggaacgcaggacgcaggtgaaagggaggaggaaagatcgggacgaagcaaggagcagtcagggcgagaaaggagtgccgaggggagatggcttcgggtgaaacagattcagaaaggagaaaggggacagtggcgatctgaggagcagagtttgcgagtctgagaagccgggaggggcgggagcagacgggggacggtgtcaggacggggggctccgttaccctcgcgggctcccggggcaaggccctaggccggggcggagcgcggggcccggccgcctctcttcattcctcggcagtgaccccggggtccggccggcccctcccccgacggcgatggaggtggaggcggtggtggagactgcgaccgcagctgttgctccgcacgggatctggagctggagccagaaaggactgatcgggactggcctcccccagtggctttttgcccactccgcacccggtcgccactccggctccggcggctggttcaggatcggtggctttctgctgtccggccggaaacaggcgccagtttccggccggagcgggttggtggtgacacccaggccgcccccgggcctcctcccgctccgccccgtcgcagccccgcctttagcgccgctccccaggctgcggccagtttggcgcttgccccgcgcgtgaccccgtgttttcccgacccgagtccctaaagctcctggtctggagcattcttgaacaggagttggaggagtacagggtggactcttaggactctggggtagaatcagttggctacagccgttgggaaggagctgaaaggggtggagtagttgtagaaaggtgagagagatgaaaatacttcagaatgaaaagactgacattctagtaactctacacaatcattctggagtgaccggaggaagattagcttcttccacaccagtctccacccaattatatatttctcttgttccttcactcttgaagtgaacatatccttctctgtaaacacttaatatttatttacttgcataacagtgataccctgttgatacatctgctttagactgctaacagtaaaaaaaacttacatagtgcgtttgttatgtcttctagtgcgtttgttatgtcttttaaaacattatggcataattcaaatatgtattgtatccctgtgatgtgtatcactgctctcagtgatacagggggatacaaaaattaacaagacataatcccagacatcaaaggttttacaatttagtaaaatacataaaactatattatatgtagcagaacttgtatgtgtcctacctgagtgacaatgagctatggctatgagaacataataagccatccttgtcacatagtagaccttccatatttgttgaatgaatgaataagtattaggcctgtgtggactgtttcaagaaagaaaggccatttagtaaatacctctttatgacaaacacaaaacgatgccaaccccggctatactctaacaaaagacatttgaaattttaattcagattcctaacattatagcacctggtctgcatattcaaaataatgtattgcctaattgtgcccattatgcctatgtaaaaacaaatactctagtcaacttttctttcccctcacttcttcctcagtttctaaaggggaggcgtggggcataggcattttagaattgtctagctcagaataggaaactgacacctgaaacagggaaacttcctagacagctatatctcttagggatacacctgggtttacaatcgaaaatttagggctgggcccaaggctgtccacacatgctaaggccaaacaagtcagagtgccttgcatgggggcatatccaagacatacaatagaggttgacaagtaaagtcatttggcgtgggcttcaagcgtataagggaccacaaattttagctaccgtttagtggtaaatttaaggaggagagcaggatgagatttggtcacctaaattgactctaactgaactctaactgaactgaactggaagggtacgggggtggacgcttgggactctggggtagaatcagttggctacagccgttggaaaggagctgaaaagggtgtcgttctagaaaggtgagagggatgaaaatactttagaatgaaaagactgaaattctagtaactctacacaaacattctggaatgattgtgacaacaatcactgaccacacctaccctttgctagttaaatctgagatgggagcacagatctgtagaagaggagcctcaaaatctgaaagttgccttgtttcaccacagctgtccagaaccaggttatacccatataaatatgtctttctaatcttaacgccactgccacagacttaatagaaccaggcgtggagctcaaaggcactctaccctcaatataagactttttcttttggcagtgaccatagaaggtctccagatttgaaagctgggccaagttgctggtcaaagtcatttaagtgaccacactttataggcttgcctggaaatttaggggccaggaagtgatggggtcacagttgctttgtgcctatttcttgctctgaccatccatcattcattgttgtttgtgcagttgctcaatgggctgcttgtctttggtcagcccaggctgtgtgggtagcagtgtggtcagctgggctgggagccaggccacctgggttctggtcccagctcaaccagtccctaatccattaagtgactcccttcccattcctgtgtctcagtttctctgcgtagaaactagaggcttcttctctagtgatatgcagccatttaggctggcactaggttggatgctcagaggcagctgtttaatgtagacattggcagcagccagaacacagttgactatttcttgctgctaggtagaatagtaagggaaaaaaggtaaaagcaccagacaaaatcctaccggtgtacacagggccacacaccctcaactgctattctgtccaaagttcttttccaccctagagatctgtttttgtttactcgtcttagcaattctaagggctgcttcaaggagctccctgagcttttacatcactttaagcaagagcagaaaaaccagagctttgcatttcaccagagaaactaaaaagagagactatttcaatactggggctaatggctagagttggggaaaatgttcagagaaaggttgtagctaggcagggaaaaaaactatttacatttatatgcttttgtggtggaaaagaaaaccaaaccaaaataacttcctttccaccgccaccaatataatttagaccattggttctggggagtttttaaaaactacatattatacatgcctaggaacctcagactgacgcagaattctttcttggaactgaagaccatgaatccatattttttaaaaaaatatctagggctcggctgggagcagtggctcacgcttgtaataccagcactttgggaggctgaggcaggcggatcatgaggtcaggagattgagaccatcctggctaacccggtgaaaccctgtctctactaaaactacaaaaaattagccaggcgaggtggcgggcgcctgtagtcccagctacttgggaggctgaagcaggagaatgacgtgaactcgggaggcggagcttgcagtgagacgagatcgcgccactgcactccagccgggcaacagagtgagactctgtctcaaaaaaaaaaaaaaaaaaaatatatatatatacacacacacacacacacacacacacatatatatacacacacatatatacacacatatatatacacacacatatatacgtatatatacgtatatatgtgtgtgtatatatatgtgtgtgtgtgtgtgtgtgtgtgtgtatatatatatatatatatatatatagggctcagccaggcatggtggatcctgcctgaaatcccagcactttgggaggccaaggcaggagaatggcttgagcacaggagtttgagaccagcctgggcaatataaggagatcccatttctacaaaaataaaaaaaaaattagtcaggcatggtggtgcatgcctgtggtcccagctactagggaggctaaggtgggaggatcacttgagtctgggagatcgaggctcagggaaccatgattgcaccactgcactccagcctgggtgacagagagaaagtgtctcaaaaaaaaaaaaaaaaagctgtatgaggggaagtttcataatgttaaacacattcctaccctaaaacctagtaattccactccctaggaatttacccaatagaaatgaaatatatgtgtacacaaaaaacttatacgtgaatgttcactatagctttattcataatagctccaaactagaacattttaaatgttcaccaacagaaaattacttatattgttcttacaatggagtacaaatttaaaaaacaaatgatcattaaacacaacaatatgaatgaatcttggactcatttgtggtgcaaaaaaagccatttatgtgaaattcaggaacaggcgaacgtaatcttgaagataaaaatcagaactgtggttacctattagagggaggtgaagatcaaataggaagggacatgagggaactttctgaggtgatgagaatgttctgtgtcttgataaggatggctgttacacacagacatcaaattgtatacttaagatcactatatgtgaattttgcctcaattaaaaaaaaaatccagggtttcttgataacatttaaccaggttaaacatttacatttacttgtggattatttgattgatatttacttcacccatcagattctgacactccattagctaagtttaccattttgtgtatagtacctagcatagtatctgacccacgacagtcatttattaaatatctattaagtgaatgaatgaatgaatgaattggcagccatttggcaaatgaaagcattgctttggtagattattatttcatatttagtatcttgtaatagtatagctgagcctccctaatcccaggccctctatctgcttgcacaccagtgctaagattatggttcctaaattcttttttttctttctcttttttttttttttttgtttttttttgagatggagtctggctctgtcacccaggctggagtgcagtggtgcaatctcggctcactgcaacctccacctcccgggttcaagcaattctcgtgcctcagcctccagagtacctgggattacaggcacgtgacaccacgcgtggctaatttttgtacttttagtagagatgttggccaggatggtcttgaactcctgacctcaagtgatccaccctcctcggcatcccaaagtgctgagattacaagcgtgagcccaaagtgctgacattacaagtgtgagccaccatgcccggccacttcctaaattatttcatggatgttttctctcttttcaaaaactctagcaaacatgttggttgcttaaccaatgtccatcctccttcttcctccatgcctatagaaccttgattaggttcaagtaaccagcctgctgtacatggcttcaggggagattggcctcagtagagggggcgggggctgagtgggaggaacacgggtgaaacactaatggatcatggggctcccttccccttgccagtgcttgatctaggcatgtgatagagttctgaccaattcgagatgtgagaaaatccgctggaggcttttgggaaagtcttctttgctcttacaaagagatgaaaagaaagaataaattattttcctctgctgctgaaagttgttggatttggaaatgttgtgctggtcagaggccagactgacatactgaggatgacagagcaaaaatattaaaagaatctgggtctttggtgccctgctgaattaacctatcccagagtggtccaacttgaaattcttgttatatgggataaatgcatctttcttattttttgagccatttcaaatttagtctttctattgcttgtaaccaaaataatcccaacgagtaaaatgtcatcaacaatacctcagtgtcaatggataaactgaaaattccttaatctcctttgtaagagggaacccagcctggtcttaactccatttctacatttccatttctacatttgtgttctacttccttgaccaccagtggtgtgctagtaaatattaacaaccggttctccagggtgaaaaagccctgatttgtaacatttactaattttctttctcttttcttttctttttttttttttttttttgagacagagtctcgcttttgtcgccaaggctggagtgcagtggcacaatcctggctcactgcaacctctgcctcccgggttcaaacttctcctgccccagcctcctgagtagctgggattagaggcacccaccaccacgcctggctaattttgtatttttagtagacacggggtttcaccatgttgaccaggctggtcttgaactcctgacctcaggtgatccacccgccttggcctcccaaagtgctgagattacaggagtaagccaccatgcccagccagcagttactaattttcatggtgcaaatatttctaccactgataagttcatgctaccaatgtgatgttgctgaacaaggagctgggaaatgtgcagtcggctctagcaagtcagtaagagacagcttgagctaactccagcaaaccaccatgttaccacccaactgtctcccctgtctctaagttttctctctggagagagttcaaggcccaatctgtatcacctccttttaaagtctttgtgttaaatcctaaactataaatgtgtttatcagtcaactggaatttagcaattgccttgaattgttaattttcacaagtatttgctcataagtgaaccgcttaatcaattaatgaaaaatacttagcaataataaaaatgtcaaaagagaggagtttagtgacaccatcttaccttcctgcactccctaaagtgttcctaggattaggcattaggagaactcctaagaagaaaatccctgcctccaggccctaaaatcactggaggtgctttattgtaaataagatttatcagctcccaattattgcaagtaacagtttcccaggagagctgggttaagagattaaaaaagggcccttggcaagattgggtgtgtttctagtatggtcctgacaaatcccctgaggatgtaagaatgggcttctaaggccattacaggcctagcaacaagtaggtagagaaaagaagccagttccttaggctatgaggagagcaagtgctaccttacctaattggaatgcaggtcaggtgggtcagcttaatctccacctcacaggtgacacaccccaggcttggaggaagcatgtacttaagactaccaacactttagctcaggcaatgaggagaggcctgggaatggaatgacaaagtcactctgcccctgactaggtcagcactaggagggaggccaaactcaggctactggaaactgacagagcattcaggggatagaagattgacactacatcaggctctggttattgctttggggcatttacttgacactgtcattaactccccttttttctttgtgactaatggcccaggttgacctcaacaggtaccacatactaagaacatttcctaaattataaagacatgctttttctccccacatcagggagctttggggttcagtgactatatctaattggcatctactagaatctctcactgacgtgccctccatttccatattactgtcctgatcagcactgtggctgttcccatgttgcttatggtctatggacgagcctgcaaagcatagcaacaaccatagagatgtcaatggaagtcattattttcagttggaaaaaaatttagaattgaaaagtgtcaccattacgtaggtaaccttcctagtttaaaaagagataaaatcctgaggtccaaagaaattagtgaaacaagaccaaaacctacgaagggatccatggatacgagtaaagtactctagaagcacccaagggaaaaatataagaactgaggcacgtttaaaaataaaacactgcctatagcaggaaagaggaagggaaactgaggggccaaataatgaaactgggcagaaagaggtcccaagtgctaatcaaggatgctggacctgcaacaccttttaagcagactagctgcccccaggcagtgcccttccactccttccccgggctgcagatcacacacaagtggcagctctcctcttacttgccaatatatgatgctgcagctagtgtcatactgcttgcttccttatctagaccctctatatgagcaaaaaatactcagcaaaatgggaattaatgacgattacatgaattctactgatgtatctaagcacccactatgtgtaaagcatgcaaagatgcaatcattgcccttaagaagttttcatgaagaagactagcagttagaggtccaagtccttctctgcttgacatctttcatcttattcaggaaaaaagacaaaaggtgtaaaggacaaggcagcctgtgactgcaaacattcatccctgaaaggagctgaaagggctgagtcttactgccccaacagcatattctgttcttggtttcctacttcctacaagactttcctttcctttagtttcctcctcccctctttctctatatgaatgatatctgcaggcctttatgcagcaaacagcttctaacactcagcaagacagtatggtggctactcctaaaattaaagcacagtctagtgagttgatgtttctctagcctattcctatggaataccccgatctagacatacacacatctacaataattaggttacactgtggacacagttgttactagtgtccctgctcagaatctaggttagcatttttgttttaaggtctgaatccattgccaatacctctacattgaatcattatatctattcctttctcaattcacgttgctacaatcccctagctcattacctctgacgtaaactattgtaaagtaactccacaactgtctcttgcctttcctgtctctcttctcccatctactcttcacaccctgcctgaaactaagatctggtcacatcatttcccagctcaaaagcccccaattgtctttgttttgtttgtttgtttgtttgtttgtttggagacagggtcttgctctgttgcccaggctggaggtcagtagcacaatctcggctcactgcaacctccggctcccaggttcaagagatcctcctgcctcagcctcctgagtagctggaattacaggcatgggcaccatgcctggctaatttttgtatttttagtagaaatggggtttcaccattttggccaggttggcctcgaactcctgaactcggtgatccacccaccccacaagtgttgggattacaggtgtgagccactggcgccctggcccaattttccttaaagggaaatttatctactgcaaataataaaaataatagtaaatattattatctttgttatcattattcacgtggttggcacgatccatccctaggggactaaatgatttcagagagctcatagattgctctgggatcattgtgtaactgagaaagaaaaacttgttatttagaacccaaccaggccaggtgcagtggctcacgcctgtaatcccaatactttgggaagctgaagcgggaagatcacttgagcctaggagttcaagaccaacctgggcaatgtagtgagacactgtctctacaaaatttttaaaattagccaggtatgtgcctgcagtcctggctactcaggaggctgaggagagaggatcacttgagccagggagtttgaggctgcagtgaactgagatcgcatcactacattccaacctgggtgacggagtgaaaccctgtctcaaaaacaaaacaacacaatcaaccccaactgtagctgcctacttttaaggtaggtgatgtaattcatatagcagggaaagaattcttcacactgcctcctaatagaattggaagaagggaatggcaggccaggcgcagtggctcacgcctgtaatcccagcactttgggaggctgaggtgggtggatcatttgaggtcaggagttcgagaccagcctgaataacatggtgaaaccctgtctctattaaaaatacaaagaattagccaggcatggtggcgcgcacctgtagtcccagctattcaggagactgaagcaggagaatcgcttgaactagggaggtggaggttgcagtgagccaagatcatgccactgcactccagcctgggtgacagagcaagactccatctcaaaaaacaaacaaacaaaaaattaaatatctaggtatatgctgtatgggcctctatttgtacccttgccccagaccccacaaagttagaggtagtcctatttaaaattaaaactgcttgagactagagactattaacagagaactacttaaaggaaaatatgtttctctgctatttctgaaaaactttgattacaaacttagatttttatttaaagctactgatttatcttgaaaattttctctgaaagccaaataggcccctatcatataattatctgtgtctgaaatcacatttccccccaaaatgtttggtgcacctaaataacaactgacacttgttgattgcttagtttccaaacagggtgtggatctttgaccctaactttatctggccctgttctggtctctgctggggcagcgccttccaccttttctcctctggttggttcagtctccatccccttacttctgttggctagacttctaatacgacaaaagcaattcattttttgagtacatagttttaaattttttctgttattttgaagatttttttaatagcaaatacattggcccttttctatttctttctctcaaaacacacacacccctaacaattgtttttaaaatgagtcagatttttcccccttcgggtcatatacttctagtaggaaacatgttccattttgctatatcagacagtattttgttaaggcttttgacgtctgtttttttccagtggcggtgaggaagaaggtaggccaggtctgggcagggtcctagaggctgggaggactggagtcaggttttcacacacagcagctgggagggaacaaagccagagggtgaatgtaaaactatatttggggaggtgtggcaaaggttaatattaatctggaaaaacgagatcttgtcatcttaccaagttcaagggtcaaattcagagccaaaaataggagatgaagtcagagatcaggaactcagtaaacccaagtccagtagttaaagcagatatgaggtgaaaggaaccagtgctacagagtgaaacaggtggagccccagagctccctgtatgggatgagtgaacctgaactaagtccgcattggatttaatgagagaagacacgacagcaccagcccagtggaatccaagttctagtgctcagtgaatacttcttgcatgataaaatgggtttactaattagtcaacaagatttatgaagcatatataagattcattaaaatgtgcatatcaccagcaaatttagcagctttcctaaagagaggcagaagggagaaaaaaggtgtgaatgttaacatttaaaattcattaacattacagatgcagtggttactccagactttctcttgccactgaaacaacatctaatccagtcatttagaatacagcttcttattccaacatgaagaataatctaaactctccctttctctctctccttaatcattcttcctgcttcccagcctgagcctggaacttttaatggaagtaatgggtcaagtcaagactagttccacagtctttagctgtgtcaaatactgtaaaatctcatgctgggctgggcatggtggcccacaccagtaatcccagcactttggaaggctgaggcaggtggatcacctgaggtcgggagttcgagaccagcctggccaacatggtgaaaccccgtctctactaaaaatacaaagattagccaggcgtgttggcgcatgcctgtaatcccagttactcaggaggctgaggcaggagaatcgcttgaaaccgggaggcagaggttgtggtgagccaagatcgtgccattgcactccagcctgggtgacagagcgaaactctctcaaaaaaaaaaaaaaaaaaaaaaaaaaaaatctcatgctgaaggtctgaggcagctgatctggctgagagagcaactccagccgttggtaactgggattgttgaaaagagccgtaaccacatgtgatcacatgtgcagagcacacacttcacggcttcagggtgtgtttcccagcctagcggtagtgcctcacctgggagctcattggaaatgcagacaggagacttgtgggcatcaagagacaccacaggccatctaatgacatcactatgtctctaaaacaggcttctgcaagccactacaacaagtggaagtttacctgggccgatcagttaagagtcactctccatttacttttatttaactctttagtatcccaccagatttatcttatatccaatggtatgtatttttaagaacccaagagaaaaaagaaatatctcaaagtgccctatttactaaagagcccaaggagtctctttacccagcagcagccacagcaaccacagcaacaaacagcattagcatccagtaaggtcatagtgtttgccaccattgtggcaagagatttatcacaattaaatgatcactggcagtgtagaactgggtactagaaaaaacagaaatccctctcacctggtatatgttctgaaagcagaattaagaagtattgacttcagatgcacaaaggtgaatcttagtcactagacgacccagaatagcttttatcaaaaacatgaaaggtaagtgtttccaagaatatggagaaaaggggacccagcccactgtttgtgggaatgtaaatttgtacaaccattttgaaaaacagtgtggaggttcctcaaaaaataaatatagaattaccataaaatccagcaattcaacttctgagtacatatccaaagaaatcgaaatcagtgcatcaaagagatatacgcactcccatgtttgttgcagcattattcacaatagccaagacatagaagcaacctaaatgtccatcagcatataaacagacacagaaaatgtggtatatatacacagtggaataccagagagccttgaagaagaaggaaatcttatttacaacatggatgaacctgaaggacataggctaagtgaagtgagtcaggtacagaaagacagataccgtataatctcacttatatgtggaatctaaaaaagttgaattcatagacacagagagtagaatggtggttaccagaggctgtggtgcagggatagagaaagcagagatgttggtcaaaggatacaaagtttcagttacacaaaaagagtaagttttagagatctgttgtgcagcatgacgaccttggttaataataaggttttatatatttcaaaatcgctaaaagagtagatttcaaatgttcttgccacacaaaaaaggtaggctaggtgatggatatgttagttagcttgattttaatctttctacatgtatacatatataaaaacatcacattttacccttataaatatataatcattatttgtcaatttaaaaagttttaaaggtattccagcttcctcctgcatatgttaatgagtaatgacataattgaacaagcactttaattggcagcagtactattaccttcctaattttgacacatcagatagtggccagtgctaaggacatgagagacaattatttctcaatagagtgccactatttagtttatcaacaaaaacaatttctgagcacttatctgcacaaggtggaataaatattccattccacaagttaaatctagttcctccttagcttttctaagagcctgtgatttgttttagatcaccaactcttaagtcctttcaaataaagccattttcattttttgttaagaatgagaccagggcatataataatgtcaaggtaacagtttttctggcaggagcttgttcctgattatcgcctctgcactccggaatgaaggatctcacagacttatgaggggacattagcttaaataggaagagaacaataaagaggatcagggatttgagtacaaggtgataaagcctagaaacagatggcttgatgaagaatgttaaatagggttaaagatactgatctgcatgctatttttagtgtccttctcaaaaactggagaaattaatattttaggagtttagcctaagatatacaacaagaattataaatatataaatacagatattggagaacaaatgcctcaataaatagaactaatagcagctgccattttagaatgtggtatatgtgtagcacatggaaagctaaagaattgatggtttctcactcaatcctctcaacaacgctttctttaaaagtcttcagtgaagttttagaaaacaccacaattagccgggcgtggtggctcacgcctgtaatcccagcactttgggaggccaaggcgggcggatctcttgaggtcaggagttcaagaccagcctggccaacatggtgaaaccccatctctactaaaaatacaaaaattagccaggtgtggtggcacacatctgtagtcccagctactcgggaggctgagagaggaaaatcacttgaacccaggaggcagaggttgcagtgagctgagatcacaccactgcactccagcctgggtgacagagtgagactctgtctcaaaaacaaaaacaaaacaaaacaaacaaaaaaacccaccacaaccttatctgaactgagttagagaagataaaatataagataggtctcaggggctgggcgcggtgcctcatgcctgtaatcccagcactttgggagactgagacaggtggatcacctgaggtcacgcgttcgagaccagcctaaccaacatggagaaaccctgtctctactaaaaatacaactgggcatggtggcacatgcctgtaatcccagctacttgggaggctgaagcaggagaatcgcttgaacccaggaggcggaggttgcagtgagccgagatcgtgccattgcactccagcctgggcaacaagagcgaaactctgtttcaaaaacaagcaaacaaaacacacacacacacacacacacacacacacacacacacaaatagacctcaggaaagactgaaacccagggctaaaatgtttccagaattctctgtagcctctattacaacttctttctgcatgtgagcattattctctcccactacagactgacttcttccacaccagaggggaatatcaacttcagagcctcacatcttacagtgctcaccaccagaaaggacctaagactacctttctctgtgtgaattcaaaaatctgatggaaaggctctgatcagaccatattgggtcaggtgaccatcctcagacaaatacattatgtctaatataggggatagtgaaatattttgtttgggtcagttttctagccctagagcaattattgtggcagggaaataagcccccacatgaattacacaactgaaaaaagagatgtggtcaggtgctctgttcatacttgagacaaaagagcagaggagacacagagctctgatagtctgtttgtcaggttgcaagaaggatctgcagagctctggagcttgaatggccttgagtgagggcacttggcgaacaggacaagtgactaccaatatgaattttagaaaatacaagcattccttggagattcctagaattttatggagaaataggccttccagtgttttccaaagggagcaggaaggactgagaaagtgcatgacccttcagtttaagaacacttcctggaaggtgcatacaatattttgcttacatccattggccagaacttggatcagaacatgatcacactcagctgcaaaggaggctgatatgagcattatttattctgggtggccatttgccaggttaaaattaaaaattcttttactaagaaagaaggccagatggaaattagaagaaaactagcaacatatatcatagaccatgcaatgaatatttatttattattttgtctcatcataacagtacttttattctttggagagaatggttctctccttctgcaaccatgtgattttgaagggacttgcctataacagtatcccacttccctgatggtagagataagttcctaacccagcttgtttcaagcataatacctccgtctgccttatcctcagtgatttgtgcaaaggtaacacatagtccaaatgtgacctatgagagccctttcctgggattttctaactgaatttttctcgggttacaaggtcataaatatataagcccagggctacttaaggctatagttgagatacggtgacagcaacttaaaagaataaagccagtacggaaagagaaaagtgaaaagtgaagagagagaaatgagaaatttctgaataatatccaagctcttggtgccagtcatccataaaaataaatccacccttaccctttctgcagattggccatataaaccaatatgtctccgattactgcttaagctcattccatctaggattctgtaatttgcaatcaaaagtatatttatatttagaatttatataaattgtagaaatacttagaaatgaaatttctaaacagttaaagctatactatattcataatcagtggaagccattaatcatgtgatgtgttcctgctaaatagtctccaactttcagccttcagataacgtaaatcaaaggtattacattgtattgtactgtgttgtgttctgttgtgttgtattgggctgtattatatcaggtgattctgaacaatcacctaccgaacctagcacctgttaactaggctctagggatataagattatagcactatctctaacttcaaggtcctcatcttctatagggaatacagagaggtaataaataattataataccatgcagaaatataaaaggtaaagccgggcacagtggctcacacctgtaatcccagcactttgggaggctgaggtgggtggatcacctgacgttaggagtttgagaccagcctggccaacgtggtgacatcccgtctctactaaaactacaaaaaattagctgggcatggtagtgcacacctgtagtcccagctacttgagaggctgaggcaggagaatcggttgaacctagaaggcagaggctacactgagctgagatcaggccgctgcactccaacctaggcaacagagtgagactccatctcaaaaaataaataaataagtaaataagataatcaatggcacaaaagcagaagtgatcaacttgacatttctaacttcatctgccaaagaagatttcttataataatctgctagtgtcctttagtgctaaaaggataactgctaaaaaaaaaaagtgtattttcttaaaattccaaattggaaatatttcttttctttattatttccctatgaaataattatattctattctattttatcctgagagattttaagtagaataattaaaaaactgactaatttggtgagttcaaaatattgagatgattaattagtcaagaccatatgaatttctcagacatttttaatacaaggaaaaaatacaattaaaaaagctttctgaagtatccaaaataacatatcactatctgaatcacaaaaccataattttaggctgaattcccttaaataggaaaattaactttttagatagtaggtggtattcaataatacttatgttttcactagatcatctgtacataactatttttctcaaaagagttatttatttaaatcaaacaggtttgacaaggctctaggatgcagttgtcaatagtatccttaacacaacagataccatgaaaccaaacacatagagccaagcaagcattaacaagttctgtagagcccagctcaagctaaagtgatcattggattcaatacaatcaagatcatttggcctaataaaaggttcgggattctcaagagaacctgggcaaagccaaattaagagaaaaggcaatgtgaaagaaaaattaaacacttcactgtgggttttttttccattttttttaattgtggtaaaatacacataatacaaatgtactacagtatcttagccatttttaagtaccatatacagttcaatggtattaagcacatcaatattgttgtgcaatcatgaccaccatccaactccagaattcttttcactttgcaaaactgaaacactatattcattaaacaataagtctccattctccctgttccccctaacccttggcaaccaccattctactttctgtctctatattttttattgctttatgtactttgtgctttttgagacagggtttcgctcttgttgcccaggctggagtgcaatggcacagtctcagctcactgcaacctccgcctcccaggttcaagcgattctcctgtctcagcctcccaagaagctgggattacaggcgtgagccaccacgcctggttgctctaggtactttgaataagtgaaatcatacatatagtatttgtctttttttgtgactggcttattttacctagcataatgtcctcaaggttcatccatattgtagcatatgtcagaatttccttcctttttaaggctgaataatattccattgtgtatatatagcatattttatcaattcatatgctgatgaacatttggtgaactgtactgtttttatgaattacaattatatattaataatctctagtatcggctatattcaataaatatactagaaaaatagttgaattgatggtgagttaggaaattcagttttgtttccaaatctcaaaagataccagagagaatatatttatctatacagttaattagatgaataatttttgtcaaaattgttataagtttaataggaaagtttcagtgataaaacaacaacccctactgtggtatgttgacagaaggacccatccacccacaaactgttgcttgattaaacccattgtccagggttctgatatcagcaggctatggaacaccaacaattctatctatatttgaattgtgattcaagcgaggtcattcttgatacttagaagacttatgtttggcacataagtaactatagtaagtaactgcatttatgaccctattgcttaaggatgctttagatttgtagaagcaatagctcaagaatgaacttactggagggtccaagagaagtttcaacaatttagcccaaagaaagctcaaggaaagcgtttatttgccactgtctccagtagaggttgttcattctctcagagtccacagtctccaggacaagcaatttggtggttgcattctcttggcttcccatttttcatataagaaacagaggatccaaaatatttcagtaactcaccctaggtcatatagcagggaagttgcaatgggttctccaaagatgctgtcgtctctgaaatcttaaaagtccagtaatccacaacctatacaaatctcctatccctccatctgtttacccctcatactctccacacccctcttttagcaccacagccagctcaagttctagatatcttcattttctctgagtctatctagaagagcccaggtcccatagtcaaactgttcatgcactggttctctcttgtccttacatacataattcatgaactcctaatgttggatcagtcaaactgatttctctgctactgcattctaagtacagctggggaaaattacacctgtggattgataacaatacaaatttttaaatatcaaatttaagttagaaaacgcttctctcattccttcagtcacgattctaaactttaaccaccatcttcctttatgaccatcaccttgctccttctcaaaagatgacctaatctcccagttcacttagaaaattgaggccttggtgtggatgggaaggaatttccttaccctccaggccctacatttataaggctgtttacagctgaatctatccttatctcacacaagtttctgaacaaaaacccttccctctagcgtagaggaaatgccccttcaaaatgccccttctgttcaaggttaacattccccgttattgttcatagttttatccccttctgcttcctcagggaatttgtgccattaatgtttcatttatcttctatattttccatttctctttctctcctggattcctccctacagcccacagcaccctcattttaaaacaaataaagcaaaagtcagcttcataaaacattcgttggaacctgtgtctcctttaaactgctgagcttcctcacaaatgagcttcttgaaatgtacaccaaatctctcctctctacttcctcaactcccatttgctcttcaaaccacttgaattgggcttccatttccaccagttcactgaaactgttctagcaaatgtctgtagcagctgtacttgtcaccctttcatgattactattgtttacctatgtgttctgttttgtcattgaatatagctttgaatttttgtctgtgcagttactgcacagtttttcttgtttttgttttttgagagacttttgctcttgtcacccaggcccgccaccacactggctaattttgtatttttagtagagacagggtttcaccatgttggctgggctgggtcctcgaactcctgacctcaggtgattcacctgccttggcctctcaaagtattgggattacaggcatgagccatggcacctggcctctattttttatttttatttttatccccttatctgatttttcattgtattcttgattgtgcccagcaagaagaaatctaacgaatatttgttaaataaattaaagaaaaatttaagtaacatgaaagagcacgatgccaccatattttagatgaggcacaaggctaggcctaaacaaaacttttctctggtgacaactacctgcattatactcctcattaacctcatcttgctgtttctggctcagtgctcttctgctgtcccacagagcctgttactttcccttctactgccataaaatttacctgtcctattttttatttcctcagggtctaagatttcagccagcaagtcagacaaactaattttcattaatagagaacagtaattggagaagccaaaagaagcacatgcctaggcaataaatgtgcatttttaataaaacgctgtgctttttctaattataaaatacatttttattattgaaaaaattttaagcaccaaaatatagaaaataaaaagcacacacacacaaaaatcagacaagtcataacattttggttttaatatagcatagtagttaagagcccagactctgctgcctaagcttgaatcccagctctaccaccttccagctctttgaccttgggcaagtgacttaacctgtctatgtctcagctttatcatctgtaaagcagagatagtgatagtacctattattgctatgagaattaaatgagctaacatatgtgaagtgcttaaaacactctctggcacataataaggtctatgttaagtatttgctattattgttttggcaaatatccttccagatagataagacagaccaacagagaagagatataactataaacacacatactttaaaaagtattggaaccattctttacctatgttttcttatttgcttttgtcacttaaaagcacaccataaggccaggcacggtggctcatgcctgtaatcccagcactttgggaggctgaggcgggtggatcacttgaggtcaggagttcgagaccagcctggccaacatggtgaaaccccgtctctactaaaaatacaaaaaattagctgggcattgtagcacacacctgtaatcccagctactcaagaggctgaggcaggagaatcgcttgaacccgggaggcggaggttgcagtgagccgaaatcccgccattgcactccagcctgggcaataagagcgaaattctgtctcaaaaaaataaaagaaaaaaaaaaagcacaccatgaggccaggcatggtggctcaagactgtagtccagcacttttggcggctaaattgggaggactgcttgagcccaggagttccgagactagcttgggcaacatagcaagaacctgtctacagaaaaaaaaaaaaaaaaaaaaaaaaaaaagccaggtatggtggtgcatgcctgtagtcctagctacttggtaaattgaggtgggaggattgattgagaccaggagtttaaggctgcagtgagacatgatcttgccactgtactctagcctgggcgacagagcaaaatcctgttaaaagaagaaaagaagaaaaagaagaggaagaagaggaggaagaggaataagaagaagaagaaggaggaggaggaggaggaggaagaagaagaagaagaaagtataccatgagtatcttcccacattttaaaattcttcaacagtagatgtttcaaactggtaaacctgtggatagaatttaatcgtgtcttggccaaaacagtattcttttataatgtaaattaatgcctccacgtggaatataaactctccagttcaccaccgtcctcaccaatccctagtgtcttcacacatatactttacttgctaaacaactgaaggcatttgagtttttaacccccaacataatttttagtaactgcatattatcttattacatgactaggacattctgtaattactcagtttccattgttagacatttaacttttttttgacccactattataaataatgctgggaagaacatctataaatctttgttatacttattttctacatctcttttcctaaaaataaaaatgctgggtcaaagtctgaatgcgtttaagacctttaatatgtattgctcaattaccttataaaaaaattgtactactgtacatttctaccagcccacttttctgacgttattgatatctgtattatcacttttaaaacttttgcccaaaaaatctaataataaaataatatacatcttttaaatatggccttttgaggacaaaatattcttccctccagcctcccaaactcattcttttccctgctgcccagacaactaagtgaaatagttggaggaaggcaataatcctaactatagccatcaatattatccttaacatcaacacttcaatattatccagtgtctttatgtcacaaagaacttgccagtggtaaaaaagaggagttaaaatataggatatttttagtctctgctaatctctaccatgtagtgttaacagtaacagtagttatcatctactgctcattttactatgtttaagcaccgtagcaagcattttgccttcattcatcctcacaacaatacatactaatattatgacatattatcaatattagtatgtactatacatattaataattttttttgagatggaatctcgctgtcaccagactggagtatagtggcgcgaacttggctcactgcaacctccacctcccaggtttaagcgattctcctgcctcagcctcccaagtagctgggactacaggtgtgtgccaccacacccagctaatttttgtatttttagtagagaccaggtttcaccatgttggccaggatggactcaatctcttgaccttatgatccgcccacctcagcctcccaaagtgctgggattacaggcgtgagccaccgcacccagcctaataatattattttaagaattataatggacaacactgaggatcacacaggttaaggagacttgtttaaagttacatgataagtggcaaagccaggattcaagcccaagctagtttaactccaaaaccatgacattagaatgtctctaagcagttattactaataaatctgtttcatttagtacttttaatttctcaaaagactttcatatacatagtttggccctaataagtctgtgggatatgattaaaggtattgggatcaattctagattagggaactaaggcaaagtctgctccaatataataataaacacatgtccattgctgcctattagggtcataaccagcaccatacctgcagttagaactcaaaaattactcacataagcactttaagttagatgtagatgacagccctatagatatcacacacacatagtttctgctagctgcagcaagaatgccagtgacagaattatgacaggagttctggccaactccaacccatcctcattcagcaagcttgttctttctctgtttctgctcccagctgacagagctactttaaaaaaagaaatcatttctgcaaacatgtgaagcagctcaaccctctggcatttagcagaataggactctgtcagaataatctagaaatctgttttctgatgctagaattaaaatgcctgtgtttttagtattttttggtattgttatgccattagatttgtccaaaaatataaatatatgcataggctttgacttgttcaaaatagcatattttgaacattgcggctttattattttatgtttacttatgggcctttaaaaatgtcattatgagccaggcacggtggctcacacctgtaatcccagcactttgagaggctaaggcaggaagatcacctgaaatcaggagtttgagaccaccctggctaacatgatgaaaccccgtttcaactaaaaatacaaaaaattagccaggcatggtggtgtgcacctgtaatcccagctactcaggaggatgaggcaggagaatcgcttgaacccaggaggcagaggttgtagtgagctgagatcgcgccattgcactacagcttgggcaacaagagcgaaacttcgtctcaaaaaaaaaaaaaggtcagtatgatttagagtactaatacagtacactgcataactgattttaacagcttttttcataagaccaacacttgacagcttcccaatacttaaatattttctgattagtgatatattggtaatacagtaatccaatccagagctaggcttgggagaaattgagcccaagaaacgagtggtcataacagcaggggagaaaaaggcagcctgagtccgggaggcctaagcctcagagacagagaggggaacacagggttcaggtatgggtggcatggatgccctcactgacaaaatacagtgctatttagagcatctaatgtcctctaacacagaaccatcagctgcctgggttccagtctctagaaaagagaaaaacaatatgccaaccacaaccctaatgcaagggttaccatatgtatatgtttctattgtcttccttaggcttacgtcatttttacagttgcaataatagtaggtactcagttaatattagcattgtgtgccaagaacagtgctaggtagggggataatccttattttcacaccaaacctgcagagtagctaacaatatcctcatgggacagataaggacactgatgcccagagagtcaagccacacaactggtgaggggataaagttaagattgggaccctagttgctttgggttcaaagtcagtatcttttaatgacatcacaactgcctctcccataaaatatctttgcctgctacttacgcatacattgctttttggtgagactttatcatgttactatgtggtcttcaccattgtaactgttttttttttttttttttgagacattctctgtctgccgtccaggctggagtgcaatggtgcaaactcggctcactgaacctccccttcccgggctcaagcgatcttcccccctcagccttccaattaactgggaccacaggcacgtgccaccacacctggttaatttttgtatttttttgtagagatggggtattgccatgttgcccaggctggtcttgaactcctgggctgaagcaatcctcccacctgggcatcccaaagtgctgggattactggcaagagccaccgtgcccagttcattgtaacttttttttttttttttttgagacagagccttgctctgttgcccaggctggagtgcagtggcgcgagctcggctgactgcaacgtccacctccctgctcaagtgatcctcctgcctcagcctctcaagtagctgggattacaggcatgtgccaccacactcaactaatttttgtatttttggtagagatggggttttgtcatgttggccaggctggtctgaaactcctggcctcaagtgatcacccacctcagcttcccaaagtgctgggattacaggctgagccaccacacttggcccattgtaacttttttgaagttcagcattccaaggagtgaagctatcattattatgtaatcaaccatttttccgttgctgaaatttttatgatcataaataaagctacagtgaatatgaaaaatttgttttaatagaatgatccacaaaggagcggatctagaaataaacatcatgaaattaagaaaattaagatacactttaagaccatttccatattgattaaaatcattagtttttcttacttaataaaaaaatctttgttccacaacagcttaataacaacaacacatacacacacacaaaattgaataatgtgagctcatgtatgtcattaactcattcttagaattgaattattcatctagtaagatctaaatggaagcaatgtataaacactcagctgtctaacccttttaaaataatggtaaactgctcttttactgctcctattcatcctatagacaaaaactacaactgttaatttttaaatatggcatgtcctttatttagggcaattttcaagcatatacgagaaaataagagctagcaaaaattagatcagatacagtccggtcaactcagcattctatctaatggaagtgatgctgaagatcaattcctaagaaagcatgctggctgtccttgataggagagatcacaaaatgttcaagaagccgcacaaaataccctctttttttttttttttaagtaaaagcttattgcccattccttaatctgaagaaaaggactatttatagatagtgaatcaaatacaagcatttgccttgtataaaccccactaaaatggcagtaaaggcatacagctccaagaacaaagagaatgggagaaaagatacacgacattttgaaagttggctaataagtatctattttggcagatgataccttatataaatttcaagcctcttcatatattttccttttttattaaaaattgctaattatgaaaaattcaagactggtataatctggacagtattgttctctcactacagatgaagtttgtatctacttttctttttttattttctagattgagtcttactctgtctcccaggatggagtgcagtgccgcgatctcagctcactgcaacctccacctcccggattcaagcgattctcatgcctcagcctcccgcgtagttgggattacaggtgcatgccaccatgcccaactaatttttgtattttcagctgagacggggtttcaatcattctgatatcttttaaataaaatatttattttatatctctttttaaatctaacaaacgaatatatttataaactggtagctttgtttgtttttttcagatggagtcccattctgttgcccaggctggagtgcagtggtgcaatcatagctcactgcagcctccacctccccaggctcagggcacctcagcctcccaagtagttgggactacaggcatgccttcacaccctaatttttgtatttttgttgtagtgacagggtcttgctgtgttgcccaggctggtctcaaactcctgtgctcaagcagtccacccgcctcagcctcccaaagtgctaggattacaggcgtgaaccactgggcccagctaaactggtgctgtaatccatttatcctaattattgtgattactgacacatttaaatgagttattttcccccactttatttttttgctttttagatttcttttccatacccttttctcttcacttcctgctttctattggattgactatgttttctttattctttctttcctctatttagtatccaagttttacattttattttcattctttaaattgtttatttatttatttatttttacttttttgaggcagggtctcactgtgttgcccaggctggagtgctgtggcatgatctcagctcactgcaatctccacctcctgggttcaagtaattctcccacctcagcctcctgagtagctggaaccacaggcacacaccgccacacctggctaatttttgtatttttagtagagacgggatttcgtcatgttgcccaggctggtcttgaactcctgagctcaaatgattcacccacctcagcctcccaaagtgctgggattacaggcatgagccacctcgcccagcctaagttgttattcttaatttttattatgcattcttaaattataaagtctaaaattatggcacttcatgatttttgagttttatgttttgcttagaaaagctaatctcagtttcaagaataaaaattatttttattttctgtagtacttttataatttttgtctgtacattttagtaattaactcatctataattctttctgtgtagggtttcagggagggaatctacctttatttagtgtccaaataaataactaatggtctgaacacctcttatactgtccatttcttccccactgatttgaaatgtaatctttattattaagtaaatttccatatatatggatctattttgatacattctactctattccaatctatttagctttcctttgccattactaaactatcttaattactcttgtctttctaatatctaatagagcaagttcttccagccctatatgctattcattgctctttaaaaacagaaaagaaaaaacttttacaattgtctgttcttgtctatattctctcttcatatgtcaagttcctatcctcaattctctcttcatatgtcaaattcctatcaaggttttgattgagattacattgaatttaatgattaattgagagattaccataatcataagactgaatattatcataaattatattatctcttcatttattaaaaaaaaatttttttttttgagacggattctcgctctgtcacccaggctggagtgcagtggcgcgatctaggctcactgcaagctccgtctcccgggttcaagccattctcctgcctcggcctcccagtagctgggactacaggtgcccaccaccatgcccagttaattttttgtatttttaatagagacagagtttcaccgtgttagccaggataggctcaatctcctgacctcgtgatcgcctgcctcggcctcccgaagtgctgggattacaggcatgagccactgcgcctggcctattcaaaatgttttaaagtgtctttcagaaaatatttatactttctttctcatataagtgttacacatttcttgtccggtttaggcttttgttattcttataaatgtaatttttttcctctacattttttcattagttattgtggcataagagcagatattgattttgttttccttatacagagccattttattgcactctcattaattcaaattagtgcttcattggttgtcttagattacctctattgcctgtgtatataatgatttttgttgcttcctttccagtatttaactcatttctatgtttcttttccattggctaagacctctagaacactgttgaatagcagcagttatagcaggcattttttgtgttattcatgaaaagccttctaacgtttcataataaactgtgatgtttaagtttttaaatagatagcctacatcaaattaaggaaatttccttttcctagcttacaatagcttttatcaggaatgggagttaaattttatcaatagggttttcagtatcttagaaagatgatctcttttattatttttctttcagtatactgaacatattccttaaggtcaaccacagttggatcaaacctacttggttaattcagttcattcaattcaacaaatattcatgtacttaatatatgccaggcagctttctggccacttagcttgtattaaaggaactcacaatgattcctaccctcatggagcttatattctagtagatatccatgatctattttttgtttaacctgttgttgaattaaaattgctaatttttgatttaatatttttatatttacatttataaatgagattgatacaagtatttctttctgtgccatacttgtttgcttcccttattaagatttaccttacagaaatatattgcaaatgtctcattattttctatgctatggaaatgtgaaagtaacaaatgaatttgtctcttctttagagattatctataacttgcccataaaatcacctagacttgagaccttttcttttcctttttttttttttttgagatggagtctcactctgttgcccaggctggagtgcaatggtgcagtcactgctcactgcaacatctgcctcctgggtttaagccattctcctgccccagcctcccaaatagctgggattacaggttcccgccaccatgcccagctaatttttgtatttttagtagagacagggtttcgccatgttgaccaggctggtctcaaatttgtgacttcaagagatctgccctcctcggcctcccaaagtgctgggattacaggtgtttgccacagcgcctggcctcttttcctttttttaattaaaaaaatttgtttaatcgtagttaaaaaaatacatacaatttaccatcttaataatttttaagtgtacagttcagtcatgttaactatattgtgctctttttcttcttcaataattttttttaatatcttagattccccacctctttttgagtcaattttggtttgttatatacttagataaatttcacccgaattttaaatttattgctataaggtaatatgcaatacattagtatgcttttaaaatcttcactatttctgtgattatatgtccttttcattccaatgctttgttgttgttgtttttgtttgtttgtttcgagacagagtctcactctgttgctcaggctggagtgcagtgttgccatctcagctcactgcatcctccgcctcccgcgttcaagcgattctcatgcctcagcctccagagtagctgggattacaggctcatgccaccacacccggctaattttttgtatttttagtagagatggggtttcacaatgttggccaggctggtctcaaactcctggcctcaagtgatccacccacctcggcctcccaaagtgctaggaaaacaggcgtgagccactgcacctggccctgatgctatttttatattttctctccttctccatctttctttttttaatcagacttgccaaagattggtctgttttattggttatcaaataatcagatttttagtacactaattgagtgtgccttttattgtttgttttttatttcattaatttctgctttatctcttttaattccatcccccaacttttaaaagagttgtttgtaatgttctttgcctagcttattgagtttaatgtttggttcattgattttcaatcttttatgttctttgagtgcatttctaaagctatacatcttcttttgaatgccactttctgtacactataggttttgctttgtaatgttttcagtattgtctttaatttccattttgatttaccctttaacccaagaattctttctttatttatttatttttttgagacagagtctcactctgtcacccaggctggaatgcagaggtgcagaccctccctccctccctccctccctccctccctcccttccttcctcccttccttccttccttcctccctcccttcctcccttccttccttcatctcactctgtcgcccaggctggaatgcagtggcgcggactcgactcactgcaacctccatctcccaggttcaagcaattctcgtgcctcaatctcccaagtagctgagattacaggcgcccaccaccacacccagctaatttttgtatttttagtagagatggagtttcaccatgttggccaggctggtctcgagctcctgacctcaggtgatccgcccccgctcagcctccctaagtgctgggattacaggtttgagccaccgcaacccgccccaagagttctttttaccttacaagcagatagttacctttttagttacctgttggcactatacatatttttttcctcccactcctccctttacactcatttccacccagagaactagtcctccactttagggctgagactcccaagactggccccatccactgggctaatgagcagcatgccctcatttcaccctgctccttcttgtaagagtcattttacacatttgtctttcccacttagctgaggccctaaggtaaggaatttagagatctttcccaccactaaggccctaaggtaaggaattcagaatgtatctctgaatacattcagaaatgtaagaaactcagttttaaagcagaaaaattatatatcactatgtctatatagtagttatagccaatgtccctaaacagaaaattgtccaatggtgcaaaggaattagtaagaatatctataatttctagatccacatttcaaatctcatattaaaatagataacattatttgtttttaaactaaattcttcatataaaatacattcagaaatgtattcagagatacatttccaacaatgattctcaaagcaaagtccagagacctttgcaccagcatcgccagtggtactattataagtatatatactgagccccatctcagatctattaagtcagaatctctagggggagggctcaggaatctccatttttaacaagcaccctcaagatgagtttattctagcacgctgaagtttgacaactatttctctaagtgataccctgataagcttcagttaagtacagagcagatcaactaggtaaaaaggtgttaggacccgtgtcatataaagaattttaaaggaacgtaggatatttagtactaaaaacaaacataaaaaagaattggttggcagaacatgagagatgccacttatgtgaaaaatactttagatttattccatacagtttttggagggtaagttcaaagggtagaaattagaaggagatagatttccgctttaatgtaaggaaaagattgccaacaatttgagctcttcaaaaatggaatagacttattgtgaattcgtgagttcacccctatttggacatagtcaagcagatgatgaatgactttatgccagagatgttgaagagggacttttacatcaaactagttgatcactacattcccttgcaactcaggattcttaagattctctaattttaggaatatgagttcaatatgggttataattattataacatttttcaggtgatactagaagcccatttcctcatagtcaaggatgtagacacatttagtgatttcacacaatgtatataaaaacaagcctgaggctaggcactatggttcacgcctgtaatcccagcactttgagaggttgaggctaaaggattacaagattacttgagcccaggagttcaagaccagcctaggcaacatagagagactcctcccctacaaatttttaaaaattattcaggcatgatggcacgtgcctgtagtcccagctactcaggaagctgaggtaggaggacctcttgaacccaggaggtcaaagctgcagtaagccatgatagggtcactacactccagcctgggcaagaccctatctcaaaaaaataataaaataaaataaaataaaaactggtctgagtaaataaaatctcacccaattatatttttttcaaatttaagagtttttaaaggtttattttatttttttattttttgagatggagtcttgctccatagcccaggctggagtgcagtggcatgatcttggctcactgcaaccttcgcctcccaggctcaagtggtcctcctgcctcagcctcccaagtagctgggattataggtgcactccacaatgcctggctaatttttgtatttttagtagagatgggatttcaccatgttggccaggctggtctcgaactcctgacttcaagtgacccacccgcctcaacctcccaaagtgttgggattacaggcatgagccacctgttatattacaggcatgagcccaccacctggggtggtggtgcacacctgtagtcccagctacttgggaggctgaggtaggagaatcgcttgaacccaggaggcagagggtgcagtgagccgagatcacaccactgcactctagcctgggcaacagagcaagattctgtctcaaaaaataataataataataataataataataaataaaaataaagttcaaggatatgtagcaaagaaaatcacttacaacaacccaacattatagtctgtctataaaataaacacatctactccttccaacttcataagggtgaaaaataagagtttaaaatatgaagcagaaacaagatgtattagttacctgtgaaaatagctctctgattgtgtgcctttaaattggcaggggaaaaaaaagaaactcagttttaaaacagaaaacttatatatcactatgtctatatacttgttatagccaacgtccctaaacagaaaattgttcagtggtgcaagggaattagtaataataccaataattattagattcagatttcaaatcccatatgaaaataaacaatattatttgttcttaaactaaaattttttttttttttttgagatggaatcttgctctgtcacccaggctagagtgcagtggcatgatctcacctcactacaacccccgccttccaggttcaagcgattgtcatgcctcagcctcccaagtagctgagattacaggtgtgtgccaccgtgaccggctaatttttttgtatttttagtagaaatagggtttcaccatgttggccacgctggtctcgaactcctgacctctagtgatctgtccaactcagcttcccaaaatgctgagattacaggtgtgagccaccgtgtccagccagaaaacctttgtggaggtgctggggattgacccagggcctcatgcatgctaagcgtgcgccctaccactgatctacaccccctttaattcttaacatcagaaatattattcaacagacacatatcagagttgagggaaattattggaaaattgagaccaaaaaaagcatacagaaagttaatttattttctagacagaactctgctagtattagaatcaaatacttttaattagatagtaatttacttgctttcttgtaacttaaggccatcttctctagtctgtttgttacagtcctacacatattaaatagcaaaaacaaactaattatatattttgcatgatcagtatgttacaacattaagatcagactaataatacaagtcacctactccattgccaatttttatactccctgcaatcttacagcacatcctcatatgaacaaaaagcctttatatttatcttacagaggatataaacatcaatttataaaaaagagacacaagccttatatagttaaaagtaatataattaacatgattacaaaaacatttctaataaagcagaggaaataattatattgcttgtagttctagtaagagtttattgaaccattaaaaataatttcaaaacaataaaatacaaaggcaaatatccaaatagttttgtatggatctagcattcacttttccttgatccaacctagttttaattcctatggcctacaggatggcttagataaggaagaagctaaaaattggctgttacagagttgcagttgtgtggcatatgggtgatctacgtaactgaagttgaagggagaaatgcaatcttcccccaaaacctgcttttccttcagtccactgtcacaatcctgagtccagctactctctcaacatctccatctccctggctaaaacctcccatctctcatctgggttgttgtaaagcctcctaactaacctcacttcttttgcctttgcctgctatgattaattcccaacccagtagccagactgatcctctcctcaaagctctccagtggcatttttttttttttttttttgagacagagtcttgctctgtcacccaggctggagtacagtggggcgatctcggctcactgcaacctccacctcccgggttcaagtgattctccttcctcagcctcctgagttgctgggactacaggcgcatgcaaccacacctggctaatttttttttttttttttagtagagacggggttccaccatgttggccaggatggtctcaatctcctaacctcgtgatccacccgcctcgtcctcccaaagtgctgggattataggcgttagccaccacgtctggcctccagtggcatccttattcaaaataaaagtaaatatcctagggtgggcatggtggctcacgcctgtaatcccagcactttgggaggctgaggcgggcagatcacttgaggtcaggagtccaagaccagcctggctaacatggcgaaaccccatctctactaaaaatacaaaaattaattggacatggtggcaggtgcctgtaatcccagctactggggaggctaaggcaggagcattgcttgaacccgggaggcggagattgcagtgagccaagatcatgccactgcactctagcctgggcgacagagcacagctctgtcttggaaaaaaaacaaagtcaatatcctcacaactaggtcctacaccaactattccccattttccatcttccgctgtcaatcactcagctaccctggctgctttgctgtcttatgaacagcccactcccacctcagggatttagcaattgctctttcctttatccaaaaaactttcatctggattacatgtatcttattcctttaacatccttcaggtttttgctcaatgttcatttttcagcaaatgattccctaaccaccacatttataactgcaaaccttatgcatctcaacactccccccaacctccttctttaaacttgtttttgctctatagaacttactaccacatgattactatatattatgcttattttgtgtactgtctgattgtcctcactagattgtaagagagattagggatttttgtctgtttttttcaatcccatatttccatggctagcacctaataggtattcaacaaatgcttgttgaatatatgaacatcctctataaatcctctagtaaccagtgtcgagaactacatgcctatgtaggtgacccaaacacttcctctaagaactgtatagaaaaataatttcaggccaggcgtggtggcttatgcctataatcccagcactttgggaagccgaggcgggtggatcacgaggtcaagagatcaagaccatcctggccaacatggtgaaaccacatctctactaaaaatacaaaaattagctgggcatggtggtgcgtccctgtagtcccagctactcgggaggctgaggcaggaaaatcgcttgaatctgggaggcagaggttgtagtaagacaagatcgcgctccagcgtgcactccagcctggcgacagagcgagactacgtttaaaaaaaaaaaattcatttaatttaaacatcttaattaaaaatagggagcattcaattaaacattcacataataactacacaattattctctttacttctttcctactttaagccttgatgccatcactacttccagaaaaaaaaatagttcctaaatatcccacagaagaaaacaaggtaatgttaatataaatactctgcccctacatttatgcagtcttccctcatatttttgataaattccacacccttccaccagaagttaaagaaaggagacgtatcctcccactttcggaaatgctttaaccaaaattaaagagagaatgaacaagctatccgtaggaacccattcatcgatagaaaggaaaaacatttcctaagaaatgtcagagacaaatgactctggatctaacaccatttggggggtttcataccattgctaacacagagacataatattattagatttatattaataaggctgagtgtagtggctcatacctgtaatcccagaactttgggaggccaaggcaggaggatatcctgcttgaggacaggagttcaagaccagcgtgggcaaaatagtgagacccgatctctacacaaaataaataaataaaattagcacagtgaaaggattgcttgagcccaagagttcaaggctgcagtgaactatgattgtaccactgcacaccagcctggggaagagagtaagaccttgactcttaaaaaaaaaaattgtattaatacactacttccagaaattaaacaagacatacacagtatgtggatataaacaaagaaaatgatttccatgtacaaaacataaaactcatagattaataactcaagtttcctagtctattttcttattttgtttcattaaaaaaaaaatttgagacggagtctcaccctgtcacccaggctggagttcagtggcatgatctcagctcacggcaacctctgcctcactggttcaagcaattctcctgcctccgcctcctgagtggctaggattacaggcgcccgccaccacactcggctaatttttgtatttttttttcagtagagatgaggtttcaccatgttggccaggctggtctcgaactcctgacctcaagtgatccgtctgcctcagcctcccaaagtgctgggattacaggtgtgagccaccatgccccgtctacttagaggtctagtaaacttaaatcagttctgaagcttttccagacagtagtagtaaaatacactataaatcagattacctggttctcaattcaatgttcttttcattctgtcatgctgctctctaaatttgagtgttctcttgaccaggaattaaattattctctatatctgagttgaaactactatatcaccaggaaataaaaaagtctaacttcccaatattattcctaaattaaatcgtggttagtcaggatgttgctatatacttttaataataactgaaaattgaagcagaaaaaaccccaattcactatgacttgtatattttgtgccatgaacagaggaaattgtcatttacagtataattttctgggcataggcatggattccggtgttcacatccccaagttcaaatctcagttttgtcacttattaggggacattatcttaatgtctctaagcttttattttccttctctctctctctctcttttttttttttttttttttttgagacaggctgattacaggctcgacctcctgggctcaagcaatccccctgcctcagcctcccgagtagctaggaccacaggtgcaaaccaccacgcaattaatttctgtattttttatagagatgggttttaccatgtgctcaggctggtcttgaactactgggctccgccttggcttcccaaagtgctggaatgacacaaatgaaccaccgtgcccagccctattttctcatttttaaaaaagaaaggttattgtttcaaaatatgttgtacatgaggccaggtgtaatggctcattcctgtcatcccaacactttgggaggctgaggcaggaaggtagcatgagcccaggaattcaagaccagcctaggcagaacagtgagacccccatctgtacaaaacttttaaaaaaattctccaggcatggtgttacgtgccagtagaggctggagggtcacttgaaccagggaggtcaaggctgcagtgagccatgattgcgccactgtactctagcctgggcaatccagggagaccctgtctcaaaaaaaaaagcatgctttacatgataaatattacaatttttgccaattaaaaataaatatttatctctcatatcccaggaaatcaagtaaaaataaataaaagaaataaatgaataaaatttaaacaataaaaagaagatagcactactacttatgtctttgagttgtgagaaaaatgcacagaaagtacttagcacatggcctaacacatatatatattcatagtgacagatacactactgtcaattgcagtcagacatgaatggaaatcataatcagattctcacctttcaaactttagatgtgacttcatagtaattcaacaaatcttccaagtccagaacacctgttgatttgaatcttacagcaattacttttatctagtctttaagaaatgaaaaaataatgtaacagcaaactcatgcagtgactcaataaatttaaagccataaacaggctaaatccaacactaaacaagcattttgcaatctattttagccaaaacaatgcattttccctcattcacataacaattactcagtatgccagctcccagtgttacagagcctgttcttggtgattcaagggcgccctctgtctgagtgctgaaaaaatccaaacccaaatttaaaactatgtaaaaacatgctttcaagtaaattcttaataaacagttctatgaaattgatcctgtctttaatcactgctggcagatagtccttaaaaaaaaaaaaagaaaagaaagaaaaaaacggctgggtgcggtggctcacgcctgtaattccagcactttgggaggccaaggcaggtggatcacctgaagttaggaattcaagaccagtctggctaacatggtgaaaccctgtctctactaaaaatacaaaaattagccaggcgtggtggcaggagcctgtaatcccagctactcgggtggctgaggcaggagaatcgcttgaacccaggaagcagaggttgcagtgaaccgagattgcgccattgcactccaacctgggcaacgagagctagacttcgcctcaaaaaaaaaaaaaaaaaaaaaaccaccaacaaatgtcatgtcatttgttacaagagcacaagaaattcatgtctacatctctgtaatttacctggaaatttggaaattccatgatatttttctcaaaatttattccatattattcaatgaaattattgacatgagtcacctagataagtttattgctctctttttttgtcctgtccatgtaaaactctgtactttatttaacatgtcattgttaataaatgacatgttatttattattattattatgtctagtttctaaaacaagacacataaaaaggatgtgtacaaaaatatatagtgaaatgcccactaaaaagtaggtttctttccatctgcttccactttaaggaagttattcaacttctctgaacctcagtttatctggaatataaaaataatatccaccttaaaggaaagttgcaaaggttaattcagatatctgtaaaggtctcagcacatagtaaaagcttaatgaaaggtggttgttattatttactactattattaagagaataatcttaaataatagtgtcctacattaaagacattttatttgcttcaaatggaaagatatgtaaataaaaaagtttatgatttacttttacaatattaaacagtctttctagttaagaaaaacagtgatcttgattaaatgcttgacagatcaggaatgagccatttctaaaagattatttcaatataaaaatattatgctctcttcatgttaaaaactctcaataaactatgcattaaaggaacatacctcaaaataatgagtcatctatgacaaacccacagccaatatcatactgaatgggcaaaagctggaagcattccccttgaaaactggcacaggacaaggatgccctctctcaccactcctattcaacatagtattggaagtcctggccagagcaataaggcaagagaaagcaataaacggcatctgaatagcaagagaggaagtcaaactatttctgtttgcagacgacatgattccatatttagaaaaccccatagtcttggctcaaaagctccttcagctgataacttcagcaaagtcgcaggatgtaaaataaatgtacaaaaaacactagcactcctatacaccaacaacagtcaagctgagagccaaatcagaaaggcactctcattcacaattgtcactaaaaaaataaaatacctagcaatacagctaaccagggaggtgaaagatctctacaatgagaattacaaaatactgtgcaaagaaatcagagaagccacaaacaaatggaaaaacatcccatgctcatggataggaagaaccaatgtcattaaaatggtcatattgcccaaagcaatttacagataaaatgttattcctatcaaactaccaataacattcttcacagaattaggaaaaactattttaaaattcatatggaactaaaaaagagcccaaatagcaaagccaaaaagaacaaacctggaggcatcacattacctgacttcaaactatactacagtggccaaaacagcatggtactggtaaaacaaacaaacaaacaaacgaaaacaaaaaacaaaaaaaaaaaaacaggcacatagaccaatgaaacagaatgcagagtccaaaaataaggccacacacctatgaccatctgaacttcaacaaagctgacaaaaacaagcaatagagaaaagactccctagtcaatacatggtgctgggataactggctaaccatatgcagaagattgaaactggactccttctttacaccatatacaaaaatcaactcaagatggaataaatacttaaatataaaacccaaaactataaaaaccctggaagacaacctaggcaatactatcctggacttaggaacaggtgaagatttcatgacaaagatgctaaaagcaatcgcaaaaaattgacaaatgggatctaattaaacttaagagtttttgcacagcaaaataaactatcaacagagtaaacagacaatctacagaatgggagaaaatattttcaaactatgcatctgacaaaggtctaatatccagcatctataaggaacttaaacgaatttacaagagaaaaacaactaccccattaaaaagtgggcaaaggacatgaacacttttctttccctttttttttcttttttttttttgagactgagtttccctcttgtcacccaggctgtagtgcagtggcacactctcggctcaccgcaacttctgcctcttgggttcaatcgattctcctgtctcagcctcccaagtagccgagattacaggcatgtgccaccatgcctggctaattttgcatttttagtagagacgaggtttctccatgttggtcaggctggtctcgaactcccgacctcaagtgattcacccacctcagcctcccaaagtgcttggattacaggcatgagccaccacgcccggctgaacagacactttccaaaagaaggcatatatgcagccaacggacatatgaaaaaaagctcaatatcaccgatcattagagaaatgcaaatcaaaaccacaatgagataccatctcacaccagtcagaatggccattattaaaaagtcagctctttcccatcttacaagatggagggtgaacaagttgagaagccagatactaaagagaagaaacctgaagtcaagaaggctgatgctggtggcaaggtgaaaaagggtaacctcaaggctaagaagcccaagaacaggaagccccattgcagtcaaaatcctgtcattgtcagagggattggcagatattctccatctgctatgtattccagaaaggccacgtgcaagaggaagtactcagctgtgaaatccaaggttgaaaagcaaaaggagaagtttcctgcaactattacaaaaccagctggtggtggcaagaacggtggtacgcaggtggttaaactttgcaaaatgcctacatattatcttactgaagatgtgctttcaaagctgttgagccaaggaaaaaaacccttcagtcagcacatgagaaaactgtgagccaggatcactcccaagaccattctgatcatcctcactgaaagccacaggggcaagagggtgattttcctgaagcagctggctagtggctggttacttgtgactggacctctggtcctcaatcaagttcctctacaaagaacacaccagaaatctgtcattgccacctcagccaaaattgatatcagcaatgtaaaaatcccaaaacatcttactgatacttacttcaagaagaagctgcaggcagggcatggtgactcatgtctgtaatcccagcactttgggaggccaaagcaggcaaatcacttgaggtcaggagttcaagaccagcacggccaacatggtgaaatcctgtctctactaaaaatacaaaaattagccgggtgtggtggcatgggcctgtaatcccagctacttgggaggctgaggcaggagaatctcttgaactcaggaggcagaggttgcagtgagcccagagcgtgccactgcgcttcagcctgggtgacaagagggaaactcagtctcaaaaaaaaaaaaaaaaaaaaaaaaagacgctgcagaagcccagacaccaggaacgtgacatgttccatatagaaagagaaatacgagattacagagcagcacaagattgatcaaaaagctgtggactcacagattttaaccaaaatcaaagctattcctcagctccagggctacctctgatctgtgtttgccccgacaaatggaatttatccttacaaattggtgttctaaatttccttttttttttttttttgagacggagtcttgctctgtcacccaggctggggtgcagtggcctgatctcggctcactgcaagctccgcccctcaggttcacgccattctcctgcctcagtcttccgagtagctgggactacaggcgcccaccaccacgcccggctaattttttgtattttttagtagagacggggtttcaccgtgttagtcaagatagtctcgatctcctgacctcgtgatccacccgcctgggtctcccaaagtgctgggattacaggcgtgagccactgcgcccggcctggtgttctaaatttcttaagaagaatctaattaaataactgataacaaaaaaaaaataacagatgctgatgagattgcagagaaaagggaacacttctgcactgttggtggagtgtaaattagttcaaccattgtggaaagcagtatggtgattcctcacagagctaaaagcagaactaccattcgacccagcaatcccattattgggtatatacccagaggaattctaccctaaagacacatgcacacgaatgttcattgcagcactgcgcacaatagcaaagacatggaatcaaactaaatgcccatcaatgacagattggataaagaaaatgtacgtatacaccatggaatactatgcagccataaaaaagaacaagatcatgtcttttgcaggtacatggatggagctggaggctattatccttagcaaactaatgcaggaacagaaagccaaatactgcatgttctcacttataagcagaagctaaatgatgagaactaatgaacacaaagaaggaaacaacagacactggggcccacttgagggtggagggtgggagaagggagaggagcaggaaaagtaactattgggtactaggtttagtacccaggtggctaaataatctgtacaacaaacccctgtgacatgggtttatctatataacaaacctgcacatgtacccccgaacctaaaataaaagtttaaataaataaataaataagaaaaaactattatactcaagactcctttaccaccaatgaaatttaaggagttacaggaatatgaattttctagtacttacttcatatggcttgcctgttctcttaaaacatcatctaagatgttaaaaataattcagtcacatttatggtcatctacatatctaacaccaagagcagccccaaaacagaataatgataataaaagggatcttagcaattaatctagtttgatcttttttaaggaataaaacttattctgtatctccttaacattataagttattctaaaattcatctcatgaattgcaataattctgggaggaggcaagcacatgataaatatttttatattccatttgttgatgaggaaacttataaacagtaaaactaagcacagtataaaatacttgttatgaaaaattaattatagctaggctaaagactacttgtattatctcaattctcacatcaatctgaggtaggcgttattttctccatttacaaatgaggaaactgtgacacagagaagttacataacttgccaagttatgcagctagtacacacagaatcaaatccaggctcactgattccagagcctacactcttaacctctatattatatttttcctaatacctaaaaagaacaattttcttaaatatccatgagtctataactgacacaaataaatgactgaataaataaataaatgggggaagacaggacaggtcttctttacagaaaattccaatacatacagaaggaatgaagaaaataatcaccattagataaacaccaattgttgcaggcaagaaccatcaatggattacagctaaaattaggaggtgaaagtatgatgagaaacagaatattttcatagcttcaacacatctctccatatgacatatgttaattacaaggagaaaaatagtaattttacagtggagaaagcctgcagacaccaggtaaaccaagtgatcaaagttaatatcaccaatgataagatatatcaacattatgtatgccatgatattgagaaggctacatcacttttttgatatttctgccaaaaatgcacaatctcaatctaataatgagaaaacattagataaacccatattgacggatattctacgaaacaactgaccagtgtgcttagaaagagtaatttagttaatagtattttaccaatgataatttcccagttttgatctttgtactatggttatgtaagaagttaatattgaaggaagtttggtaaagagtataagggaactctctatttttgcaacttttctgtaagttttaaatttcaaaataagaagttgaaaaagtaacaattttcttaaaatctataatccaaaccttattaatttatcttcctctttattctcagagaggccaaattggtaagttctcccatgagttgactagtgtcactggcagaggagctaagaatagttctccatgggtcaactgtcttctccatatactacatgcttctgtaaggagattggatgatgacgatacacaataatcttgtatttgtaagtagtaagaacaactattttaaaatgaaaggattcagtcttttctcttagaggtgttcattagtttttaatcatgaaataaaattattgcccatgattctgaggttctgtgtcttgatactctaaaacattatatacagtgaaacagcattctgttaggatttgtccaataaagtacttttcattatcataatgttttaaacatgtagactcagtaatccttactctaagaatgtagagatatgactgtgctaaggcaataagtatgaataaacagaaatgtatagctagctaacatcacagcttaactcaaaaggtctgaaccaagcctaaagcagaaaagtatgacaagtgaaagcactgcccaaatgcccttggagcataattatgagcccattttaaggggcaaatactaatagaattggatgaaggattgtgggacagaagatttaggggtaaagaatagtattaaagctcaacggaaagagaacaaaaactactcaatctccttgtattcgctcagcccccaataatcttgaccctctactgctttgctactcaaaatgtggtccatggaacgccagcaccaacatcatctggagctagttaaaaacaaaggatataggctggtgcctttaatcccagcactttgggagaccaaggcggggccaatcacttgagtccaggagttcgagatcagcctgggcaacatggaaaaatcctgtctctacaaaaaaatacaaataaattaatgggcatggtagcacatccctgtactcccagctactcaggaggctgagggaggagggtcacctgagaccaggagtttgaggttgcagtaagccgagttatgattgtagcactgcactccagcctgggtgacaggctgtttattttttgagactgggtgaccctgtcttgaaaaataaaaataagtaaataaattaaataaataaaaatacatgatgtaataagacctcatcccagatccattgactaaaaaatcttcattttagcaagatccacacttgatgaatccccaggagatttgtacatgcacattaaagtttgatcaacatttcccaaacacattgagttttaaggaaataaacaataagatatgtcataccacattaatctccaaattggtggtttaagtagcttggtatttcattagacagcctttcaatctcactttagaagagaaaagcacaataaaacatccagtataaaaggtattttaggtattctttatgcttatctgtcagagactagttaggaaaaaatatttcttttacaataaatttcttattttataattttcttacaaaatataccaaatctgtgttttaaagtaaatatattatgtattagacatttttaaagaatactgacaaattaaggtactgaatgcaaatatatactttcttactttcttttcttttttttttttttttttgtgacggagtcttactctcttggccaggctggagtgcagtggtgtgatctcggctcactgcaacctctgccgcccaggttcaagcgattcttctgcctcagcctcctgagtagctgggattacaggtgcctgccaccacacctggctaatttttgtagtttttactagagacagggtttcaccatcttggccaggctggtcttgaactcctgacctcgtgatccacccccccccccccccaccccggcttccaaaatgctgggattacagacatgagccaccgcacctggccacttttcatattctttctttttttttttttgagacagagtttcactcttgttgcccaggctggagtgcaatggcgcaatctcggctcaccgcctcctcctcctcccaggttcaatcgattctcctgcctcagcctcccgagtagctgggattacaggcatgcgccatcacacccggctaattttgtatttttagtagagacggggtttttccatgttggtcaggctcggtcttaaactcccaacctcagatgatctgcccgcctcagcctcctaaagtgctgggattacaggcacgagccaccatcatattctttctttaatgcccagtctaggtagggaagattaacatttactaatatgttcattaaaataaacataaaactcggctactctgggcacactgcctatggagcagccttgctcttcaaagagagggaaaaaaagaaagaaaaattattttaaaattattttaaaacataaacataaaacttaataacaatgtaaatacaaaatattcagctaaaagttggaagggttcagaccaatatgaattacatgatccattacatctgtttgccattgcaaacaaacaaaaaaaaccagcagtcttttgatttagaatatttttagtcatctcaaccatttcatgaaatagaagatagtttaaaagagaaaaaaaatccaggatagaagtagggccatatgttcctatttaatattggcatataaaagagaaaatacaagtaatatcagcgtgactccttcagtgagatttcaatgcctcatctcacatattttcaggctattaggtgacatctagggctgaaggatttattcaccagttagcatctgttaggtgatgaactgtgtccctgcaaaattcctgtgttgaagtcctgaccttcagtatctctgtatgggattgcatttggagaaagggtctttaaagaggtaattaaggttaaacgaggtcattagggtgggccctaatatgattggtgtccttatgagaagagattaggagattaggacacagacaccacatagagaccatgtgaagacacaggagaagacagccatctatgagaggcctcagaagaaaccaacctttgacacttgaccttagacatctagccaccagaactattgaggaaatacgtttctattgtttaagctactgagtctgggggtacttcgttattgcagccctctcaaacttacatagcatctgacatacaagatatgcaataggtatttactgaaggaacgaaggttacagtttatccagcaattaattctgcccaaagctgaggctgaaggttgactttccaccagtaaagtcagattaaatatttattatgcagtaagacaggcaaaaagctattattaaatatgaggaatatccacataccctctacccatcttaagaaatgaagcatcagcattatagttgaagcacctatgctctggttcccagtggcatcccacttgctcccatgctagaaataaccactaattgaatttggttatcattctcgtgtaggatttattttttctcttttcttttcttttcttttttttctgagaccgggtcttgctgtcccccaggctggactgcagtggaacgttcatggctcactgcagcctcaagctcatcgcacccggctgactaaaacaaaaaacaaaaaacaaaaaaaaatttttttttgtttaatttgtagagatggtgtctccttgtgttgtcctggctggtctcaaacttctggcctccaacaatcctcttgccttggcccgcaaatgctgggattataggcgtaagccactgtgcccagccacatgtagcatttcttcatacacctatctataggtttgtagccctaaacaatatactattattttttgcatgttttcaaatgttatataaataatatcatactctacaaggactatgtatgttgtttctatacccctaccatctttttgagagtcaaccatatggatgcccttaactctggtttatttgtcttaactgctaaatatgaatatagtattttgttataaaatcataccatgatttatttatttattcttctgttgacggacatttaggttgttttcaacttttttgctattatcagcaatactgttaagaacattctcatacgtgtctcacatacatgtgagagttctctagggcaacgatttccaattcctttcatgaccgcacataggaaatcttggaaaagcatataggtaaaaaaaaggaggctgttcatagccagcagtgacctgcccaggggctctggctgccccaagacctgcttggctactcctagcctaataacaagtgtggggacaagagtgactttattttaaatgctaatctgccacgtaacttctgactaaccccgagtctgggaatgcctccagaatgtctaaatgatgtattagtctttatgtaagaacttctattcactgtaagtttcctcctaaaccacacttgatgcaattgcagaaatcataggctgtgatgtccacagccacctacatactccttccagatcacatatactttccctaagatataagccctgggtctggaaggtttcgatgcagagatctacctgtcatgcagctgcccagaaccatatttctgtctgtacattcccctaataaatcactcaaaactgacaaactggatttgtctgcctccttctttgccttctcagctccttcagcatttgggggccactttgcacatatggccctttcacggaacaaagaaaggaagcttccttgggagtttccatggaaggaagagggaaatataccaaggggacgaatttttgagtacaagagtatgtacagtatatctttagctttttaatgtccacattgctctccaaaatgttataccaatttttacacttctgctggcaatatatgaagtgttgttctacattttcaccaacacttggtattatcagacattttaatttttggatatgaaatggtaattccattgtgactttaatttgcattttttagattaccattgagcatctcttcgaatgtttactagtcatttatttcattttcagcgaattcccttttctaatcttttgccaagaaattatgtcttactctgagcaactgttcttttctacctgtgttagctaggaatctctcttaaacaaaagcacattctattttatatatcagagcaacttacaaaactaccatagtgcacagtctacattttgaaagctgctaatatataaaatggtctagaactgattaaaaagtgaagggggaaacctgacatacatttgttttctttttcttcttctttcttttttttttttttttttttttgagacggagtttcactcttgttgcccaggctggactgcaatggcgcgcgatctcggctcactgcaacctccacctcccgggtttaagcgattctcctgcctcagcctcctgagtacctgggattacaggcatgcaccaccacgcccggctaattgtgtatttttagtagaatcagagtttcaccatgttgatcaggctggtctcaaactcctgacctcaagtgatccacccatctccgcctcccaaagtgctgggattacaggcgtgacccaccaaggctggccctgacttatacttataacaagctcaaatcaccaaaaatttcactcagactagatcatttcatccttgggaatgcaaagatcttatttaactaaattttcagttactcaggtctctgagtatattacctgtagtttctgcagatagaaatggttctaggctaggcatggtggctcatgcctataatcccagcactttgggaggccaaggcaggcagatcacttgaggccaggagttcgagaccagcctggccaacatggtgaaaccctgcctgtactaaaaatacaaaaattagccagtttgatggcgggcacctgtagtgccagttattgaggaggctgaggcatgataatcactagaacccagaggcagaggttgcagtgaaccaagatggcaccactgcactccagcctgggtgacagagcaagaccgtctcaaagaaaaaaaaagaaatgtttcttgctgtggagtggttgcaatacagaaatccagtttctttggccatctcaaaatgctacaaatggtgaacttatttgtaataaaaagtatgaattcaggatcgttattttaaaggagtctgcacaggatttgatagctggttggtagtcatgctacaagccaactcagctataatattctcactgtggctattatcaatttacctactcagaaaggtggaatcactgaaattattgaatgtgcagacagaactcttcatgcagataatttttactcaatgatttaaagctattaaatgcttttgctaccataaagctcagcacatcacagttggtgaactgtgatgaaaatttaacaaattctgtttgatttgaggctgcgtagacactaagcctctgaaatcacttgaagcatatttttcctaagttttttcttcataaaaattgcatgttttacaaattatgatggagcaggtcaaatcttcccattagtatttctattattgtatagtaatacaagatcaagtcttaatggaaattatatttagaagctatggatgacattttctgaaattgattctatgtttaaattttcttgtcaatgggaaatacatataaccataagtgaaaaataagctaaaacatgtttaccttttgatttctaataatcgaagctgatatttattgagcatttactatgcaccaggcactgtgtaaaatacttttttgcacattatttcatttaattctcacaaattcatgaggtaggttacgttattaccatttatctgatgaagaaatggttagagaaattaagaacactgcacaaatactagttgtatgacacaagtaatcctttctttctttctctttctttcttcttttctctcttctcttctcttctcttttttcttttcttttctttctggcagagtctcactctgttgcctggagtgcagtggcatgaacatggctcactgcagcctcgatttccagggctcaagcaatcctaccgcacgcttctcaagtagctgggaccacagatgtacccgctacacctagctaatttttaaattttgtgtagagacaaggtttagctatgttgcccaggttggtctcaaattcctgggctcaagcaatcctcctgacttagcctcccaaagtgctaggattacaggcatgaaccactgtgcctggccaatactgccattctttatgcaaatatttttttcaattgttatcaagtaggaaatctaattaacttcagtttcattgaatttcatctttacttccttcctatccatggcttatgagagaagtgttaacatgaagcaacaaggattatagtaaatagagaattaataatctaaaataactgagttggccatattgttattataattatgctgaagcttatttacatattctttgttttgtgttgaagccttgagctctggtgggggaaaatcatgattttgattaaacacaaaatgggcagttaaacctctaaatagtatacatggagaaagctgaagtacatttaattatttagataatcattcctgattatttaacttacatatttacaagcctaaataaaatgtacaaatgtaaatagtgctttttttttttggagacaggtctcactctgtcacccaggctgcagtgcagtggcacactgtaacctcaacctcctgggctcaggtgatcctcccatctcagcctcccaagtagctgggactggaggcgctggccaccatgcccaactaattttttgtatttttttgtacagacagagtttcatcatattgtctaagctggtcttgaacttctggactcaaacgattggcctcgccttggccttccaaagtgttgggattacaggagtaagccacgtgcctgaccaatactgcattttttgacttcctgttttctatccttaaagcactgatttcttggacccagtgaaaacaaatttttcaagttgaagattttaagttaatgtagtcattcatatttgaaggatgtcatgatttattttttaaatttaatgtctttactattgaaaatatttcttgttattatagtttatttataccctaaattaaaaataagtaggcacttcatattctggatttgctgtcacttgcctgcaacaaaacaagtaactgggtttatcctggatgagtcacaaagcaagagcttggattttatcattggtttcagttctatttttagaggtatggggatacaaaagaagttcttaatttggagacatttaaaatggcttgtgtggttttcttcaggaaggaaggatgctgtctaacttcaggaccatcacagcaccctttaaatatgtaataattattttgttcaaaatgtttttttttttttttttttttttttttgagacggagtctcgctctgtcgcaaaatgtttatgttccatatcttatcgctcaatgtataaaatatcactgccactgacatcaatgaaattttatgtgaaatggaatgagttagtaagtgtcaagtaggtattttcctcgtccctcaaaaagttatgtgcccaagtataaatcatcaaaaggataaagattctttccatctattgcttacagactgactattgtttaaaaaggcacgaatttcatagacaagtctttatctccttctttcttaaaaaagcacagaaaatggggaaaaatcttctatactgcaatctaaattataggtaagaaaaataaaaaccaagtgacataggagattggcagtgaattttcaaatatcagtaatttacaggatttacaggattttcattagcgttgtttccatgttttctgtaagatacgaacatttaaattgataagaatggaatgttcatataacatttcttgtatccatttaaagattcacattttcactttaatatataacttaagacttttctttcaaaacacatctaaaaattagtaaaatgcctaaagggaagctttatttacttggtagaaaagctgaaagaaaaaaaaacatattcttcacaatttcagaggtgacaaaaatctcttatatttcagtagtttctgatctcccttaagggatttgagaattatatataatattgcataatcttaagctgattaatgttaaagtgctattggtctattttaactgtgtacttcttaaaatataatgaaagaatttatttggtaatcctgaatctattgacctcacaaacactggtcattattttggtggaaatattcataagcatttttagttactgatttctaacaattgtttcttattatcttcctgattttacaattccccaaagtaaaggtgcgaaaaacaaacatctaccctccttttcgacaaatgccatgatagaggggagacctgtgtggtgtaaagacaaatgcagacatttggaagttgatggttttaagattcagtaaaaacttgagagttttggcttcaaatccccacgctagttttagttctaccggatacgtgtcccctacccatttcaaaggacccagtcacctcggctcttgcctgagtttcagagtcccgccggagttagagctggcagagtccaattgctcagagcgccgaggcgggggcggggcagggggacgcttgcaggtccggtggtcccgcgggctgcgagcccccacggccgaccctagctgcagaccctcctggagaacctcaggcctttcccccagaaacatccctaaaaggcgttccctttgttcattcattcaacaaatatttgttcaatctcatatgcccttctgtcttgggaaaaccaattagggcctctgcagcctcaacacaggggcactgttcccgcctattaatgacgcaatgaacccgggaagacgaatctcgaccactgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaatagcgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacggtgagtttgcttttgctcagcatttgtgaaggaaccctctcaaccttacaattgctcgtcccattccactgtaggacttagcatttaattaaacatacgaaaatgagggtcggtttgtgtggaattgaaaagttgtttatataaagcttgcccggtgggttttcagtctacatggctccagccactgcctagagactacttctacccggaacaatttattggaatcagaaatccttttctaaatgtccccgccaagaaatcattaatatgtcagagcacttggaaggctttgggatgggcctactgtttccactcaacattgtgtttttaaagtaaagctgttggagctcaagctgaaatgacagattatttgttggccacagaccagaaaacaaaactctttaaggtgatagaaaaaaatatttttggaaacttatggattgttcctgttcaaagagaccatgttttttgtttttaatcttgaagcttcagctgaaaggatagagcgtatttttcattctcgtatgttacctacctgtttggatgttcagtaaatgttttccgtatattactatttaagttatccagctaagtattaatgaaaaaagagggttagatgtgctacttgtttttattattctagactagcatacttttagttaatcttttgtttttacagactggcatagtgagtatggtatacacacaatcggagattctacagaaggaagtgtacctctttgaacgcattgattctcaaaatcgagagatcatgaaacacctgaaggcaatttgttttcttcgacctacaaaggtactgcataaactgagcttccatctgcccaggcagatgcagaacactctgatctgaaagcattaagaaggcaaaataaatttgtattatcataatttgtggcatcataattatcctggttcatcagtgttataaccttcatttttcttgttttgtttccatatttcagttgaccccttacagccagttcttccttcaagatgttttttaggttcacagccattcccattgccactaatgaactactcttaacggagacccacattactttattcctggattaacctccgtatctgtcacattgaacaccatcaacacttaattttatatacagctatgagtgtcttgaatctttgccactttattcacatttatgctcaggaacctgtggtggcttgatgttacttccatgattaaatctatatttagcccagccattaaagccctactttgttggtttgatctgcccatgtgtatccagccttcctatgtcctaggtctgcttctcctctatagccagctaggctactgttggaatgagcaattctacatgctcattcctgttccttgttttttttttcttccactgattaaaagttctttggccatttgtcactttttatccatcatcttctaaatctagcttgagtctctcctttaaaaagcctttgctattttaatcttatttgttacacttttttttttttttttttttgagatggagtctcgctctgtcgcccaggctggagtgcagtggcgcaatctcggctcactgcaagctccgcctcccgggttcacgccattctcctgcctcagcctcccgagtagctgggactacaggtgcccgccaccacgcccggctaatttttttgtatttttagtagagacagggtttcactgtgttagccaggatggtcttgatctcctgacctcatgatccgcccgccttggcctcccaaagtgctgggattacaggcgggagccaccgtgcccggctgttatactttcttgattcatattcatgttcttcaactctaatgcattttatccggcttgtgcatatgaactttccaaaatgcaaatttgatcatgacactcctgcttgaaatccttgaatgacttctcattgcttttctgataagggcaaaactccttaattgtagccttcaaggtgcagcatggtctggtttctaccatttctccagcctcatttcgaaccatcccccttttgcactctgcatcttaatcaccctgtgtatatcaatccgctatattccccttgtcccgtcatgccacgggacgtttgcatagtcttcttcctctgcctggaacttaacttcttcaagtaacccttcactgtttttgctgaccaggtcaaacctgccccttatatgcatttacaacaccatctttatctccctattgtgtgtaatggtttgaacttttatatggtttatgtgattaccagcagtaagctccatgaaaacagatatgatatctgttttttctcaccctatattcccaattcctgtcacacagtggacactcaataaacagttgctgaattaatgaacacatgctgtgttataatagtttccaattgtttcatgtttgtagctcttagtcatgaaattttggttcaagagatatgttagagatcatctagttcattatttcctaatgttttttattagagaaactctttcactgttatgtactgtctctcgaactcttttaagaatctttccttttggccgggcgcggtggctcacgcctgtaatcctagcactttgggaggccaaggcaggcggatcacgaggtcaggagatcgagaccatcctggccaacatggtgaaaccccgtctctactaaaaatacaaaaaaaaaaaaaacaacaaaaaaattagccaggcatggtggcaggcgcctgtagtcccagctactagggaggctgaggcaggagaatcgcttgaaccagggagtcagaggttgcagtaagctgagatcacgccactgtagtccagcctggcgacagagcaagactccgtctcaaaaaataataataaaataaaaattaaaaataatttttaaaaaagaatctttcctttttctttttcctcttttatatattctcttttgtctttttccacattgtctgaacttttaagaatcttttaattcactttgttatttttgcctagcatattacgaggaagtaattgaggtttaaaagatttattatttaaattttttgccttaagattatattataaagttaatttgaaatctaaattgcatttttaaatctaaattacaatttttaaaaccctttccccattaataagcagtatatattgcttacttttttttaattctgtaaagaaatgtgatttttaaaacaaattaatatgtttagggaacaatttatattgaaatttaaccaggtgttatagtatcaaaaaccaataaaacctgcattataatcttatgtaattggaatcttatattttgaccatataaaaatcaacttttttgttttaaactttcatactttattttaaaacaatgtaattgtagaaaagatcttagcctgctacttgcaaatacttcacaaacattgtagttgtgcagagtcttacatcccaataagttaaaagccaaagtgaatataattaactttattttctcttgcatgttaatttttaaaggaatagacacatttaatgctctatataggaattttgatcaggccaggcgcagtggctcatgcctgtaatcctaacactttgggaggccaagccaggtggatcagttgaggtcaggagttcgagaccagcctggccaacatggtgaaaccccgtctctgctacaattacaaaaaattagctgggtatggtggcacaaacctgtaatctcagctacttgggaggctgagacaggagaattgcttgaacccaggagacggaggttacagtgagccaagattgtgccattgcactccagcctgggcaacagagtgagacttaatctcaaaaaaaaaaaaaaaaagaattttgagcaaatgaatacaatttatagacaagcagcttgatgtgagtttgcagaattataatcaattttatgttgtgtttcaacatctgtgtcctttatattctttatcttaattggccaaaatgcagctggttaatatttaatattatacacatattattaaataatatatgattcccgatcattgtatttaatttatctcttttgtctccagcccttacccaccaacataagcacacttaacctagacttcaatatgcagtagacgcagtaaataaacaaatcaatgggtgaatgcttattacttttttccttaagcaactctcctcatattttgtttgcttgttcttcattttctaggagaatgtggattatattattcaggagctccgaagacccaaatacactatatatttcatttgtaagtatgttagttcactttttcaaacatgtaacaacatcccagttagtgtgtttcattgagcccttcatatcatcaataacttcattgaatctgtcactataaaagtctagtttatttaatgtccttccaaagtattaaaaatcttttgacctgccgggcgcggtggctcacacctgtaatcccagcactttgggaggccaaggcgggcggatcatctgaggagtttgagaccagcctgaccaacatggtgaaaccccatctctactaaaaatacaagattagctgggcatggtggcacatgcctgtaatcccagctacttgggaggctgaggcaggagaatcgcttgaaccggagaggcggagattgcagtgagccgagattgcgccattgcactccagcctgggcaacaaagcgaaactccatctcaaaaaaaaaaaaaaaaaaatcttttgaccaatattctgtttcagagggctaaatgtgatttccattcatctttgattgcttaaattaaaaattttacattttactttgcctttcaagatgctttgtaagtcaaaagttttaagtagacaaatttcacatctcacccctgccaaaaaaaaaaagtatatacttatccctgttttacacttaaaaattgaggcatggaagctgatttattttttgaagtgggaaggtaatacttgagtttgctggaaaagcagaaatttactttacataccagataaaagcctttcacttctctttgttactatatttaatgcactgaaagtataaatcatcaggtagtgatctcttatgtgcacaactttcttggagtgggggttaggtaggggagatctggaaataaactaggtttgtgtttactatacaatttacatggatttttttgatccaatacattcggctgtagaagttacatctattctcctctagatgtcattatttatctttatgttaatagtgttagtgtagtctatttggtaacatttccaaaaccaaggactagatttaacagtaagtagggcatttgagaagttttaaagcttacttaaaggtattagagttttagggtttagactacagtctaagacgtacatactttcttcagcgtatactacttaaatagaataatgatacaaaaaattaacatttgcgaaaagactatatatatataagagctctctcatattttatttcattcagttctgtgtagaattgaaaagttacataaagcttgtccagtgggttttcagtgcacgacgccccaagaggtaaaaataggcaattttattaatctgtggcaacttaatttttgtttgtttttgtctgtttgtttttggctaatagtcacaggttttctttttaaaattaaactttctattttgaagtaattgtagattcatgtgcagttaaaaaaaaaacaacgaataataatacagagatcccagataccctttacccagcttccccctgtgtagtatcttacatgatgatagtacaatatcacaaccaagatgttaacactgatacagtcaggatacacaacattttcatctctataaggatcccttttattagcttatatggacttctgtcccaccccaaccccctcattaaccctggtaaccactaatattttctccattttatattttgtcattcgaagaatgttctataaatgaaatcatacagcatataatcttttgggactggcttttttcactcagcataattctctggagagtcatccaggctgttctgtgtgtgtgtgtgtgtgtttttgtttttttttttttgtccgagaagcagtcttgctttgtcacccaggctggagtgcagtgtcgccatctcaactcactgcaacctccacctcccgggttcaagcgattctcccacctcagcctcccgagtagctaggattacaggtacacaccaccacgcccagctaatttttgtatttttttttagtagagacagggtttcaccgtgttggttgtccagactggtctcaaactcctgaccttgggtgatacgcccgcttcagcctcccgaagtactgggattacaggcatgagccaccacacctcacctgttgtgtgtattaatagttcattcctcctttgagctggaactgcaaaaaaaaaagttttcttaatttaaaaatagttcatttctttttattgctgagtagtattccatggtatgaatgtaccacagtttgtttaactatacaccattgaaggacatatgagttatttccagttttggctattacaaataaagctgctataaatatctgtgtacagatttttatgtgaacattaagtcttcattctctggggtaaataacccccaggagtgcaactgctgagtcatatggtaattccatgtgtgatctgcccaccttggcctcccaaagtgatgggattacaggtgtgagccaccgcaccgaacttttaaagacatacaaaagtagaatagtatcataagttccaatgtacctatcagctggtttcaacaattattgagcctcacccaatcttgttttagctatactgtcacctacttctccagcaatattattttaaagcaaatctaagacattatataattttatccataagtatttcagtaggcatctctaaaagataaggactcattttttttaaaaacacatttccattattacatctagattaaaagtgaaaaataattatttattctttttttttttttttttttttttttgagacacagtctccctctgtcacccagacagagtgcagtggcatgatctcggctcactgtaacctcaacttcccaggttcaagtgatgttgcccaggctggtcttgaactcttagtaccattttcaaataaccattcagcgttcaaatttaaaattgtcttttttttttttttttttttttacagttttttaaaatcaggatcaaagtaaggttcacacattgctgttggttgatatgttaagtttcttaatcttctgtataggtcctcccacccctgcccctgctgccccatgcaatttatttattgaagaaactgttaagttttccacagactggatcttgctgattgcatccccagggggtagtttaacatgttccttgaagtttaaaatattcctctgtcttctagttcctgtaaattcataggtgaatacagagccttaattaggttaagatttgatttcttcttggcaagaatactttataggtggtattgtgtgctttcattggctgcttattcttttgatattagtagctgctgatgctcaatgcctgggtccattcaattgattcattgggggttagaaaaaatgatgatattctaattctgtcattaacatttgttagttattgttgagctggaatgttttcacaaagaaaaattttccctcatctatttggttacctggtagtacagtttatatataaaagacagcatgaaagtttacttctttctccttattttcaataaaatgacttacttccctagtattctcattctccaattcctccgatggagtcttcctctatcgcccaggctggagtgcagtggcctgatctgggctcactgcaagctctgcctcctgggttcatgctattctcctgtctcagcctcccgagtagctgggactacaggcgtccgccaccacgcccagctaattttttttttgtatttttagtagagacggggtttcaccgtgttagccaggatggtctcgatctcctgacctcatgatccacctgcctcagcctcccaaagtgctgggattacaggtgtgagccaccgcgcctggccagtccttttaaaatatatatatatatatatatataaaattatgaatttgtggattaaatatatttttgctacccattccaatttgaaggtcacttattcattaggctttaactatcaggcccttttacatatattgcagcagaaattatctcctttgagtcaaccccaactcatgtgtttcagatttcagtaatgtgatcagcaagagtgacgtgaagtcattggctgaagctgatgaacaggaagttgtggctgaggttcaggtaaacatattggtcctgtaacacatctcgtatgttggccctttttaaatatttgagtctaaaaataaaaaataaggaaaggtctgtctcaaaagaagttttattatgaatacttgaatatgtttatcacataaatgaggaatattgttttcagaggcagcaaataaactagttttgaatttttcagaaggatgtgataggtgataaatgaataaaaagaatacctgttttaaattatattctctctcatgacaacacattggacagcaaagttcttttttatctgagtagaacattgtatctcctattagcagtattttatttttactaattgataagtatgcatagaggtctccagaaatataatgtgtataaccttacaacctttatttgttagatttattattattgctactgttttgtaattattttaattctcccacgttgactgttgttacccaattattaattgaacaatttagtatctctttacacctgtatttcacaaagtttggctatatcatattatatcacttatgaaaatattactgcttgatacaattgaagtttatggaatgactattcttggtgctttatttgcaggaattttatggtgattacattgctgtgaacccacatttgttttccctcaatattttgggttgctgccaggtatggaaggaaaggtttaatttatcagtcgagagttaattcagcaaataattagacttgtaagagaaaattcaaatattttctctgaatatatgtttttaacaaaaagggtcgaaattgggatccagcccagctatctagaacaactcaagggcttacagctctccttttatctctgaagaagtgtcccatgattcgttatcagctctcatcagaggcagcaaagagacttgcagagtgcgttaaggtatggcattacctattcctggttccaaaacataaaggccattcatttctctatcatatttcagaaactaaaggaatagtttatttacaaccaaggagatgattgtatgttaggtttccgcgaaaagaggtaggtatatgtaatttaaaacaaaaagcaacaattagagctaagattcttaggtttaacccaagaaacattcacaagctatttaactttttttggtccagttaaaccacttataaaatagggtttcatatcctaacctcttaaatagtatgctactaaactttgtgagacttttgaatccttcatatggaagatctatgtgggtgcaaagaactattgttaaatgtagtgtttattaatttcctatttatatcatttctatatgtaactagatggttgcacaaaccatctttctctctcacccacagcaagtgataactaaagaatatgaactgtttgaattccgtcggacagaggttcctccattgctccttattttagatcgctgtgatgatgccatcaccccattgctaaaccaggtacaaaaccctttcttggcataatagaaggataattttaagtgatattcatcaaaatacagatagggaagtaaaaacatggtccatttatttgcctccttatttttagctattcttggttttgctttgtatttcctggtgttttggtatcatgattcttccatccactgtcatcataactcttctgcttcatctctcctgtacctttctgccagtacctccacccctaatcaagacagcttcttaattctgtagattctatttccctgtgtttccttctgtctcctcatttccatgcttacagccattgccttggtctagatcctaatctcttgcaagaatattgaaatagtcatctacttcgttccctactttttatttcttctcactccaaatgttccacaagtacaatttcctaaagcacagctctatcttattactcttggcttaaaaaacttcattggttcccatttgcctactaggttaaaaagaaactcctgaacttggcatccaagagccttcacaatgtgggctaaacctcttataaaacctagagttcaccacttacatagataatgccacatggtttcctgccagcatgcttttactgtgactgctttctaaactctagaatgtttggaataccttctcttcccatcttcacctatcaaaatactgctgttaaaaccactcaatctggccgggcacggtcgctcacgcctgtaatcccagcactttgggaggccaaggtggctggatcacctgaggtcaagagttcaagactaacctggccaacatggtgaagccccgtctctactaaaactacaaaaaaattagccgggtgtggttgcacacacctgtagtcccagctacttgggaggctgaggcaggagaatcatttgaacccaggaggcgaaggttgcagtaagctgagatcatgccactgcactccagccagggcgacagagcaagactccgtctccaaaaataaataaataaataaataaaatgatttatatgaataatagcaaagaataaaaaaaagaagagccgggcgcggtgactcacacctataatcccagcactttgggaggtcgaggtgggtagatcacctgaggtcctgagtttgagaccagcctggccaacatgatgaaaccctgtctctactaaaaatacaaaaaattagctggacgtggtggcagatgcctgtaatcccagctactcaggatgctgaggcaggagaatcacttgaacctgggaggcagaggttgcagtgaaccgagatcatgccactgtcctccagcctgggcaacgagagcgaaactcttgtctcaaaaaaaaaaaaaaaaaacactcaaaagccatctccaacatccagccattcttcaacatctcgaagcctgtattctttcagtcagatattgttcttatctcctgaaaatccctgtagacttgtagacctttgtgtctctctcatgtctcatgctgtacttgccatgttgtagctttggttgtttacatcctctcctacgttacatatttcttcaaggcagactgagtctcaccagtgttttttctccttcaagtataagaacagtgcacatagcgggtgctctattaatagtgattttgtatgtgtgtatgtatttattgagacagagtctctctctgtcacccagattggcgtgatctcagctcactgcaacctccgcctcccaggttcaagcaattctcatgccccagcttcctgagtagttgggatcacaggtgcacacccccacacctggctaatttttgtattaaatatttttagtacagacaaggtttctgtctaaatattggccaggctggtctcgaattcctgacctcaagtgatctgcccgactcggcctcccaaagtgctaagatgacaggcgtgagccaccacgcccggctgtgactttgtatttacagagaaaggcacagtctatgtttcagtttcttcccagcttgtactaatgttaatgctaagggaaatctgtggagtgaaacttctctgtagtataaaatagccttgtattcctaaaattcaaagtaatatatgttcaccaaagaaacttttgataatatcaaaaagtagaaagaaaattaattgcctattattctgtctcccaaagaaaagcaactatttatcccacagatttcactggggacttcttttgtgccacgtactaaactaagtactagagataaaaggttaaaagttacaatttctgtcctcaaagagctcatggtccaattatgagaaaaataaacataattttaattgtagagtaagtgctagaagcatgtacaagaagctatccataaaagcataaaacattttgttgtacgttttttttttttttgagatggagttttgctcttattgtccaggctggagtgcaatggtgtgatcttggctcactacaacctccgcctcctgggttcaagtgattccctgcctcagcctcctgagtagcttggattacaggcatgtgccaccatgctcggctagttttgtatttttagtagagatggggtttcaccatgttggtcaggccggtctcgaactcccgaccttaagtgatccacccacctcagcctcccaaagtgctgggattacaggcatgagccaccatgcccagccttgttgtacttattttaagtgcgacttaatggaacttgctttttcaagaattcctttggcaaatcttttaggaaataagcaccttcttttataaccttctaaattatttcttaataaatctagttttcttaagataaaatatgtatataaatatttctagcatttagattctagatgcagaagggaacatgctagaaaatacttcattttgtctaacagacctatgactgaaagtaatctattctccataattggtgaaaagggaaaatttggagatttctcatttccagttttaccaaataaattctcaatttgtgagactggaaaccagtccttcctctcatctccccttaggtaaaaatataaaataaaatgggttcaaaggtaagtttctgaatatcccagtgttttgatcaactcacaaggtttttctgataatattagtgttcccaggacaaatatagtaccactcagatctgcaagaacacacttctcatgctgcagaaaaccatagaagcatacaggaaatggtacagcttgtaactgcagtaccaatatagctctatctgtgaagccaaaaatatactcttaattcacaggcaaaaaattggagctaataatagctctaatttgttttctttctatcaagaatattaatcttgctgccctttttccaaaagtatgaaatctaaaagtattttgacttttcttcagtgtttaatcaattaaaatgacagtcttaatgcttatagcacaaagtatgaataaaatttaactcgagaatcttcatgtaaagaagactagttaaagaatgttatcagtttttatttgttttcctgaacgtttactatttccatattctgtcagttacctttttttttcataattctttatttagtggacatatcaggccatggtccacgaactactaggcataaacaacaatcggattgatctttccagagtgccgggaatcagtaaagacttaagagaagtggtcctatctgctgaaaatgatgaattctatgctaatgtaggtggtttaaatttttttaaattgtctttagttgtttttatgtaagaagatcaatattggcttgttagtataggggcaggcatgggatttcatgtgaaaggatgataggggcatcctgtgcataaactgcctctgaagggaaggcagaagacttggattctgaccctttagcaattttttttcatagagatcacgtagttatttacttctctcccctccagtagctgtttgtgagaatagtaatggtattcatcaacagtgtcccagctaatgtccaaatttggtaattaaaatagaatttccctgcccttcaattctgtgttccaaattctttttcacttctttcaagttgtctgaaagtcagactagttgatgaagtgtgcttccaactttctttttcacagaatatgtacctgaactttgctgagattggtagcaatataaagaatctcatggaagattttcagaagaagaaaccaaaagaacagcaaaaactagaatcaatagcagacatgaaggtaaattgaacatgtacatgaatgacaaacatgtgacagtttggtactattcatgtaagcaacacttttggaatcttctgggtctaatttctaccttgattgattttatttggtttgagacttattttctgtaatgtctttaaacaatatagtgaaaactttatgataagccatgtgcttctttccattcttcagtaatatctggactatttaaagactcaatctattgctgggagcagtggctcacgcctgtaatcccagcactttgggaggccgaggcgggtggatcacctgaggtcgggagttcaagaccagcctgaccaacatggtgaaaccccgtctctactaaaaatacaaaattagccaggtgtggtggcgcatgcctgtaatcccagctactcgggaggctgaggcgggggaatcgcttgaacctgggaggcggaggttgggaggttgcagtgagccaagatcacgccactacactccagcctgggcaacaagagcaaaactctgtctcaaaaaaaaaaaaaaaaactcagtctaccaacatataccagttcttctcttcttaagcataacaaaatgccatgtggctgaaagttgtagatgctttaatctgggctgaaaaacaacccccgctttccccaacccccattcagtacatgcttatcctcagtcaaaaaataacagaacctcccattgatgtttttcccatggcaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccaggtcagtccaatttgatgagcacctactatgtgtaaggcactgtgccaggcagagcaagagataaaaaggcaagtaatccttcttcatcaacatggaatttagtccaacaaggagctgacatgagaacacaaattaatattatttaagatagatctataaaaagagtcacaagagaagtgtaatgtgcaattcccaagggttcagttaattagtataagggcagcctagtctactagaaagagcaccaaactagaatcagaagatctagattggagtgtttggtataccacttacaggctttgtgacatggagctgttgacttaatctctgagccagtttcattatttgtaaaataggtatattaatactcatctcacagagtggttaggaagactttaaaagataaaacatatattaaaatgtattgtctaagttttttcattattgaagatctgcttttcatcgcaccaacatattaatgcctgctatatgtatatactactgctgtgaggatctgaatacaaagatgaataagataccacattacagtaggggagaaagaaatttaaaccagcaattgtaataccaagcactatgtactatattagaggtatttacaaaggaatatggaaatacagaggaaggacaactgttttccccaaggatgaagcttcttagcacttcttagggaaaataacatcaaacagggaaaaggaagaaacattctcagcagagagaatgcaggcatgaagatgtgaagaaataaatattgatatatatatatatattttctatatatatataaaatatttatatttgaaatatacatatatttaaatatatatatgggaacagagaatagttcagtgtggctagtccagggtacaagatgagtggtcttagactggaaagactgactgaagccaggttatggccattggaaggaagttgggctttaatcttaaaatgatgggggctcccggaggattttagaagaatagcaacataatcagactctggcctcaagaaatgtatagtctagttgaagagacaaaactaaagcacaagaaaaaattagataatgtttcaagatgagaattaagtcataattgtaatactgactgtaacaggttttgaggttattaggaacagttcttagagaaggcaagatttggatggaccacaaaagaatgaatagaatttggggaaggagttcagccaggagcagcaaaagcaaagatgtagaaatatgcaggaagtaataaacagtttgacctgtagagagtgagtatgaaacagaattagataaaattgaattggtaaacaaaaaacagtttacaagctttatgaagaggcttgtaagaatttatacctgctgagataagcaaagagatccagtataggatcttatgtagaaagttgaggtgaggaagacagtattttaggaaatgtaacctagtaaggatgctttagaggtgaaaaaacaggtcagagagacttgtagacttacagtgatagtagtaaaaatgtacagcaaggggctgaactgaaaaacatttcaaagggagaagaattagacgacaggctggatataaagatagaataaatcagaggtaatcccatgtttcctgagaaatgacaaagtatgatgtcactgacaagtaatttaggactacgagtcctttaggaaatagccatttctaagccacttataagaagcacatttccctgttaatagggccctatattctaaagcttagcttctttctttcccagctacagttccactttattctataaaataatgccaacctgttatattggaaacaactcaggttttggacccagactggcttggcttatatcctacctctccttaccaaagtttctttgggaaaattacttgatttgcccaagtcttggggattatgatttcaaactttcagactgttacgatgattcaatgagatatgtaaaatgcttcacatgtaataggtgctttgtaaatgttagttcccttcctctaagcatgattttttttttacacatagtgcaaacaaaagaaagaagtctacctgtgggtgctctagttataccagggtctttactgggacttattgttgttgggttttggatcagaacctaaagtcgcattctttttaatcactaaatagtatcctttgtaaagatgtatcctaatctatttaacttggcctttaaacaacactactaatagtattttatagttgttttgtgggcctaatagaaatgtcctgatatttaccacaaaaaatgagttttctgcctcttattaaataaaaaacaaaattgtgtcccgtaactaaatttaaatttcttatatttctttatcatttgatttttcccttgaaaacagtagaaccagacttaatcactagccagttttactgtctttatttgtatctctctacatgtggaaagcaattagaaaaagttcttgtaataacttgtctgaaactttatttttgtgttcactttaaaagaaaaatagtcactttaaaaatataaattctatttgtgatccactttttatttttagaacttatcttttgaaggttttcttgtctagggtattgggattttacagtgagcagttgatttggagtcccccatcataaacgacttatttggcaacataacttaaatagtctataaagggatcttttgtttgatagtaagtggatgtcaggggcctgacttctagaggggttatagcattccttggcttgaccttagatgataatacgtcatgaagcaatgaaatgaggtttgtgagtagagatggggtttgctttattgaatagtatcatgacaagaaaaaaaagcatgtattgctaaaagttaacttaaaaattgctgccattctaaccattattttgtaggctaatgaaaatttcatttagaaagaatttcactagaaccaaagtgaaatttactaccactgaaacatatacatatcctcagaagagatttattaattagtaatgaagatttgccataccatgaagaaaagcatctttagaaagtgagcaattccacccttaccatcctccctataccctgccccccatgcccagcctgtgttgtcatatcacagtttttcatttggagagaggaaccagtctattttgtattttttcctgacctttcataaagatctcaaatcatcctgttaatgatacataataaggactcaataaatatttattagaaaaatgaggaggaagagctctatttgaagcagtatagagtagtggctaagagcttgggcctttgatggcttgggtttgaaaataattcctaaccactctaaaactcagtccttttgtctataaagggggaaaaataatagtacttacctcagaattgttgtgagagtgcaatgagctaatacatgtaaaacacttatggtacttggtacttacagctttcaagaaatattaactaccaacattaagagtattattatttgatggtacatttaattttcttaatggcatccaagacatgttttttagttcagtgatagccttgtatctctctgatttcagaaaagtgtttggtttttttgtgtgtgtgttttgttttgttttgccactcattaaaattataagaaaagtggttgggacacattgaactgactgacaattttactttgattaattaaatgtaaaaatgatccttttactctaaaacaacatttagccagtattttagaaacagtattgatcagcagaagatctactgcaaagctcaattttatgttgactagtcattaagaaaaggaatactggctccgatgtatttaccagtcagtagaattgggtcttgtctgctttctatcatttttccctgataagctttttatattcccacaacactgttctctcaaactgttaggctcatttttgtcagatcagcatgtggaagtcttctgccaattccatcttactgtcctaatctgttggtttattttgttattctctgactttactacattaatatagtagataacaaagaagggatcctgttctttaggttaaactaaaacaaaaaaaaaaaaacggagactatctttattaccaagaccaactgtaatctgtataatagtttgaaatgtgtgtatgtcataatgatttcttcttgctgtgctgctttatcatagttttgatagaagaaaacagaaaagtaaaaaaagatttagccagaaacaatggaagaatctctaaatatcagaaaagaagaatggttttctcgttgatgtcttataaatgaatgttagttcctttaggaaacttgatctccaaagacactatttttgctttgctttgctttgcttttcctattccttgattacgcccacacaaatgttagagttcagtgcaaggttttcgaatcctgtcttcttaagtagatgacaattttctgttttgctctttactcagtcattgttataatgtgacagtgttcttttctaatagtcacaaggctgatggaaaatttaataagagaaaccaaaaaattatgtaattcagttaatttccaacagataaatactaccgtgtagcatataacttgctttgtaattataagcctctctgattcttttttctcctcttctctggttagtgccctgaaatctcaatgtaatgtatgccactgtcaatcaagttgacaagtcaagtagttatgagggaaatccttcaaaatgaagtcaaaggataaagtgggatcaaggcagacaaaaaggtcctgcgtctccaaggactgatacagctgaaagaaaagaaagaactcagcttgtacctacaggtttcttttcatgagagaatagatgcctctagctagaacatggacctgagccatgagttgggtcctaagggctcaaaagtaggcaaaataattactcgcagtaagcctggtcagatctgggccaagtcctcagtcaagaactaagagtcaagccaggcaatctaaataccactaccaagtctcaaggaatggaagtggattttttttaggattgatgcataatgattgtacagatttatggaatacaatgtgatgtttcaatacatgtatacattgtgtagtgatcaaatcagggtaattagcatatccatcaccttaaacatctgtcatttctttgcgataagaacatttaaaaacctctcttatagctattttgacatatataatacattattgttaactctattcatgctactatgcaatagaacaccagaacatattcctgctatctaactgtagctttgtacctattaaccaatttctaaccacccctatccttcaccatcccatcctctggtaactgctattctgctctctacttctatgagttcaatgagaacaactttttagattccacatatgagtaagatcgtgcactatttgtccttctgtgtctgatttatttcacttaatgtaagtcctccaggttaatctgttttgccagaaatgacaggattttgttctatttcatggctgaataataaatatatatatatatatatatatatatatatgctgcattttcttttccctttttttttttttttttttttgagacagggtttggctctatcgcccaggctagagggtagtggtgcaatcttggctcactacaacttctgcctcccaggctcaagctactctcccacctcagcctccccagtagctgggactacaggtatacactgccatgcccagctaatttttgtatttttgtagagacagaatttcaccatgttgtccaggctggtccccagctcctgagctcaagcagtccacctgcatcggcctcccaaagtgctgggattatagacctgagccaccgtgcccgacctaaatactgcttttcttggtccattcatctgttgatggacatttaggttgattttatatcttggctattttgaatagtgctgcagtaaacataggagtgcagatagctcttcaacatactgatttcatttcctttggatatataccaagtagttagattgctaaatcatatagtagttctatttttaattttttaaggaatcttcatactattttccataatggctgtactaatttacattcccaccagttgtgtgtaagggttcttatttctccacgtcatcatcaacaacacttactatctctaataagaaacagccaagagtcaagatccaagtgaaggtaaatagaaaagggcagagactgattactgcaaatagtctttgactgtcatcataccagttttgtgaatttatagttacttggatttctcagatttgcttaaaagtacagagacagatcagccagaaaaggtggtaagagagtgactgcaagggcaggaaatgagacattgtgcctataagaaaagtaacaacagaaatcccaaatgggatttcttttctttttaaaaaaattttttaaaatttttatttatttatttgagacagtttcactctgtcgcccaggctggagtactgtggcacgtaatctcggctcactgcaacctccgcctcccaggttcaagcaattctcctgcctcagcctcttgagtagctgagactacaggcacccgccactacatcctgctaattttttgtatttttagtagagagggagtttcaccatgttggccaggctggtctcgaactcctgacctcaagtgatccacctacctcgacctcacaaattgttgggattacaggtgtaagccatggcacccggcccccaacaggatttcttaatgttttaaacttacgctgttgattgagatacatacataatttgtacctgaaatttcttcatattatagtagaaaatagtggaacatttgaacagttaccctaaatgggctgtattccgtggctgctctaggggaaatatcccatgaaaggaaaaaaataagaaaaatcttacgaatttgggatcgaaatctacagaagagaagtttctccctttttgatcccttaaggatgatggtagtgaaatagtaacccaaaaaatcaacaatagaaatctctttcagagaactctgtacttgaaagctacatgggaggttccccattatcatcatagtccctagtcagtgtgaacagaagagctcttagacattggacatggttgttgtcaggtacaaaagagataatgtacgtgaaagcattttgtaagttgtaaagtaatcatatagttgatagttatgtcctcagaattcagtgcccttcaaggctcttgccagcctttcaaaccaagccatttcttcctctgatttccatatttattttgatagtgccactgcttttggtctctcacactggttccaatacttactgattcttcaggacctttggcaagtgtcacctctgtgaagtctttcctaatttctcaacaacccaatatactttctcttcccctttctctccccttcctcttttgcactgattttcagcttttgctttttgttttgttttttgcatacatgtttctgttataacaccacatatttgttcctgaaaaacctcatattctataaaaacatgcactaaaaaaagggttatgagaatatagggttataagcagaccacttaaaatctacatgactatagaaagaaagaaaacattcatataatttttaaatcagagccctaataaaaatagtaacaattataataaaaatactagcatggttaaatctccaccggcatttgcacctagaaatagagccagtccatcctctgcagccttattcctggggctcatgttttcttcaaattataaggtcttgaaaatactcacttctcataaagactactttgtcaaaattaaaaataccatatggagacagctttcttcatcaatcagtgtttgattgttattttgttttgttttgcttttttacacagtgcaatatatttgcatcctttttatttgcacttgccctttccccatatagcataacacagtggaaagtgcaacagttcttgaagctacaaaaccagatacttcttgcagaacacacttctgtaggattatcatctttttttcttaaggtattggtaaggcttcccctttaatcataagaaagcctatccattctggaaaaattacatgtgaaccaatatgccttctgtgttaaactgacaccatttccatatttatccatctcacagaactaaagtacattaaagaaacatgtatatagcagaataaattatattactttgatcatccttcaccccattgactgtgaactcactggggacaggaattgtctttaacttatctgtgtgcctgcaacagtgcatgacatactgccttatggggactcaaaagtatttgttgacttgaattaaattatttgttctgctgcataataaatataaatctatactatatggaaggtcctgaatatgaggattaaaaaatgtaaacatggcttctcctgtccccctttcctatcggtacctgcctcttaaaatcattaagtactaaatctagagattacatgctattacatactcatctctgtcaaccatgttgagacatgttctgatgcttcttagagatcaagcccagtctgtgtaaaattctaccaacttgtctccatttcactggtcaatcattaatactaagagaaagcagtaggttttgcaaatcaactagtcagttttgttgtgccgtattgattcaagtcgtggaaatagtaagtgttctttcagcaaggaaattacaacttcagctattggaaaagaaaagtggaactatccattattaaattcatttttgtcctaaagcaattacaatggaaatatatttccttatttaattcttaccttggacaaaaggcatttaattttctatagttgagacagttgctaaatgtatgacttataattgtcatagtagtgatgtatcactaccattcaataattattagatctaaggcattgtacaacagatgactcaagtgaaagggggataaatataagttctatctttcttcagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaaggtaaccagtttccatattagcccaccaaacaggaaccaactctgttattatattcttagctctaacgaatgataaatcatactatttttatttacagaaatgtataattctgtcttttcatttttgtttccttaataaaattattttcttatgaaatgggcttcctgatgcctaagcaatcaaaatttgcttctctttcttaatagctcgtgtctgcagttgttgaatatggtggtaaacgagtcagaggaagtgacctcttcagccccaaagatgctgtggctatcaccaaacaattcctcaaaggactgaaggtatagacatctcctctatgctctcctgagtgagaacagttgaagtccttgaggctgagagtgaatgaatatgatcttcaaagtatcttgaagattgctgctaatttagtactgtgtcagttaaatgaaattaaaactggcatcctcttgaaagctttttcttttagtgctttctgtcttagagccgtatcaacattggaccaaatagcttagcaggaaataactggaggtatttccaggaaataagaagaaaaagacaaacagttctgttagtcacagatattttacaccatttgtttataattaaagattttttaggtagtttctctttgaaggaaattaaagatgaagcaaacttttgatcttttaaaaatactaacctgttttcttaaaatactcaaaaattaattctaatctgctagcctttctttttttttttttttttttttttgagacggagtctcgctctgtctcccaggctggagtgcagtggcgtgatctcggctcactgcaagctctgcctcccgggttttacgccattctcctgcctcagcctctcgagtagctgggactacaggcatacaccacctacacccggctaattttttttttgtatttttagtagagatggggtttcaccgtgttagccaggatggtctcgaactcctgaccttgtgatctgcccgcctcggcctcccaaagtgctgggattacaggcgtgagccaccgcgcccggcagcctttcttatgtttcctgaagtttttctattttcctgggtattttcagtcttttttatacataatcctttccttttatttgctctacctatcatttaacatttcacaaaagggtgagagacagtgaagacatgataaaggatttaagcaattccatttttaaaaaatcctttacaataactagccctaaattacagagtaatttttatgagattagaacatttctagctgattaaaataatttttaaatttcccacagttacgtaaatctatcccatgaaatctctattgagtgtatgtccttttctgatatgaatattattaattcttgtgttgccaatttcccaaaaatgacataagaaccattttcccctgttttagggagtagaaaatgtatatacacagcatcaacctttcctacatgaaaccctggatcatctcatcaaaggaaggcttaaggaaaacctatatccttatttaggccccagcacactcagagacaggtaagctaacaaagatattaataataaaagccagaaatactgaacaaacagaaaatttagagtaatgttaaggactaaagctgaggttatagcattctgctgctcctttcttctgttaagattcttttggttttacatatgtcagcattagatatgaattcccctgctaagtctgaaacatttatttcttttgtactaaagaaacaagtgttttggagagcctcaaatccttctgtatttcagtatcagaccagtttacttatgccatttaaggttctgttcgatggcatctggcatttggtgtttcaaacattgaggccaaaaataggcttgctgcttgattgccatccagagcaggttgttactatttttggtgaggactggactttgccaaatgttgccagcacacaaactgagagacctaattaataaaggccatttgttacacaggagcaaaggatggctttctttttgagtattaactaaaggaagcaataattgtcatcttaatccagtggttaatttttaataaaaacaaaacttgtccagaacaacttatttaggccaacctgaaattttaaatactgtatacataaattctacctagttaaaaattatatatttttttttgttggaacacatgttatctaaggggctaacatatatacttgaatcctattggatagattaatgtgaaaattttactgttgacataattcttctattatttcagttaataaacatctaagagccttggaagtatagtgttttataaacataatgagattctgaatgagaaaaatgttttgagatacataggtgattcttttatgtgataaagtgtattttttcactttgtcctttaaaaaatttttttctgtaatttggtacagaacagaaaaaaaaaatcatcttttaaaagtccaaggttgagatgcagaacatttggtgttaaattcagagagtacactcattcagataaaatgtttaaagaccttgggatcaagattcagaaatgtcagctaagtgggaagaatgaacgccagcccaaagttatgcacctatctgagaggctttttaaaaaacaactattcttgagcttttgcattaatgtgataaataaaaacatttatttgcttatgaatttttataagaattactgaacaaggaattatttattaccaaagggaaaccacaggccaccggaagaatatactgtatatgatcagtacacagcaggaaacctttctaatttacataattcattcccacacaaagctcaaaattatattccttgaacaaaatgcacatttatcagttgtcaacatctgttaccatttgtcactataacctaagtatgcatatagttaataattcagttgctttgtccttttacacaacagatgttgattgaatgctttcagtatgttaagagctgttgtagatgctggcgatatagaagtgacaggaaagacaaggtacccgccctcaaagaacttacatagagacaatgagtaaacaagtaaacaaatgaagaatataattttaataagtgctatccaggaaataaatagggtgatgagcttcaaagtaattgtaggggtggggaggactactttagatggagagagaacctctctgagaggtgatatttaagatgagctttgagtcataagaaagaaccagaccagacacggtggctcacgcctgtaatcccaacactttgggcggccaaagcgggaggatcacctgaggtcagtagtttgaaccaggctggccaacatggcaaaaccctgtctctactaaaactacaaaaattagcctggcgtgggtagcaggcgcctgtaatcccagctactcaggaggctgaggtagaagaatcgcttgaacctgggaggcggaggttgcagtgagctgaaatttgcaccgttgcactcgagcctgggcaacagagtgagaccccatctcaaaaaaaaaaaaagcaatcacactatgattaggagagaaagcatccaaagcagagggaaacaccagagcaaaggtcttgaagaaagagagaatttggcaagttaatggaacagaagggagccctgcttggctggagcatagtgaataaggaggaaataagaggttgaaagataggtagggttggatcacatcggttctcgaagaccctagtaaagagatttttttttaatgtcataggaagccattgaagagttaagcatatgagtaacatgaacttaattgtgttttaaaagatatttgtggtaagaatggattattgaaggcaaaaatagaagcagagagactactgaggagatgaatgcagtagtccaggtgagaaatggaagtggtttgggtaggaggctgagagagaagccagaatcaatagtcatatttaatggcacagatttatggaacaagggtaagagagaagtcaagaataactctcaggctttgaggagaaacagagttttgttgttcagttggagatgtctattagataacaagtagaaatgtcacatattgagagttgacaaaaacattagtaatattaaaacctctggaaatgttgaactgctccagattaaacatggaaaaggcaactagttggggaaatggaaacaagaggagagtgtattggatcatgacaaaggtattggtgaatgaattggagatttgatgaggccaaagaattattacagaagagtattagtacaggtaaattggaagttgagaggtagttattggataaagatattttgaattcaagatttcatagggggttcagatacttgtaacgaagaagtttagattgtaagcatggatgtgggtggttgtagtgggtaaaagaaaagatcaggattggtaaggagaccaggatgttagatgagtaatccacagtgatgttaaagtcactgacaatcttgaaaagagaaggagaaaaaggaggacaaataagccagagctaaagtcttcatggaataaaagtgaccaggaaaggaggtcaggagaaaacggtgcagctacattatgagcttctaagatagtggaaattttgaaggaagaaggcaaagaaatggttacaaaactacagtgggtgtcacagaacatacctataccacctcctggccatgcctaacagaaggaatactgcaaaggacttgaaaatactcttatttaccaattctacttctaaaagcttactgtatagatattcctgtgcaagtacacaaagatacttaagccaggatgttcactgaagtaatagcaaaaaaactaggaacaagctaaatatctattaatagagggctggttacctaaactacagtacaatattacgtattctttttttttttaaatgacataactcctcacgggtgatatgcaaagctttttaagatatattagatagaaaagcaggatgttgtaacatttcttttcttttttttttttttttgagacagagtcttgctctgtcacccaggctggagtgcagtggtgccatctcggctcactgcaatccccgcctcctgggttcaagattctcctgcctcagcctcctgagtagctgggattacaggtgcatgccaccatgcctggctaatttttgtatttttagtagagatggggtctcaccatgttggtcaggctggtctcgaactcctgacctcgtgatccgcccgcctcacctcgtgatccgcccgcctcggcctcccaaagtgctgggattgcaggcatgagccactgtgcccagccataacatttctttcaggtaaaaaaactgtataatcctgggtgcagtggtttatgcctataatcccagcactttgggaggccgagcgggcagattctttgaggtcaggagtttgagaccagcctggccaacatggtgaaaccctgtctctactaaaaatgcaaaaattagccaggcgtggtggcatgcacctgtagtcccagctactcaggaggctgagtcaggagaatcgcttgaaccagggaggtggaggttgcagtgagccgagattatgccattacacaccagcctgggtgatagagcaaggctccgtctcaaaacaaaacaaaacaaaacaaaaaaagtgtacatgtatataaatatgtgcttgactatacatatgtatgtatattatatatataatatattttcacaagcacatatatgtataaatacagtaactctttttgtttgtttgtttgtttttttgagacagggtctggctctgtagcccagactggagagtggtggcgtgatttcagctcactgcagcctccaccttttgggcttaagccatcccacctcattctcctaagtagctggggctacaggcacatgccacagtacctagctaatttttgcatttttatagagacaaggttttgctatgttgcctaggcttgtctcaaactcctgagctcaagcaatctgcctgcctcagcctcccaaagtgcttggattactggcatgagccaccatgccctgcctacagtaattatttctgaaagaataatcaagaagttgttaatagtcgttacctctggatattgagacagtagttagttacatatctatccttcctattagttattgtattaggtattgtaatcttgaagtaagtattatgttttgttaatctttggggttttcacaatgtttaacacagtgatttacaaataataggtgttcaatagatgtttggtaaattctataggcatctcttctagttgatatgccaatatttatagttggaaaatttaaaccagagaataaacttaattgatgctatacaaaatttagatttttgaagttcataaacaaccctttaaaacattctggctctgtattcacttggccacactatcagctctagccactttcttggccctgtattatcatattgaaaagagtccttgattatagtggtatttattattatttgtctcatcataatagaaattctaggttttattgttgctataataatagaaaatatcaaaggaaatgtggcaagaacacaactttgcaaaaccagaacactggtggaaatttttttagcccttagctgttaaattagtgtttaagctgtttggcagtatagctatatccacaaattggatttgatcattctgcagatgggattcttgcataccctatttttcaagctaatttttttttctcactctagaattgcctcttgtctctgataaaggcaagcaactttttcatttggtgaggaaatggagctatatgatcatgcattccagaatcagtcaattcaaaaaggaagtacttttcatgtttatacaaatgtagtagaatcttgttgctacagcttattttttgtttctgtgaagcagcagtcctttttcattggccttttttcctgcagtaaatgctcataagaactgtaccatttgtaagtatgttcagaaattacaattttagccataagtgtaatgctccacaaaatagataaaatgttgccttttgaaagtttgtgtttccatgtaacttaaccacatatagaaataatgttaaaaattctcaataaggtgggcaatgtgtctcatgcttgtaatcccagcactttgggaggctgaggtggggcagatcagaggtcgggagttcaaaactagcctggccaacatagtgaaaccttgtctctactaaaaaaaaaaatacaaaaattagccgggtgtggtggcaggcacagtggcagatgcctgcagtcccagctacttgggaggctgaggtaggagaattggctgaacccgggaggcaaagttgtagtgagccaagattgcgccactgcactccagtctgggcgacagagtgagactccattaaaaaaaaaaaacacctctcaacaaacttggtattgaaggaacatacctcaaaataataagagccatctattcccagtattctgggaggccaaggcgggcggatcatgaggtcaggagattgagaccatcctggctaacacgataaaaccctgtctctactaaaaatacaaaaaatgagccaggtgtggtgttgggtggctgtagtcccggctacacgggaggctgaggcaggagaatggcgtgaacccaggaggtagagcttgcagtgagccaaaatcaagccactgctctccagcctgggggacagagcgagactccgtctcaaaaaaaaaaaaaaaaaaaagagccatctatgacaaacccacagccaacatcatactgaatgggcaaaagctggaagcattccccttgaaaaccagcacaagacaaggatgccctctctcaccacttctattcaacagagtattggaagtcttagccagagcaatcaggcaagagatagaaataaagtgcatccaaacaggaaaacaggaagttaaactgtttttagacgacatgattctatatctagaaaaccccatagtctcagctcaaaagctccttcagctgataaacaacttcagcaaagttgcaggatacaagtcaatgtacaaaaatcactagcattcctatacagcaacaacaaccaagctgaaagccaaatcagaaagcaatcccattcacaactgccaccaaaaaaataaaatacctaggaatacagctaaccaggaaggtgaaagagctctacagtgagaattacaaaacactgttcaaagaaattagagaagccacaaacaaatggaaaacatcccatgctcatggataggaagaatcaatatcattaaaatggctatactgcccaaagcagtttacagattcagtgctattcctatctaactaccaatgacattcttcacagaactagaaaaaattattttaaaattcatatggaaccaaaaaaacgccaaaatagccaaggcaatcctaagcaaaaagaacaaagctggaagaatcacgttacccaacttcaaactatactacaaggctacagtgaccaaaacagcatggtatgggtacaaaaacaagcacatagaccaatggaacagaatagagagcccagaaataaggcctcacatctatgaccatctgatctttgacaaagctgataaaaacaagcaatggggaaaagactcattcaataaatggtgctgaaataactgactagccatatgcagaagattgaagctggaccccttccttacacggtatacaaaaatttcaactcaagattgattaaagacaaatgtaaaacccaaaattataaaaaccctggaggacaacctaggtaataccattctggacctaggaacaggctaagatttcatgacaaaaaaactatgcatctgagaaaggtctaatatccagcatctataaagaacttaaacaaatttacaagagaaaaacaacctcattaaaatgtggaaggccgaggcaggtggatcacctaaggtcaggaattcgagaccacctagtcaacatggtgaaaccctgtctctactaaaaatacaaaaaattagccacgagtggtggctggcacctgtaattgtgccacgggaggctgaggcaggagaatcacttgaacctggggagatggaggttgctgtgagccgagattgtgccattgcacaccagcctgggcaacaagagcaaaaccctgtcgcaaaaaaaaaaaaaaaagtgggcaaaggacatgaacagctacttctcaaaagaagacatacgtgcagccaacaagcatatgaaaaaaaactcagtatcactgatcattagagaaatgcaaatcaaaactatggtgagataccatctcaacaccagtcagaatggctattactaaaaagtcaaaaaataggctgggcatggtggttcacgcctgtaatcccagcactttgggaggccgaggtgggcggatcacaagatcaggagttcgagaccagcctggccaacatggtgaaaccccttctctactaaaaatacaaaaattagccaggcctggtggcgcgtgcctgtaatctcagctactcgggaggcagaggcaggagaatggcttgaacccgggaggcaaaggttgcagtgagctgagatcgcatcattgcactccagctctgggcgacagagcaagactccaccttgaaaaaaaaaaaaagtcaaaaataacagaacctggcgaggctgcagagaaaagggaacacttgtatgctgttggtgggagtgtaaattagttcaaccattgtggaaagcagtatggcagttcctcaaagatttaaaaacagaactaccatttgacctagcaatcccattactgggtatatacccagaggaatataactcattctaccataaaaacacatgcagctggacacggtggctcacgcctgtaatcccagcactttgggaggctgaggcaggtggatcacctgaggtcagtagttcgagaccagcctggccaacatggtgaaacctcgtctctactaaaaaataaaaaaaaattagccaggcatggtggcaggtgcctgtaatcccagctactcgggaggctaaggcagcagaatcacttgaacccgggaggtggagattgtgatgagccgagattgctccactgcactccagcctgggcgacagagtgagactccgtcaaaaaaaaaaaaaaaaaaaaaaaacacatgcatggccaggttgggtggctcatgcctgtaatcccagcacttcgggaggccgaagtgggtggatcatctgaggtcaggagttcaagaccagcctgaccaacataatgaaacctcatctctactaaaaatacaaaattagcggagcatggtggtgcatgcctgtaatctcagctgcttgggaggctgaggcaggaggactgcttgaacctgggaggcagaggttgtggtgacccaagattgtgcccttgcattccagcctgggcaatgaacgaaactctgtctcaaaaaaaaaaaaaaagacacgtgcacacaaatgttcattgcagcacttttcacaatagttaagacacggaatcaacctaaatgcccaccaatgacagactggataaggaaaatgtacatatacaccatggaatattaggcagccataaaaaaatgagattatgccttttgtgggaacatggatggagctggaggctatcacccttagtaaactaatgcaggaagagaaaaccaaatactgcatgttctcacttacaagttggagctaaatgataagaactcaggaacacagaaggaaacagcagacactggggtctacttgagcaggaagggtcaaaggagggagaggaacagaaaagataactattgggtcctgagcttaataactgggtgatgtaataatatgtatgacaaaccgccgtgacacatgcttatgtaacaaaccttcacatgtacccccaaacttaagttaaaaatttttaaaaagaaataatgatttccagatatcctatatattttttttttattttttaacaaaataagatattatccttgattatccttgtatatctctatacagcatgagctagctgctgttttctaatgtttgctgtctgcattaattaatgctttggttgctatggtgaattacaaagcacaggaagatgcatacaaagaattgaacttgtgtattccacttagcttcaaccatcatatggaaaagatttgctatgtgttttaccattggcctcatcagaacatctacttttaaaatttactgggaaaaggaatgaaaaggaaaaatgtcaggggtatttaaacattgtttttcatagacgttcttccttaagtcagcttgaataagtagtaggaggaggctcaggaaaacatttattaatgttttcataaccaaatgtgacatagtcatctttgcgaggtacacaattgagccaagctctaagagcctatccctgtatctaggttttgtccttacatgtatataacctacacccacagtttaccatccgtgacattttctttcctctccagtagtacaaaaataccctgccaccctgaaatgatcagactgaaggacagtgttctcttactatgctaaaagcccacttgaatttgttccttcccagttcttgcctttcttttccataagagacagatatattgtccaggcaggtgatggtcagaggatagctatggtgaagcaacatcattttccatgatgctctcatttgtctgctcaatcgctttttaaattgacttatcagatcagaagctcaaaacaaaggtgttaactatctgattcttcccattagtcaccaagatggtcactgtacccctgcaaaggaaagattccctcccttcttcttaataaaataatctgcaattcatttatttacttaagtaaataaaatgtgtttatttgagtaatccattatgcagtttatcttgagcaaatatatatattactttcctacatttttcatgttttttggtgaatataatgtcctttcagccttgagtattttattgtttccgaacactttaactgcctcttatcttccagctttttacatagtctgtaactatctgggtaatttttcagtcatctcccttccttcttcccctcttttggagtcccccatagtctcttctcttcatccttatgtccatgtgtacctgccatgtttaactcccatttataagtgagaatatgctatatttgatttttctgcttcagataatggcctcttgctccatccatgttgctgcaaaggacatgatatcattcttttttatgcctgcttagtattccatggtgtatatataccacattttctttattcagtccactattggtggatacttaggttggttccatagctttgctattgtatatagtgctgggataaacatgagtgcaagtgtctctttttatatgatgatttcctttcctttgagtagatacccagtagtgggatttctgggtcaaatggtaagttgtttttgttttttgtttttcctttcttgagacagcatctcattctgttgaatggagtgctggatggagtgtagtggcagtcacagctcactgcagccttcccaggctcaagtgatcctcccatctcagtgccccctccctgcccccagcctcaccaagtagctgagactataggggaaagccaccacgctgggctaatttttaaaaattttttggcagagttggggtctcacaatgttgccaggtggatctcaagctccttggctcaagcgatccacctgccttggcctcccaaagtgctggaattacaggcataagccaccaggcccagccttttttcgttgttgtttttaaggaggaagaggggacatgagcaaggatgtaccctgtgcattcgctcccctccctgtggcttaattgctagttctatttttagttctttgagctagttccataatgttttccacagaggttgaactaatttacattccaaccaacagtatatgagcattcccttttctccgcatccatgccaacatctgttgttttttgactttttaataaaccaaaatagtaagagccatatatgacaaacccacagctaacatcatactgaatggggaaaagttggaagcatttcccctaagaactggaataagacaaagatgtccactctcactggtcctattcaacatactgaaagccctacccagagcaatcaggcaatagaaagaaatataagacatccaaattggaaaagaagtcaaattatctctgttcgcattcaataggattatatacttagaaaaccctaaagatccctctagaagattcctagacttgataagtgatttcattaaagtctcaggatacaaaatcaacatacaaaaatgagtaacatttttaggcaccaataacattcaagctgagaatcaaagtaagagctcagtcccatttacaagagacacacaaaatacttaggaatatatttaaccaaggaggtgaaagatctctacaaggagaactacttaacattgatgaaagaaatcatagatgacacaaacaaatggaaaaacatcccatgcttatggattggaagaatcaatattaaaatgatcatattacccaatgcaatctacagattcaacacaattcctatcaatttaccaacatcattcttcacagaattaggaaaaagaatcctaaagttgatatggaaccagaagaaagcctgaatagccaaggtgctcctaagcaaaaaacaaatccagagtcacattgcctgacttcaaattatattataaggctacagtaactaaaacagcatggtactggtacaaaaacagacacatagatcaatggaacagaatagagaacccagaaataaagccacatacctacaaccaactgatcttcaataaagtcgataaaaataaacaatggggaaagaacaccccactcgataaattatgctgggaaaattggccagccatatgcagaaaaatgaaattggacccctatctcttaaccatatacaaaaattaactcaagatggattaaaggcctagatgtgggacctgaaactgtgaaagtcctagatgaaaacctaggaaaaactcttctggacattggcctaggcaaagaatttatgacaaagatcccaaaagcaaatgcaacaaaaacaaaagtagacaagtaggacttaattaaactaaagggcttctgcacagcaaaagaaataaccaacagaataaacagacaacctacaaataatgcctccaacaaaggactaccatccacatcctacaaggaacgcaataagtaaaaacaaccccattaaaaactgggcaaacgacatgaaaagacatttctcaaaagaattacaagtggccaaaaaacgcttgaaaaaatgctcaacattactgatcatcagagaaatgcaaatgaaaaccacactgagatatcatcttacgctagtcagaaagtcagatgccaccactctggttttaccttcctaccggctcttctgaagcctttgttattttctctctcttgctctcgctcttgctctcactctggctctggctccccccatcaccccattattttcagcttcttctctgccgacttcttttccacaggctataatcatactcaattttcttttgttaaataataaatttaaagcctttggtcctagattttcctgtaagttatgtccttcccttcatagccaagctttttggataaagaagcccacagtcactgtcttctgtttctcaattcttcaatccatgtagcctggctccttactccactacaacacactaaaacatttcttgcaaaatcacagtagtaaatccaggggactctcaattcccaccttattttccccactgctgcatttcacactattaaccattcttttcttcttgagactcagttgggcctcaacctctcccttctgattctcctcctacctttctgaaaatgtccttctcagttgctaatgctggctactctttttacttgttttttagttattagggactcagcaaaaaatctgtcttttggttttcttctcattctacatgatctccctagataaaactcatctattcccatggcttcagctaccacatattcggggaaagcactagacctgaatatacagatgtctagtgggcatctccattagaatattccacaggtatctaaaacacagcatgtttttgtcttatgcacagtaaatgtcctttttctcaaacctaaaccactacacctagttaccaaaaccagaaaacaaagttatggactccccctttacccctatcctccacattcagtcattgaccaaatactgaagaatatgtatttttttgtgactggacatccagtacctcctcttcaccctttctgggatgtctttagttctaggtttcatcatatcttcccagaagtcttacactagccttttattctccaacttttcccaacagttacacccaattcattcttgcacagctgccaaaactatccttcaaaaaagcaaatttggctgggcatggtggctcacacctgtaatcctagcactttgggaggccaaggctggcagatcacctgaggtcaggagttcaagaccccctgcctggccaacatggtgaaacctcgtctctattaaaaatacaaaaagtagtctggcatggtggcgcacgcctgtattcccagctacttaggaggctgaggcaggagaatcgtttgaacccaggaggcagaggttgcagtgagctgacattgcaccactgcactccagcctgggtgacaagagcaagactccgtctcaaaaaaaaagcaaatttgatcatagtaacctgtgagaaccccatgacctgtgagatttgaggtgtgtgagctggcttatgcttttccctctttttctcactatgtccccaacttcacttctgctccaaaggaagagttaggatgagtccaaagtttttggcccaagcaactagaaggctaaagtgaccatcaagtaagatagggaaggctataggtagaacagacttagggaagattggggatttaaaacgtgttgaattgagaaataattaaacatccaaatggaaatgtcaagtaaacaggtatttaagtctggagtttagaagaaaggtctgggctggagatggagatttgggaaccatcagcagatgtatttacaaccaaaaaatggtgtgattatccagggaaggaaatgtgctgtttctctggtaactagtaatgtaaccacttgtcagtgtagctgttgagcacttgaaatgtggctagtgctactggggaattaaatatttaattttattttggttaatttaaatttaaataaccataagtgacaagtggtcactatactgaatggaacagatggagagaatgagtttagattaagaagaaaggaggatcaatgtctgggctctgagtattccacaattaagaggtcacagagatgaagtgggaccataaaaggatactgaaaagtagcaagggaaaaaatcaaatatgaaattttctggaaaccaattgaagaaggtatatccaggaggagcaagtgatcacctcagtcatatgttgctgataagtcaagtaatataaaactgttctacctcacccatcatcaggcaatagtttcataaggaacacacaacctagatccctcccatgcgtagttcacagtaggatttgcactcctatgagaatctaacgcctccacggatctaagaggaggcagaactcaggccctaatactcactgctcacctcctgctgtgcccccgcccagttcctaacagaccacggactggtattggtcctcagcctgggtttggggacccttatcgtaattgacactttaccataacaccctcttcatcattggtagcttgtataactgtttttagggggaaggtttttttggggtgtttttgtttgtttgtttttggagatggagtctctgttgcccaggctggagtatggtggcacgatcttggctcactgcaactttcacctcccagattcaagcaattctcctgcctcagcctcccgagtagctgggattacgggcagctagcactacgcccagctaattttgtatttttagtagagcctgggtttcaccatgttggccaggctggtttcaaactcctgacctcaagtgatccgccttcctcggcctcccaaaatgcatataggcatgagccatcatccccacccttgtataaattttactgggaaatctctgcaatttagagactatctgaacattttaaaatagccacaatagctgattctgtttcagtgaagtcccacaagaacaaatactctctcagttaattctttcaaggtattttagaaagagagagagagagacaagcaggaaggaaatgtagggttggggtttttttcatgatttatacataagcatgtatattccttgattaaagatgtttctggttagttttgtgcaataacattcaaaacggatgcttctgattgatgtagttttagtgtccaatgagtgatttaacaaaattatttgcctagtaatggttttgaaaataatttgatctccttcttggtgatatttaaggaaggagctaataggaacattcacttttgttatgaagccattttgatacggattgaaacaggaaacagagtaaaacaacacagtgctacccaagtgaagctagtgactgagctgtgttcgcatgtccagtatcagctacactcatggtttttttggtttccatggtttctttttcttggtttatcaaaggattcagaaaaaagatttcaagaaaagatagagttcctagaagcaccattaatttttgtgtcccattcttttttttatactcaaaatactaaatgtttctagtttccatgttttggggacatctaaatatgctagttctttcaaaaatgctttgaggtccttgtacagaggccattgtaatagcactgtattaagtatttgacaaaggcttatacatgaaaggagatgtgtagtattaatacaaacataaaattctgccgtattgatatcatgtcatggtaaggcactctgcaccctcttgaatataaaagaatatttctacatttggttccagcaaacactattgtgctattctgaaatccacagcacagaaattataagacatccgctcataaacagaaagcaaatcactattcagcatttcctgctctgtttcctgccaatttcagataattgaaactttttttaaaccttttattctattctgctttaattctgcttcctccaccaaaaaaaaaagatttagaaattaaaactctgtgtatgtaagtcacagtcctttttttttcttatcctgtgataatatctcattcttcattattgcagacctcaggatatcattgtgtttgtaattggaggagccacctatgaagaggctctaacagtttataacctgaaccgcaccactcctggagtgaggattgtcctgggaggcaccacagtgcacaacacgaaaaggtaaaagagaacattcattctacaactgtgtcctctttcccagaggataaagcttaaattccctttatgttggaaaaatttggtcaatactcaccaaactgctgtagactgaaattctctggtgtttgcagctccagaataatttaagaatttgtgagagaaaggatctatagtagttaagttcgttaagttcataaatctctttattaggtcaaagacctagaaagtaagaaccatcttacactgttaacaatttgtatttcctgtgttcaaaaaaggagaaacccttggacctaattcataaggaagggggaaaaattaaaaattgggttttttttaaagagggagaaacctaatagccacagcttagactttgaaaatacttaaacataatggtattgaagtctgtgagtttttctattttgttgattaactttattcacttagcaagtattcagtaagaatacaaagatgaataatctaaagatcctacctcaagttattgtctattaggaaagaacatttaaaaataagaaaacaagtgcccagagaggcagataaaagggccaaggattctcagagtgactaagggaaattagcaaatgtttcacatagaagatagtatattagctgagccttgggtgaaaatggacatatggagggagagcacattctaggtagagttaaccacgtgaacaagttataaaagctgtaggcaacatacatacacaaagaacagcaaatagttgactagctggaatgtgtgtaataaagtgaaaggatgattgaatgccatcattgtggaaggccttgagtgccaggcttgggaatttctacttttttacatagaaaatggggaattattgaaagtagtgattacaagaaactcacggtgttttaggaggattaatttggcagctaaaggtagaagaggaaaagactggagaaccgtgacatgattgttgaatctaaagattggggaccctgagagatccatgctgagccatgtattctagataattgggagtcattaaaagtatttgtatactttttaattttgtatgattatttggtttttaatataacttttctcctttattatggaagtaatatatgcatattctgaatatttttaattcagaaagtacaaggagaaaaaacgtttccataatctaaccactgttacgttttagtgttttcaggcctttttttaagcctgtatagacgtttgtatgagtgtgtgggcagaaagggatctcatcgtacattctgtgttttaactttcattttgcagtctgatgtaaacgtcttctagtgttaaatatataatcattcattcattaaacaaatatttactggataagatttcttgggtttgaatcctgatttccctcttactatttttgtaaacttgggccaattactaacctctttgttagtgtccagaactcactggctatttatatatttcttttgtgaattgctagttcatattctttgcccattccacaattgaagtattcctttttttcttaataatttttttaattctatttatataaataaggttattggccatttgtctagtatttattttgcaaatctttttcctctatatttttgttttatactattcacagtgttttgttgtataaaagttttgttgttattactttaattttatatggtcacagttacctgtgatttctgcctttggtgtcatgcctagaaagttatttcctacacaagattatataaatactaagatgcattttaaaaattatttttaggatacatatttaacatgatatctttacagtctatcagaattttagttttgtgtaaactgtgctgtagggtttccttttataacttctacagaaatattacagtgagaaatattacagtgaggggcttttttcttcttgacaccaaatacaccatgtctttcccaacaccatttttccaattctccagacaccaactggatatttagcaatttgattcaattctgacacgatctacctggagttagcatctcatctcaaagttaaaagggcttaaccccacaagaccacccctacttcagatgccagtcacaagttccagaccacccgtatttcgggagtgactggttgtaaatcaggggttcccatgaccccttcctcaggtttgataatttactagaacagttcacacaactcaggaaaccactttactgcatttgccagttattacaaaggatacaactcaggaacagccaaatgtaagagatgcatagggcaaggtataggggtggggtgtggagtctccatgcctgctctaggaacacccaccccaccccagcaccttgatacgttcaccaacccacaaactcttcgaacactattgggtaggggtttttatggaggtttcgttatgtgggcatgcttgattaaatcattagcccctggtgattgattcaggctccaactgttttccccaccctggaggttcaggggtgggactgaaaattcaaagtttcttattaaggcttggcctttccggcaactagccctcatcctgaagctatctagaggcccaccaagagtcatctcattgaaacaaaagacactcccgtcaccctcagtactcagaaaattcttagggaattaggagctctgtgccaagaatggggacaaagaccaaatatctttctgtgataccacatacatacacttacacacagttatttcattatgtacggaaaagtatataaatgataaacagctcagtaaaacattgcaaagtgaatatatctatgagatgacctctgagtgtaatgatcaagaaatagcacattgccagcacccccagcagcctttcttattcctcatgctccctccttgtcacaaatccgtgcaaagtattcattattatgacttctgtcaccgtagattagttttacctgttcttaaaagatattttttgaataaaagaagaaataagccaggcgtggtggctcccacctgtaatcccagcactttgggaggccaaggtgggtagatcatttgaggtcaggagtttgagaccagcctggccaacatggtgaaaccccgtctctactaaaaatacaaaaattagccaggcgtggtggcaggcgcctgtagtcccagctactcaggaggctgaggcaggagaatgcttgaacctgggaggtagaggttgcagtgagccgaaatcatgccactgcattccagcctgggtgacagagagagactctgtctcaaagaaaaaaagaagaagaagaagaagaaataaaggctacacttaatctatttctgcctttctcacaaataatataagaatattaaaatgttttaactgtaatcactttcctcccaatttgtacactatcattgtccagtgttttggttttacctttttaaattcccaaattaatcattattttcagtagttaatgtttatctatatttactcacatatttgcccccttttccccctccactttgtttctttcctcctggctctttcttcaatccaattttcttctaactaaagaacattcttgcctgaatcccatgcctgtactcccagcgctttgggaggccgaggtgggcagatcacttgaggtcaggaattcaagaccagcctggccaacatggtgaaatcccatctctcctgaaaaatgcaacaattagccaggcgtggtggcacatgcctgtaatcccagctactcaggaggctggagaattgcttgaaccggggaggtggaggttgcagtgagccaagatcgagtcactgcactccagcctgggcaacagagcaaaacaccatctcaaaaaaaaaaaaaaaattattggccagtagtttaggaggccatggcgggaggatcatttgagctcagaagtttaagaccaaacctgagcaatatagagtgactctgtttctaaaaaaaaaaaaaaaaggtaaaaattagctgggcatggactaggcatggtggctcacacctgtaatcccagcactttgggaggccaaggcaggcggattgcttgagcccaggaattcaagaggagttcaaggagttcaggctgggcaacatggtgaaactttgtctctacaaaaaaacacaaaaattagctgggcatggtagcatgtgtctgtggtcccagctacttgggaggctgaggtgggaagatcacaagcctgggagattgaggctgcagtgagccgtgatcatgtcaccaccccccagcctatctgaacaagaccctgtcttaaaaaaaaaaaaaaaactttagtatttttttcagctattgttcattttgatgcctttgtctaaaagtgtcttaattcagccaagtttagaatttcaggttgataattttcacttacttaaaagtaagacaacaatggaatgctgtattacttggtatgaaaaagtcatgtttggcataatttctggaaattttacagtcattatttctttgactgttgcttctctttcatctcctgttgtctatccttctggaattactgtgagatatatgttaaaccttcatctattcttcaggtctcttaatctctcatttatgttatccatctgctatctgtctgtgctgtcttctgtataattttttcagatcagtgttccagtttagtaattctttcttcagctatatctaatctatgtttaatttgtctactaagtccactaatattatatttttatgctcacgagttctattttgcttctttttcaaatttgcctgatgtttttgttagtatcctctttttttctcatgttttcaaatcctttatttttgctaaaccacattaactctataatctgaagtatgtgtaggtctaattctgctgttatatctgctaacattaactcatgatgaagcatttctgcatgtgttctgtgattttgacttatgagttatcttaagaaggattttatctatagcacccgtgaggagctgacattcaagatacatctctcttgcatattcttctttcatttttgctaggtaccccaagagcattgtcagtctggaatcatttttatgttagtttctatacataagggttcctgaaccttgcaaagcatatctccttgtgcagatagatttttttagtccactttttcagtgagggtctctatattacatggaaatctcaattttgatttattttcttaccgaggcctaagccttctttcctgaccctctgtggctactaaaacacagtgcccttgtttaataacactggcacacacctattagatagttgtagcatcagtttatacttatcaagctaagttttggttccctttttgtgctgacccttagcaattcctctcactttccaaagaagttagatattcatttaaaagaatgtttgtcattttttatcctgcatttgtatgtgttttattacaagataattttcaccttatataatctcccttaattctagaaatggaagtgtcagtgtggttatgatcttgggagtggataaaatggtagtgacattatagaaactccattttgaacatcagtagatgatatgatttggaaggatagccatgcatcctaaaatgtcaaactgagggttttgtacctaattcaagggcacctcttgaatatttttgagcacagaagtgacataatattattagagctattttttcaagtgtctccctttgctgctaataaagcaataatagttcatacttattgagtagatactgtatgctaggcactgtactgaaagtactttaaatctattaattcattgaatcctcacataaagtttgtactattattatctttatatatggaaactgaggcacagagagattaacttattcaagtaaacatgactagtaagagatggagctagtattggaagccagaacccatgcttttaaccactatgcatttccttcctcagtattacttgaatgcctaatgctgcattattctctaaataatatttaataatttagggtgcagaaggttttattacttgatggtagccatatgggattttgtcttcttgatccaaatgagttatttcatgaatgtttagttaatcatatgcttttaaataggcttccatatcagaattcaaaaagatgatttgacccttaagtgattcctctgagagttaatatttctcactatttgtagccttatggccagtgactaagaattgtagcatcatccctttaatctgaaatatcagcaggttaaaattaaacatatatatctccatttaaaaaaataggccaggtgcagtggatcacacctgtaatcctagcactttaggaggccgaggcaggcggatcatgaggtcagaagatcgagaccatcctggctatcacagtgaaaccccatctctactaaaaatacaaaaattagctgggcgtggtggcgtgcacctgtagtcccagctactcaggaggctgaggcaggagaatcacttgaacctgggaagcagaggttgcagtgagccgagactgtgccactgcactccagcctgggctacagagggcgactccgtctcaaaaaataataaaataataataataataataagtaggggggccaggcatggtgggtcatgcctgtaatcccagcactttgggaggccaaggtgggcggatcacctgaggtcatgagtttgagaggagcctggccaacatggggaaaccccatctctactaaaaatacaaaaattagccaggcatggtgacaggcacctatagtcccagctactcaggaggctgaggcaggagaatcgtttgaacctgggaggcggaggttgcagtgagccgagatcgcaccactgcactccagcctgggcagcaagagtgagactctgtctcaaaaataaataaataaataaataagtaaaaataaaaaattaaaaataagttgggggccaggcatcgtggctcaggcctgtaatcccagcactttgggagaccgaagtgggcagattgcttgaactcaggagtttgagaccagcctgcgcaatgtggcgaaactccatctctaccaaaaatacaaaaaagtagccaggtgtggtggcgccacctgtggtctcaggtacttgggaggctgaggcaggagaattgcttgagtccgggaggcggaggctgtagtaagctgagatcgtaccactgcactccagcctgggtgacagagcaagaccctgtctcaaaataaataatataagttggatttagatagaaagatagattagtaaagattttttatatgtctttgtaatttagtcatagtacatacaaaaatacatgttttagatgtgtttgactaattaatagtgctatgggctgggcacggtggctcacgcctgtaatctcagcattttgagcactgtggaaggccaaggcaggcatatcacttgaggccaggagttcgagaccagcctgcccaacatggtgaaacctcgtctccactaaaaaatacaaaaattagttgggtgtgatggtgtgtgcctgtaatcccagctactcgggaggctgaggcacgagaatcacttgaacccaggagacagagtttgcagtgagctgagatggcaccattgcactccagcctgggtgacagggcaagaccctgtctcaaaaaaaaaaaaaaaaaggtactatgaataaaacttcattttctgttcaaaaaagtagaaaaaagaaaaaaaaatgaaacatctagggttttccttaaattagtgttcaagttcctgacaaatgaccttttgtttttttggggacggagtcttgctctgtcgcccaggctggagtgcagtggtttgatctcagctcactgcaacctctgcctcccggattcaagcaattctcctgcctcagcctccagagtagctggcactacaggcgtgcaccaccacacctggctaatttttgtatttttggtagagacggggtttcaccatgttggccaggctggtctcgaactctggacctcaagtgatccacctgccttggcctcccaaagtgctgggattacaagagtgagccaccgcacccggcctcaacaaatcatccttatataaaattaagaaggtaaggcagtcctgcgaaggccttatgctagattcttccagctattgtcagcgttggtatctctgtgtgacctaatagcatgctaagcagtacactgtattacatttgagcagatatcttagcaataaagattcaataaaattttggacagaattgttcactggcttcctgaccaaagaaacttttgcaaagagggagttgctatggcaatcaccaaacaggaaaaaatattagttgatttttgcaacacataaatgattcaatatcaagtgtttatagtttacttttgtaaatagatagccctagccaataagtaaatagtgaaatttatcataccagtaagaagattatggaatttatatttcagaggccagttattgtgaaggcttaagtaactgaaagcaatagtttcacctttgaatggaaaggctcaattttcatgatgaatgtaggataccttgggtattactaacatatttagtaagtttacaactcttaatacatattggaatcttagactctcagtaatggaaaggctaatattttttaaaaatcagttttatacctggatatagtagggctgcagtgaactagcaataatatgatatggaggagaaaacattgaataatttgtttctgtgaattattagggtttaattttgtaggagttttagtgtataattttctctgtaatatatgggttatttcttaaggaaacaggccaaaagaattagtgacaaaaatgcagccttgacctcaagagctctgcagcacagaagtagctttttgagagactagggagattagaaaatggtatacgtttagatttgccgcgatattgctctccttttacacttagaatcatgtaagtcatggtatggttggccatgtcttacatgtcttacatccaaatccatggatttggattagtgggtaccccaataaacaggaaagaaatgatatcttgtcactgtgtgatgtattaatacagaagctactatccttccagaataggaaatgtctattgtggaatatttctggaatacaggtcacttggtttccctattacaactcttaaataaaatctgaggccgggcgcggtggctcatgcctgtaatcccagcactttgggaggccgaggcaggcggatcacctgaggtcgggagttcgagaccagcctgaccaacatggagaaaccccgtctctactaaaaatacagaattagccaggtgtggtggcacatgcctataatcccagctactagggaggctgaggcaggagaatcgcttgaacctaggaggcagaggttgcgatgagctgagatcgcgccatcgcactccagcctgggcaacaagagtgaaactccatctaaaaaaaaaataataaaatctgagattactaaacagatttattctgcatgcaaatttcagaactaccacttactagtttttttattacttaatcacttaatgtaatgggtagataggtcaaaattgatctcctgcatcccagaaaataacaagtacccttacccgtcaggtagcaattttagcaaccttaatcatggtttctctatttttatttctgacatatatcaagatcacttttactgtaaattgaaacaaaatcttagttgtaaacaaaacttaaaaataaagaagagaaagcaattattcctttcctccctagtatatttccaaaaatgaacataatttttagtgtaagaacagagcctttgtataagtaagctcgtcatcttaagcaaggagtcacctgaagatataggtcccttagatcctaataggaaatatacattagtttaatctgaaattgaagttgccattcaaagttatcttaaagtggctctttcttgcatactttatttctttaaaacagttcttttgcgataatattttttagtgattcaggcgctggttgtaatgaagcagagttctatatatgcaggccttccgtagttgtatgatttgtttctatagggcctgctctgattagctgtaattgtgattatctttgtttagatttaaacaccatttaaaatagaaggcatgtatttgctgctaagacaccaaggaactttgcagaagcaacttatctccttagcaacattctttttttttttttttttttgagtcagagtcttgctctgtggcccaggctggagtgcagtggcgcgatctcggctcactgcaagcttcgcctcctgggttcacgccattctcctgcctcagcctcctgagtagctgggactacaggtgcccgccaccgcgcccggctaattttttgtatttttagtagagatggggtttcactgtggtctcgatctcctgaccttgtgatccacccttctcagcctcccaaagtgctgggattacaggcatgagccaccatgccctgccctccttagcaacattcttaataaaattgccttctaaataaagagaggcagtcaatatttcttctctttccatagccatatgaagtttaacatgaattttgtattacttccctttttcatttcatatataatgaaatacacagaaataaaatgtagtaaccaattacagagacttctttaaagatataactgttgtgcttttttgaaggcaaagaacctgccctgaaaaagaatctgacctgaacacatgctgtcctaagcagttagtctagtgtgtctctggggtctatgcaggtttgcagtgtacagactgttatctcctgtctcagtatttgcccttcttatggaattactttccttcctcttactaccttatttcctcctcttcatttgtctcattagttgtattagccagatatatatttacttgtaggggagggggaatgtcaaatttcagtttctaggaattatatatggcatgagtcattgctatagcatcacagaaattttcatcaacgtctatctagaacagtcaggagttctagttatgagttctgtaatagatatttattgaacatgtgagaacaatgtaaagccaatagttggttcactcaaatatttactgagcactgggatacctccatgaataaaacaaagatcctaacccttgtgaagcttcattttaatgcagggggagacagaaataaaccataaacttaacaaataggtatattttatagtaaatcagtatgtaatagatgcagtgggggggcagggaatatgaaactgtgtaaagggaaattgatagtgcttggggacagtggctgtaggttacactactcagtatggtatcaggaaaggcctccttaagaagagatgtgtgtaggccaggtgccatggctcacacctataatcccagcactttggggggccaaggcggccggatcacctgaggtcaagagttcaagactagtctggccaacatggcgaaaccccatctctcctaaaaatacaaaaattagccgggcctggtggtgcactcctgtaatcccagctacatgggaggctgaggcaggagaatcacttgaacccaggatgtggaggttgcagtgagctgagattgagccactacactccagcgtgggcgacagaaagaagagtgtgcaaagacttaaaggaggtggggggagtaagccaaacagatagagggaaaaagcattccaggcgcagccacagccatgtcctaagaatcatgcaatgcgttggaggagctgcaaggaggctggtgagtctgggtggagtgagcaagaggagtagaaagaaatgcagtgcgagaggcatcaatacctggggctgttcctggagcaccttatatactgtgaggactgcttttcactaggagttagagagcacttttgggttggggttttttttaatgtttttattgagctaaaatttacataccatacaagtcacccatttgaagtgtaaaattcagtggtttttagtatattcacagatatattcaactattaccacagtcaattttagaacattttcattggctgggcgtggtggctcacacctgtaatcccagcactttgggaggctgaggcgggtggatcacctgaggtcaggagtttgagaccagcctggccaacatggtgaagccccatttgtactacaaatacaaaaattagccaggcatggtggcacgcacctgtaatcccagctactcagggggctgaggcaggagaattgcttgaacccaggaggcggaggttgcatcacgccattacactccagcctgggcaacaagagcgaaactccttctcaaaaaaaaaaaaaaaaagcattttcattgtatccaaaaatccccctctccagccctaataaaccactaatctaacttctgtctctacaaatgtccccattctgagcattgcatgtgaatggaatcatataatatgtattcttttgtgactggcttctttcacttagcataatgttttcaagactcctccatgtgtaacatacatcagtactttattcctttttatgactgagtaatatttcactgtatgcatgtgccatgttttatttatccattcatcaattgatggacatttaggatgtttccatcctttggctattataagtaatgctgctataaacatttatgtacaagtttttgtgtgcgttaatagggttttaagcagagccatgacacctgacttacgttttaggaggatctatcaaagcaatgtgaattaagaaattatccaccaaaatgaacatttgcttattataaaaatgcaaatttctagatgtagttaaataaactatacccattattttattcacctgcaataaactgagccattattgtagttggttttctgaagcacatgatcctaccttgcaaataaacgagcatcttggtttggattttgagctggcctgccttagcacttcacaggtcaatcaatattaaagagttctagtccctgccagcagtaattgacacctttaagttagctgtgtgagctgagaggtcaagaacccaatccatatagatggaattgttatcgtaataggcaaaaatacctgtcttcatgggattcaggatagaagtagagggaaaaagggtggctaggtgaattcattagccaatagcgctgccattgcttgaacactatgtgaactttatttagtctccagttcttcttaaaacttttgacaaatagaaagacatatcctgctagaagatggcatgagagcaacaattctctcgctgccagattccctttcaagccaataataattactgtacatagtatattctttgtcatagtactagatccaactaagccctcattagctataaacctaaagaataattaatgatcccattttcaattattttccccataagtagcaaagacagatagtgctggcaaacaggtaaaggaaagtaggcattccccttgaccaagtaattcatgctcattgttaaaaggaaatgaggctgaacacggtggcttactcctgtaatcccagcactttgggaggccgaggcgggtggatcacgaggtctggagttcaagaccagcctggccaacgtagtgaaaccccatcgctactaaaaatacaaaaatcagtcagacgtggtggcgtgcacatgtagtcccagctactcaggaggctaaggcagaagaattgcttgaatctgggaggcagaggttacagtaagccgagatcgcgccactgcactccagcctgggtgagagaccaagactccgtcttggaaaaaaaaaatgaattataaaagtaaaaatcattcataataccacagctcagagctaatcactgttaatatgttggctttttttctttttttctttttttttttttttgagacagagtctcgccctgtcacccaggctggagtgcagtggcacaatcccgcctcactccaacccccctacctcccggatttaagtaattctcatgcctcagcctcccaagtagctgggactacaagcctgcagcatcacacctggctaattttttttttttttttttgtatttttagtagagatggggtttcaccatgttggccaggctggttttgaactcctgacctcaagtaatccgcctgccttgtcctcccaaagtgctgggattataggcataagccactgtgcccagccccttctaatatttttttaacctaaatgttttagaattttgtttatgttttgtttttaacataagatctatagagtttttttctttaatcatttgagaacattttcccatgttactaaaaagtctttaaaacaatcttaatggctatataattttatttttaaggatgggtctttatttaactattaccattggacatttaggttgtttacatttttttcaccagcatattcagctgcaagtttacttttattttttatttatttatttttttgcttttttaaatttttaattgacatgtaataattttacacatttattaggtacagagtaatattttgatacatgtatacaatgtatactgatcaaatcaggatatttagcataacagcacatcaaacatttatcatttctttgtattgggaacattcaaaatcttttttttctgtattggatatgtattttttattttttttactttttttatttattttttaatatatatatatttttattatactttaagttctagggtacatgtgcacaatgtgcaggtttgttacatatgtatacatgtgccatgttggtgtgctgcacccattaactcatcatttaaaaaatgacgagttcatgtcctttgtagggacatggatgaaactggaaaccatcattctgagcaaactatcgcaaggacaaaaaaccaaacaccgcatgttctcactcataggtgggaattgaacaatgagaacacttggacacaggaaggggaacatcacacactggggggaggggggagggatagcattaggagatatattttttattttttttatatttttaatcatttttgagatggagtctcctctgttgcccaggctagagtgcagtgatgtgatctcagctcactgtaacctccaccacccaggttcaaggaattctctgcctcagcctcccgagtagctgggattataggcgcctgccaccactcccagctaatttttgtatttttagtagagacgggctttcaccatcttggccagactggtcttgaactcctgaccttgtgatccacccgtctcagactcccaaagtggtgggattatagatatgagccactgcccctggccaagcttacatttttaatataaataatgcttcaataaacatcttacgtactgataaaacttggtccccatctcggtggggacaaaggtttaagataaacgtatagtgaggcagtctgaaatattgccagtagaaggataaattagtataactttcctagaaagcaatttagcattatatattctaaggtatgggattaatttcatggcttttgttgttgggtttttgttttgttttgtttttttgagacagagcctcactctgtcgcccatgctggagtgcagtggtgccatctcggctcactgcaagctccgcctcccaggttcacgccattgtcctgcctcagcctcccaagtagctgggactacaggcatctgccaccatgcctggctaatttttttttgtatttttagtagaaatggggtttcaccatgttagccaggatggtctcaatctcctgacctcgtgatccgccctcctcggcctcccaaagtgctgggattacaggcgtgagccaccacaccggcctgttttttgatttttaagaagctcttgctcaagtgatggaaatgttctatatcttgattgaggagttggttatacaactggatatatttggcaaactcatcaaagaatatccttgatatcagtgaattttattgtctatgagttatagctcaataaaaaaaatttatatgtagctgagcagaggtggcccatgcctgtaatcccagcactttgggaggctcaattgggaggatcatttgaggccaggggttcaagaacagcctgggcaacatagtgagactccatctccacaaaaaacgttaaaattagccaggcatcatggtacgcacctgtaatcatagctacaggtaagacaaagcactgtagtaccaaactgacattttctccttcaaatgttcagaaagataaaaaagataatttaaaatggaatagtttctcactgcataattcaatgttatttaatgccatgccccagaaccacctgatgtcaactgatgttatgactcacacactttgaggaaaactgggctattacaattcctaaagcaacgggtatgatgataatttggtaaaacacttaaccaaattttaaagacagtacaacaaaatgtaaaatatctcagtacttttttaagttgattacatgctgaaagataatattttggatatatgggttaaataaaatacactactaaaattaattttacctgtttcattttacttttttaatgtggccacgagaacatttgtgacttgcactgctttatccatttaattttgttaattctcataatgactcagtgaagcagattttttttttttttgaaacagggtctcgctctgttgcccaggctggagtgcagtggcacacacacagctcactgtgacattgatctgggttcaagcagtcctaccacttcagcctcacaagtagcttgtgctaactttttatttttttctagagacagggtcttgctatgttgtccagactggtctcaaactcctgggctcaaacaaacctcccaacttggcctcccaaattgctgggattactggcatgagccaccacacccagccaaggtagatatttttataattgttatcaacttcctttttcagatgaggaaatcaaagtagagagaagttaagtaccttgtccaaagtcataaagctagtaagtggtaaacctggaattgggcacagtctgtttccagtatgagtacctaagcactcagttgaaataatattttggaatatttatctagctatgatatttttaaatcctttgtttataaatgtcacctataagataggcaaaatatgtttttatcaaatggataatatgtgaagctttcagactactaagaaatattgtaaaccaaagctggggaaaaaataatacagaactgagggatcatttacttttattttaagaattttatcattcaatgatgattaaaaatgagatttaagagacagtgttgctctttgagtaaaaatgactaacttggccaggcatggtgactcacacctgtaatcccacactttgggaggccggggcgggcagattgcttgagttcaggagttcaagaccagcctgggcaacatggtgagaccctgtctctaccaaaaatacaaaaaaatagctgggcgtgatggtgcgtgcctgtggtcccagctactcgggaggctaagatgggaggatagcttgagcccagggggcagaggttgcagtgagtcaagttcgcgccactgcactccagcctgggtaacagaatgggacccttgtcttaaaaaaaaaaaaaaaaaagaaaattaacttgattaattagtggaagcttttagtttcataactatctgaaatgatgcctaagtgttataataatttaactttgacatggagtaagtgaaattaatactttttgtagtgaatacagctaagggcctaaaaaatagttggcatcttgaatttctatacataagtttgaggctggtagggggctgattcaatttgtgttatcaacaggtactttatagatttccacctaaacaagtaacactagaaacttggaccttctcctgtaaccaccagtaggttcaatctctgaattatttacagaaaaattaggatactatgacagaatttgcatttcaaagaggcaggaacccagaggggacttctcttcactacggacgtttcaggataagttttgaaactttcccaaagagattttctttcttttttttttttcagtgagacagagtctcgctctgtcgcccaggctggagtgcagtggcacgatctcggctcactgcaacctccgcctcccgggttcaagcgattctcctgccacaaagtcccaagtagctaggactacaagtgcgtgccaccacgcctggctaattatttttgtatttttagtagagatggggtttcaccgtgttagccaggatggtcttgatctcctgatctcgtgatctgcccacctcagactcccaaagtgctgggattacaggcgtgagccactgcatccggcaaagagattttctttgacagcttattttcctccagtgaccaaaggattagacatcattgcaagagttgtgatggagtgtgtcgcctgtcactgacaagcatttattgagtgctgattatgtgtaatgttctgtgcacggtgctagaaagatgaagacatgttctgtatctttaaggatctcaatgtctaataggaaaataaacatataaatgaacaactctaataagatgcctttttaaaagttgaatttaacccaggattcaaatttaggcatgtcccttgattccaatttgtttgtgcactgtaacgtatattttttaattaaaaaaatagcttttcattttacctctgaattgtgtgtaaaaaagaaatttaaaaaagaaaaatatcttttcattacaaaatcaatatataattcctgtaggaaaaaaaatttaatacagctaagcaaaaaaatagccatactgccaccatagggaatgttgtcagccttttagatcttttgctatgaatgtatacacattttttttaattttatttatttatttatttatttgagacggagtcttgctctgtcacccaggctggagtgcagtgacaccacctcggctcactgcaacgcccgcctcccaggttcaagcgattctcctgcctcagcctcccgagtagctgggactacacgctaccacacccaaataatttttgtagttttagtagagacagatttcaccatgttggccaggctggtctcaaagtcctgacctcaagtgatccacctgcctcagcctcccaaagtcctgggattacaggcatgagccaccacgcctggccaattttttttttttttttaagatggggtcttgctctgtcacccaggctggaatgcagtggtgtgatcatagttcactgtaacctcaaactcttgggctcaagcagtcctcccacctcagcctcccaagtatctaggactatgggccaccaagcctggctatctatctgtctaatctatctatctatctatttatttgagatggagtctcaaatatattgcccagtctggtattgaactcctggcctcaagagatcctgcagcctcggtctcccaaagtgctgggattataggcatgagccactgtgcccagcacacatatatatctatatataatacacacacacactttttttttttttttttttttttgagagacaaggccttgctctgttgccaggctggagtgcagtgatgtgatcttggttcactacaacctcctcctcccgggcttaagccatcctcccgagtagctgggactacacgtgtgtaccaccatgcccaactaatttttatattttttgtagagagagggtttcaccatgttacagcctaggctggtctcagactcctgggctcaagtgatctgcctgcctcagcctcccaaagtgctgagattataggcataaaccaccacaccaggcctagcccacatatatttttaaataaaaggaaacatactctacatgtgctttcaatgaaaatgcttatctatatcatttttaataactgaattatattctattaagtgtagcacaatttcatcaatcctcaattttttgttcattcaacaaatacttagtgagcacctactatattacaggggttaccttgagactggaatatagtggtgagcaaaacaaatattgtttgatattgtttgcagtttttcactcttataaacagtactgtaataaacatcattttacatacatctttaaacacttattcaattgttgacttggaataataataattgaatatatactatgtgccaggcagttggttgacttcattacatatattatctcatttaatcttcatgatccaagaagtgagatcattatgatctcaattttcaaacgaagaaataggaacatagagaaattaagtaatttgctttaagtcatatagcagggaaatacagagctggaactcaagctcagatttgtgtgatgctggattccatgcactgctggcaatgttggttaggcatcagagggtgtaagcgtttttaagatgcaaaattactaaactgccggccagaaaaattttattatacctgtatagtatatacacataatagtgtgtttatatcttcacatcatgcccgtgccaaccctgaggttagctgctgctgattcttaaaaataaaatttaggctgggcatggtggctcacacttgcattcccaacactttgggaagccgaggcaggtggattgcctgaggtcaggagtttgaaaccagcctggccaacgtggtgacaccccatctctactataaatacaaaaattagctgggtgtggtggcgggcgcctgtaatccagatactcaggaggctgaggcaggagaatcatcgcttgaacctgggaggcagaggttgcagtgagacaagatcgcaccattgcactccagcctgggcaacaagagcgaaactccatctcaaaaaaataaaaataaggtaaaataaaatttaaaaattatcagctaggcacagtggcacatgcgtataatcccgatgctttcagaggtcgagacaggagaatcacttgaggccaggagttcgagaccaatctgggcaacaaagcccagactcttttttttgtctctaaaaaaaaaaaaaaaaaaagtatttttagccatgcatgatggcatgcacctgtagtcccagctacttgggagactcaggcaggaagatcacttgagcccaggagttaaaggttacagtgagctatgatcacgccactgcactccagcctgtgtgacagagcaagactatgtctcaataagtaaataaataaaaattatcaatgtgtatggagaaggtcagttaaaaagcagtttacttcaacccagatgcagagaaagaaggaagaaacagattaatagtgtgaagcttaaagaagagaccaatgaataaatgagaaagaaatggaggcaagagtcagcaaggtagatgttatctagtttcaaagcagccttccagttccagattccagggttttatgaagcaatgatcttcttacattaagtcagtgacagacacccctgccctgtcaatgccatataataatcatttttcttttgtgtaagctactttgaatgggtttgtttcctgcagccagaatgttgagttatgggaaaaagttattctctctcacaagtttgtaggatatgcctttttgtgtcatgtggaagatccaatacagatttgcatatttgtttcaggacttgtgtaaaactaaaaagttaaaaatgtaaggaaaaactcaaacatgcttaactctgtatagtgagacagaagtgacctgtttacctcattatttccagtattatctatatttctgttttcatgatcaaaaaatattaaaatgttctaccaattttaaagagccatcaatttgatgccactggaattatttaaataataaagtgtccagttgattatattcaacacagccctgagttccattcctctgacaaaaccatacagtattaccttccccaaataaatgatgcatccttcagcacatatgttctttcactaggattatcattagagcttctgagcctaagtggaacctgttacttataaatcaccttttagtaccctttggtcttgttcgaagcagtgtaacataccaattaagagtatgggtttcagtgccagactaccttgtttaaattccagttttgccacatattcacttgtatgatctgagacaaatcatttagcctctttctgcctcagctttttcagctgtaaaatggaggtattaatagctccttcataccattgttgtgatgattagatgattaatatttgtaaaatgcttagaggtgatctggcagagggtaagcactcaatggatgttacctgctgttgctgttattactgttacattttggggagataaagtaaaacagactttgggtattcattatcaccacctctgtcatcacccttacttccaaataagttgtcttaaaaccctttaccataattcaaaggcagaattatattattattccaagtggaaatatactgaggcagtgataaaatgtactatgaagatagtccgatgtcagatgactttgcagtctgtgagaagaaaaatctttagtagttccatttccatttgtgttcacttaaaatttctcctttggggccccccagagtcagtaccactataattaaaagatgaaggccaggcgtggtggctcacgcctgtaatatcagcactttgggaggctgaggtgtatggatcacctgaggtcaggagttcgagaccagcctggccaacatggtgaaaccccatctctactaaaaaaaaatacaaaaattagccgggcgtggtggtgggcgcctgtaatcccagctgttcgggaggctgaggcaggagaatcctttgaaccagggaggtggaggttgcagtgagctgagattgtgccactgcactccagcctgggcaacagagcgagactccatctcaaaaaaataaagaagacttgcaaagagtcttcagcattcatggttgctacagctgggctatttggggcttcgtttcttgcattttttaatagtgttcaccatgctgcccctgtagttgtggttgttctgacacattgatgtgggcttgaatgttcccatacatctacacctctttttattctcagatgataactacctttcagatatgttctcagatgataaccacctttcagatctctgagttctgtccttgaggagtccatttttaaccctgtggacgatgagggtaattttttcctttctcttcgcatgacattccagtgaatgacacaaacagtgctagatccatgcagaatctcattgtttgcttttcttgctgtttcttctcaataagagaggaaatagtgccaagggctcctgtttgcttctttgttttgttttgttttgtttcatttcataaatcaggtggccagtactaaggagggaattccgaaggaatagctacattttttaataggcaattatatcatttgtaagaaagtgtcatagggtaaaataaccccagtggaattagttagaatcaaggaaatatcttatactttaattcagtgtattccaagacttattatatagaaaatttatttgaggagatattgataggtattccatttttaaaagggttctatagccaactaagtttggaaaacactctatccttctcttgaaaagtcaaaactcatattagcatattaaagattctgagaaaatctagggtaaagaaacccacttcacttttgtgttttttaattgtattttaatataatatttgataaaatatatgtagcatgtaagttagaaagcataatataataaatacgcttgagcctttcacctaacccaaggactagaaaattgccagtaacatagatgtatccatgtgttcctctccaattacatcccttatctccctacagcaggtaagtgctaacctagattttgtatttaattcccttgctttggtggaagaagattgtgtttttagcacttacctatgtatttctaaataacacattgtttagttttgcttgtttttgagctttataaaaatagtatcatacttttttcattaaactttgcttctaagattcatctgtattgttgcaggtaacctcaatcatttttcagtgctgtgtaacattccattatgtgaacataccacagtttacttttccattcacctgtccatagacgtgaggttttttgttatattttttattattactattgctcctctcaaggagaaacaagaagaaaatgtgagctaagaatattgacagaatattatgattatattgtttgggagcattaaggagtatatttattgagtggctgcctttactattcaaggcaggaactaaaacacaaacataaataaaacatccctgtcttcaatgatcttatggtccagtggaggagtcaaacaaattctgtatttttcatattaggatatgattagtctcaaagactaatggcacaaaataaacatgacacatcttttgaagtgcccagtttcttataatcagggggatgtgcaggggtagaattaaataatttaactgataagtaccttaaaatatgtttgtgtcaaaatttaaaaggtccttttatgaaaaataatataaaattattatgcatttttattttttattttatttatttattttttatgacagagtctcacacttgtcacccaggctggagtgcaatggcgtgatctcggctcactacaacctccgcctcccaggttcaagtgattctctagccttagcctccccaatagctgggattacaggtgcctaccaccacacctggctaatttttgtatttgttttagtagagacagggtttcaccaagttggccaggctggtcgcgaactcctgacctcacgtgatccaccctcctcggcctcccaaagtgctgggataacaggcatgagtcactgggcctggccagttatgcatttttaaaacaaaatactgaaagtcaaagaaagatgtaagctgatataccaatctggactacacccttaggactcataattcatttgcttctttttgtcctctgtcgcccaggctagagtgcagtggtgtgatctcagctcactgcaacctccgcctcctaggttcaagcaattctgcctcacccccctgggtagctgggattacaggcacatgtcatcccacctggctaatttttgtatttttagtagaaatggggtttcatcatgttggccaggctggttttgaactcctgacctcaggtgatctgcctgcctcagcctcccaaagtgctgggattacaggcatgaaccaccacgcctagccctgcttcttcctaggtataaaaatttgaggccgggtgcagtggttcatgcctgtaatcccagcaccttgggaggccaaggcgggtggatcacctgaggtcaggtgttcaagaccagcttgaccaacacggcaaaaccccatctctactaaaaatacaaaaattagccaggcatggtggtgcatgcctgtaatcccagctactagcagggctgaggcaggaggattgcttgaacctgggaggcagggattgcagtgagccgagatcgtcccactgcactccagcttgggcaacagagtgagactctgtctcaaaaaaaaaaaaaaaaaaaatttgaggccgggtgcggtggttcacacctgtaatctcggcactttgggaggccgaggcgggtggatcacctgaggtcaggagttcaagaccagcctggccaacatggtgaaaccccgtctctactaaaaaatacaaaaattagctgggcatggtggtggactcctgtaatcccagctattgaggaggctaaggcaagagaattgcttgaactcaggaggtggaggttgcagcgagccaagatcgcaccactgcactccagcctggacaacgagagcgaaactccatctcaaacaaacaaacaaaaaaaattgaaaagtgttcatgtacagaagttaaacaaaatgtatcctaaatataaataattaattctgacagagtaactaggaaatgcctcacagaggagctggtttttgaactagaccataaaggataagtaggatttccataggaagaaagagcagtcaaggctgaggaaaagcatgattaaggacaggagcaagatttaaaaaaaaaaaaaaaaaaggtgtaccacatttgagaaataatgagaagttcttcataagtaaagtctatctccagtgaggggcaggatgatctctgtgtgtgagatgcctggtatttccagatgtagatttgtttgtttgttttgagacagggtctcaccctatcacccaggctggagtgcagtggtgccatctcggctcactgcagcctccacctcccaggttcaagcgattctccagcctgagcctcccaaatagctgggaccacaggtgcatgctaccacacccagctaatttttgtatttttttgtagagacggggattcaccatgtttcccaggctggtctcgagctcctgaactcaaagtgatccacctgccttggcctcccaaagtgcagggattacaggtgtgagccaccacacccagcctcagatgtagatgttgaatgccaacctattcccttgctcctgataaaactgctgttggatatttagaaaaagtttagcacactaggtgacatttaagctggggtcttcttttaaaaatctgtatctgaatcatgttcatttggcaaacaattcatccactttatactaaggatgaagaaagtaatactcaagatgtgcactaactagtaagacaaaccattagaagagaattaggaggaagaaaacccgctcactgccttctgtcctgtcataggggatgaatgctcctagctggggctagctcttccacttgggcaccagagcccatctacctcacctacaccgggatatctctccaaactcccctttctttcccaaatcattttttcccacctgttgtattattcatagaagcatagaaatatcctgctatgctgggcacagtggctcacgcctgtaatcctagcacttttggaggctgaggtgggcagattgcctgagctcagcagtttgagaccagcctgggcaacacagtgaaacctcatctctactaaaatataaaaaattagccaggcatggcggcgtatttctgtagtcccagctactcaggaggctgaggcaggagaattgcttgaacccgggaggtggaggttgcagtgagccgagattgtgccactgcactccagcctaggcgacagagtgagactccgtctccaaaaaaaaaaaaaaaaaaaaacagtttgaaatatcctgctatgttctgcatctttaaaagccctctcttaacccccttactctttctaggctccatctcatttctgtgttctctttcatgggaaaattctccaagagttgtttacactcactgtctctaattccttccctcacatattctcttaaatccacatattctcctcaactactgcattcaggccttcactcccatcactctaaaatcgctgttgtcagggtccctagggacctccacatagctaaacatagagtcaactttcagtcctcattttgcttgacctatcagcagcatctgacgcagttcccttacttatttttttaaaaaaaatagagatgaggtattgctatgttgcgcaggctggtcgttgttatcacttagcttccaggaactatactgtcttggtcgtcctacctcactggccattccttctctgtctcatttgctgtttctcctatttttggaatccctgggacttggccacctcattcagtctcacggctttaagttgtatgtctcgactactaactcccagatttatatttctagtcctgagtttcattattgctatttggaggcagataatctgttgttgtggaggactgtcctttgcattatagatgttcagcaacattcctggcctatacccatgagaaaccagcagcactccaccagttatgacgaggaaaaacatctccagactctgccaaatgtcccctgagactaaaatcacactcctcaccccattgagaaccagtgtttcttgtccgaacttctcccccaaactctggacttgtatatccactgtctttttgacatctctacttgaatgtctaataaatattcatacttaacgtgatcaaaaccaaacttctgatctttgttgctcaatataatcctccctccgacttcccacctcagtggcacatccattcctttagttgcttaggcaaaaaaaaacttggcattttcttgaatctcctctttatctcacacctacatcctgacttatcaataagtcctgagagctttaccttcaaaatacacccagaatctaatgccctttcaccactactgctctggtccatgccaccgtcacttcccactgggattactgcagctgctttactcttgtcccccaacacccccttctcaatatagtagtagggtgatcttgtgaaaatgtgtcattcagggtatgtcacatctttttgcagaaccctccagatgtctctcatcttacccaaagtaaaaaccaaaattcttacaatgacatgccaggccttatatggtctctccttatagcccgctctacccattccttacctctccaatctcacctcttactatccaacaccttattcacttcactctagccacactaaccttctttctgttccttaaacatacagagccttgatccctttgcacttgctctttcccagatacatgctctgttgcctcattcaggtcttgactcaaatgtcagtttctcagggaggccttccttgggtactagtttttgtttttgttttggggggatgttttttatggtagcattttattcctcttcaagaaaagctattacctaacattgatgaactctctttttttttgagacagagtctcactctgtcacccatgctggggtgcaatgggatgatcatagctcactgcagtctctaaatcctgggctcatgctcaagtgatctttccacctcagcttcctgaggagctgggactacaggtgtgcaccacaatgcttggctaatttttaaaattttttgtagagggtcttgctatgttgtccaggctggtcttgaactcctggactcaagcaataggattaaaaatatcctcctgtttcggcctaccagagttctgggattataggcgtgagccaccatgggcagccagtcactagttttattttatttttgttgttgttgttgttgttgttttgagatggagtcttgctttggtgcccagcctggagtgctgtggtgcaatctcagctcactgtaacctccgcctcccaggttcaaacgattcttgtgcctcagcctcccaagtagctgagattacaggcatgcaccaccacgcctggctaatttttgtatttttagtagagacagggtttcaccatgttggtcaagctgatctgaaactcgtgacctcaagtgacctcaagtgatcctcccgccttggcctcccaaagtgctgggattacaggcgtgagccaccgcacccagcccagtcactagttttaaaatctcacaccactaccatctccaatactccttttttaaacctgctttatcttttcccatagtatttcttcatctaacatattacaaagaggcagtatagcattatagttaagaagacaaactgaagccagattgcctgggattatatcccaattccatcacttctggtgtgtgtgtgtgtgtgtgtgtgtgtgtgtgtgtgtgtgtgtgtgtgtgtgtgtgtatttaaagtggaatggtttctgtccattagagcagtactttgcatatagtaatatgtgtacaccattattattgtattattattattaactactaattaattttattttccttctctcccattggaatataaattccatgagagcagaggggtttttttttactttcttcattgctgtattcacagcttctagaacagtgcctagcacatagtagacactcagtaaatatttgttgatcaaattatgttatttctggagtgatgaggataaggagggtcaaggaagacaaggtatatgtttagaacttttacaaagagaatgtactcatgtatccttgtgcccctaaaagcttcataagcttgcatggaaaatggacatacagacaaataaattacaacacagtatatttacaagatatggaagaatgagtacgtaactctaaggggaaagcaatgcagttgaggaaagcttcctagaggagtaataatgtgagagttgggtttttaaagatgcatagttccaccaaacaaagtgtgagatggatgggacagcctttgaatagcaggtgcaaaagcaaagaggtatgaaacatagcagtggctctgaaaactgcaagccgtggaagttgagaggtgaggagcattttcagtgttttaagctattaataatttcatcttatccttctgccttacccactcccatactcctaacttctccaagtaagtgtttggctgtaattaggagcttattactccattaagacaaatatcttggggtttttctcattattttcctgaaagtctttttctatttttctgctccccacaagttctatttttttaattattataacactattcaggttctagattccccttggtgtctttggtataagaaattcacatgtaatttttacctgtggagtatagtgaaaaaggaggaagacatatccttaaattatatacacatacacacacatagtttttgttacagtatgatagctttgtttaggaatagaaacacagttgttcagctgaattattttagtaattaatatttttaatcctataaacattggtctctagtcccttaccagtgatgtaagtggagaagcttgcttttcagtgtgtgactcaagacttctcaaggttgactttttaaaatcagggttggggttctgcttttttccacccaccttccttctatacatggagtcaggaaaacacccttgatgacagcacaaactaaaaaaagcagtagcattaatccactctgttagtttctggcactgcctctgtttatactcatattggattgtgattgtgtatctgtctctgagagtcccttaaggtaggaatcataactaaggtgtacatttgtacacctagttcaacacctagttcataatggatgctcattaaacatttgttgaattggattgaattgaactgaattgaactggactatggcaccaacggagaaggggatttttgagtttgcttttaagtgagattgatttaaaatgaatttagaaagaaaaattattctttttgttttgtttttaaacatagtctaaatttggggtacagctagcaatatgttcattcgccataattttttaagcattctgagcaatgactcattagagtccccaaatagtttttttttaagtcatagtggccctaggaaacaaaattaggctggtaaatataaatagtaagtgtgttctcattatagtcaggaatgtggggtcttgttgatatacagaggaggatctttatttcttccctttgtagcagagttggaaatgaaccaaagatcccctgataaaattcctatagggcttcccagcacatttatttcattctttctagaagtcatcaagacttattgtgttattgttcaaaaaaaaatcagtgctacctcatttcctaacacttgttttctgacctccaattgtgtctagtccaactggccaaaaagccaggccaaagatgtctgtatttccatagaggaacaaatgaacttagcttctactcctttccctctactttgcaattttttcttttgcaaaggagtttggaatttaaattctccaagcccagaatctttcaatgcaagatggtaataaaactgcaaaacaatggtaataactggtcattcctccagtcctctgtcttttaaatatctgtctgctctgagagagagtcctgagcatccaaataacttgttgttgttgctgttgttgttgttgagacagggtttcactcctgtcgcccaggttggagtgcaatggcacaatcttggctcactgcaacctctgcctccaggctcaagcaattcttctgccttagcctcccaagtagctgggactacaggcacctgtctaatttttgtattttttatagagatggggtttcactatgttcccctgcctggtttcgaactcctgggctcaagcgatccacccgcctcagcctcccaaagtgctgggattacagcgtaagccactgcacccgtccatccaaataacttttatattataaagaaggctgtcttgccaatgggtagctattttattcatttactcagcataactttattggatacctctgtgttaagccctggagatctaaggtgagtaagacttccccctacctcccaagaagctcacagtctgtcttggcaacaattatacagtgctaagataggagtgggataaagtaataacagtaattagttcagcatggaggggtctggaagggctttacagaaaaagtgacttttatgtttatgtatttatgtatgtatgtatgaatgagaccatgcctggccagaaaagtgacttttaatccttagtcttgaagaataaggttcttgccaggcgcagtggctcacgcttgtaatcccagcactttgggaggctgaagcaggcagatcacttgaggccaggaatttgagaccagcctggccaacatggtgaaacccgtctctactaaaactacaaaaattagccagcatggtagtatatgcctgtaatcccacctaatcgggaggctgagggaggagaatcgtttgaacctgggaggcagaagttgcagtgagctgagattgtgccagtgcactccagcctgggcaacagagcaagactccgtctcaaaaaaaaaaaaaagatttcagcagagaaagaatagtcaaacataggacatagtaagaataactacttgaggtaggaaagctcatgacgtgtttaggaacagtgagtagttgggcatggatggcatagaggctgcactctgagagatggaacagacaagtgggaagcagtattgcaagatgctgaaaggcacagaatctagagcctggatctgaatcccagctgagccacttactagctgttgtgaccttggcaagtcacttaacctcccctctatagctttgtttcttcgttttttaaaatgaggataatagtagcatctgtttgacagggccgcatgcatatatgcatatatacacacacatggctttaaacggtgctcagaacaaaatgaatataagtattctttattagggcacattatgaaaggccttgaactgtacattttccataagtaaaagaaaggttttaaagcagaagaagggagagtatacaacaggatataatctgtattttgttttattttttaatttttttttttattagagacagggtcttgctctgttgcccaggttggtctcaaactcctgggctcgagcaatccacccgcctcagccttctaaagtgctagcattacaggcctgagccaccgcgcctgcctgtaatctgcattttagaaaagtaactctggtgccactctggagagtagattggataagaaagaaactatagacaacatacaagctctgagacagtttcaagagtacagataacaggtgctgatgtaacatggtactgagttaatatagtggccttgcccttaaaaattctgggatcctaaatagaaacttcaaacttgaaatgttagtcttaatagatcttacaaatttaattctaaaaaaaaaaatgaagaccctggggaagagcacagaaggactgtccttgcagtatggatgttgtagtgctcaactgatgcttccattctatacccaaatatcagaccagtacctcctgcctactattcatgatatattttcatctggttagatgtccagagcaagacattctatttttggagatgcttttgttttttccttcaagtaacctcaaactacttatcagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaaggatatgagtgatttagttttatttctttggggctaatttatgggaatttatgaggtgggacatgagctggtttcacaccaaacataatgaaggcattacttctacctgaaggatatttaaagtatgtcaaggcaaataataaattctagtgtcaatttcacctctcttgaaaacaggagaaagtgacagtatcattattgccaggaaattaaggcatcctcaaatcatcatagcaaaaataccaaagcacaatccctccctgttttgtgtgtgtgtgtgtgtgtgtgtgtgtgtgtgtgtgtgtgtgtaaacttgtatgttgacaaatattctctagcatcagacagtaagggtcaaacctatgtcatatttatatggctttgggaatattatttagcctctttgtggctcagctttctcatctataaaatagaaccttcctcataggattagaagaattaaatgagatgagatgatacatgaaaagtgcttaaaacactggtatacggtaatcatttaataaaatttggctaatagtaaataagattaatttctgtctctaagttggggttacagagtcacatgtaaaatgattggactaatcattttaatcattgcacatctaatcattgcactaataagcagttcaaaaaatagagggaaaagctgaaaggtctgtccctctcttttttccactcgtcccagctctcagctgttgtttctttttttttattattttttatttttagtagagatggggtttcaccatcttggccaggatggtcttgaactcctgacctcgtgatccacccgcctctgcttcccaaagtgttgggattacaggcgtgagccactgcactcggcctcagctgttgtttctttacacgcactcatgaagtaaaatccaagttcttttttttttttttttttttgcttttgtgggtccctttgggtaattttttcttcttcattttttataagtatttaagacagcctgcacttggggatggagtattttaaatgcagcattttacaagttatatagccttttaaaatatgaaaaactccctcctccaagcaggaatatctgtgcttctcttcctatcagcaagataacgctgtggaataaaaaaagcaaaaacagagaccttccttatgtcattttcctcattattcatctgcttccattgtgcctactcaactgacaatatcaagaagtctaagaaatgagccctaccatcagggtgtttgatgtcagaagttggcatttctttattaagaatcaaagacacgtatttttgtgtaagatttacagagctgattccatttgtactggccctttatttttgtgccctttaaaaacatcactttaattaaggtcttgtatgcttttaataatcctctcccccataggtggaaatgccctggtcaaaacctctgtgttccatttactccacaaaagccaaggatatttgtttttagacaactgtgtttgaataacagtttctgtccagtaaacttgcaagcagcagttgacaagtttttatctctaatagttcccttctttctccctttagtgaagttataaaatattccgttatagaatacagctactagcagtcgcgtcttatcctcagatgttgttagagaggtacccccatcatgaggtcctcccagtgtcttatcttcaccacagacagaaactggctgagagtgatttctgtggtttatgtgcgtgtagtgtcaagctcactgaggagcgctgaggagacagcgctataaaaatgtgtataggaacacatacgttctcagatttctcactttagcattggtctttggaaaacagtcccacctacatcccaattcaggtgccatgaggttcacctggtgagacaaaccagcttcaagaataggccaggggaagtggaaaggggtgagtgacaggacaaagggagaacaggtgaacgaaagtaggggcaggatcacaggatggagcagggcagagagaaagagaggacaccagagatttatgtaacatcttaagagagcagacaggcagggaaggttctgcagcccacatgcatctgctgtggaatctgaaaattactttagacggtttttctttttcattagcccctctgcctaatgtttcacaatgctctggcacctatctgatgaggcacgaaaggaaccctggaccttgcatataggagacactcaaatacttatttatctatctatgtatctatttttgagacggagtttcactctgttgcccaggctggagtgcagtggtgcaatctcggctcactgcaacctctgcctcccaggttcgagctattctcctgcctcagcctcccaagtagctgggattacaggcgtgtgccaccacacccagctaatttttttttgtatttagtagatatggggtttcgacatgttggtcaggctggtcttgaacttctgacctcaaatgatccacccgcctcggcctcccaaagtgctgggattacaggcgtgagccaccacacgcagcccaatatttgttgactgatagaaactactgggaaaggaggaagatggggcaaatgatgaattacttttttcccataaatcagaatctatttaaatgataactctaaaccactcctgtgtgtttgtccagcaagccctcaaaaaatcgtgcaggctatttgctcaccagtacatttggacattttgcatcctcacatatgaagacaccctggatttgctcattattttttcatcgctctttaaacagggggttagaaaatagagacggtggaaaggggacaagatggtttggggaacgtggtgtgtgcacactcatgcccatgggagggggttacaaaatctgaagaggagactgcagtcaggaagcctggattctaatccatttagccagtaacttgatgtataaacttgggcaagtcagtttatctggcatgccctgtttcctcattttccaaatggaaatattaatactctatataccttacaaggtggcattaaaagtgtaaagaaatgacatataagagcattttgaaaggataaagttctgtgtcagtctaaaatcgtggaattaattggtatggtgaatggaaagaagttgagaggaatatcattggattaggaggaaaggtggaactggaaaagagagggagcccctccttcatttgacagacaccagaaaaagtcaaaagagcctccactattcaaaccacaaatctagccaacacttttatcttgagacatctctggaaaaatgatttttccttttccctgctcctcagtgccagggatttttattcattttgtggttactgcatgcttgccatatgccaggcaatgtgtttattagcttattatgatttcaaaattagccctggaagacaacacatatcttcaaaggactctcagaggtcatctcatatcttcccctagctttccttgttgataaaaatggcagttcatccctcaccacttaatacgtggagggacgcgggcctaaagaaattcagtgacttgaccaaagcccagagtggtgatgaaaccagtacccaagcgcggggtttctcactccccttttccatcacacgtatatatattaaaaagacatgaagttactaagatgtgtcctggaggctctgaggcagatctgctgtaggagggatcagcagaggcttctctagtcagggcattctctgggcgttcagcccttccctccactgggctccagcgctgtagagagggtggggtttttacctatcagtatagcgggaaaagatacccaggtggcaggaagtttaagcctcacctggaacttatattgaaagccacttggtagaaaggataatggtttggagacagagttctattcctgccagcattgacactgtgtctgaaaagccagcatcgacactgtgtctgcaaatccctcagctattctgagtctccgttttctccctgtgagatggagatcataaaatccgcctcatccttaggattattctcctgaagctacaataaggcctgaggcattgtacgctggaagaaacgtgtattaatagcaacttctgtcccaccccatcccccaacacgtcgatcccctccggagcataaaactttcccccagcatctgacctgcccaggccaccctagcacctaggagcgtgaattcctgatgcgggttgtgggtggcgcgccctcccggttcccgctctcgtttttgtttttggtcgggtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccgtgagtcagaaacaaaggcgggggggcggggggagcgcccgagctgcggctccgcgattcgccctttattctgaactcgcaacgtcagcggcccgcggatggagctgcggggtgcggactgggccgcccacagcgcaccgggccgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcgggtgagtgcgcttgcctgccctgcggccgccgccgcctccgcgctctgacgacccccgctccgtcggcgccgcggcggcctgggagacccacggcccggccgcgcccccgccccggcggcccggtcccctcggcctcggccccgccaggcgcccgcgggggcttttgtttgtttactcgcctcggggggcttcaacttggctgagtttccccacgacccgcacctcccccgcccccgggcgccgggcgagcgtttgcctcgcgctccgccgtggcgaggagacaatgggagagaaaaccagagaaacgccgttagtccccgcgcggcgaggacggggcggcgggggcgcagggcctggagggaacctgggagcctctccgcgcccggccggcgcccctgccacttgcagccccggttgtttattcgggagcgggggaggggagcggggggagttcctcggagtgaaaacctttccgaagtgggagcgaacctggggcggccccccgccccccggccgcagccttcggaggagactgggccgccgaggcggtcgtgagagacggacggagaggaagcgccggctggaatctcctaaccgcccgcttctcatcttgtcctggggcagggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtgggtgcctcttgcctctaactctccgttttctcatagcccccactttgtcactccccaagggctcgcctagcttactccacccccgttttgttccaaaggcaagttcagtggtctcctctctacccccatctcatctgcagagaaaggccaccctttaatgagaagaccagagtgagaattagaagttgagttggccgcttactcagtgtttttttgtttgcaaatacctttctaacaacgataagcccctcccaagatgccccagaagttctaagtgtcccttgctgcctcccaccctaacctggcctcctgcatataggatttcttttctatttctgctgaaacagtttagcctattcgccaccccttcctgtccccccaccttaacccagccagcctcccctttcctgtctgtggcaggagcgtgcacaggtcctgtccgtggcgcatccgccctgaatcacagaaaacacgcaccccgccgtcaggcccctgtgacctcgggtgtgtgagtggcagttattttcgttgaagccagtgtccctaaccagtatgctctctgttccccacccccaccccatttaaaaaaggcaaggaacccattttctacccacttcctgcccacccctccatttgtatcagaagggagagaaatggagttaagaacccctgtatgtctttggatagctttggctgtgtagttaaccatgaaaaccacagtctacactgtgtcaagacctgagctatgataattgaatccagacccatctcccttttttccctaagtcttgggatcaataacgtgtactaatgtggagaaatcagaattgcccctacagtggttagaagtcattccattccctgcctctgtgactgtccaaaggcagtcagtatagcctggaagactgtcctgtgtaccggttagagtggcccttcctcccgccctcacgggaggtattctgtgttccctcacccagggctaactgggaagtcctccctgagttctaacctcttctgctttctgcagtagacatccttattcagtagattatatttaggtaaataaaaccttttatggtattgaaacatacacacacacaccctgagacaaagtactcatctaaaagaacatctactgaggcatctagggaagaactaagctgtgccacagccaaagagatccctcttaagggtattgaaacctagctgtttacacaaaactagcaagttggtgatggaaagtcttaggagtgaggtgagggcacttttcttggtctgtcatccaggcaggaatgcagtggctcaatcacagctcacttcagcttccacctcccaggctcaagtgatcctcccacctcatccttggagtagctgggactacaggtgggtgccaccatgtctggctagtttttgtattttttgtagagacagtgtttcgcgttgttgaccaggctgctctcaaaactcctggcctcaagtgaaccacccgcctcagcctcccaaagtgctgggattacaggtgtgagccaccgtgcctggccaggaggatttatttttaagagttacctctgcccaatcacaaatcctccagaaagttttctccacaattttctggctttctaattaaaaaaaaaaaaaaaaaaaaaaaaaaaacaagtgtcaaagtgtatctcctgtcttccccgaacttcttaattgcaggaaactctagttacgaatcagggagaacttcctacacatcaaagagaaaaacataatagtgaaagggtaagaggaataagacatccattgcttgtttgtatttgcccaaagagcagagtctgggggcaaaagcgtagttgatccttgcttttaggtacagagacagaggaaaggatggaatgacctcagcctaggatatctggtgtcctatgagtcaggaccatctgactggtcatggagccagctgtctcctgctgggaagggcacaggaaagagggactaggcatattgatactatgcttttttagagccagtttcaatgctacagtgggcctggttaaaaagtgaaattgacagagtactctgggctttattttgcccacttgtgaaaagctccagggccaatagaatcaagacacggtgttctgttttgttttgttttttagagacagggtctcactctgtcgcccacgctggagtgcagtgtcacaatcgtagctcactgctgccttgacctcccgggcttaagcaatcctcccacctcagcctccggagtagctgggactacaggcatgcaccaccacacccagctaattttttttattttttgtagacatggggtctcactatgtttcccaggctggtctcaaattcctggcttcaagtgatcctcctgcctcaacctcctgaaattctgggattataggcgtgagccacagtccctgaccaagattttttttttttaaggcagagtataatctatatcatttactgttaatgcaagaaaatttctaaccctatctcccagaattttcaccagtctcttttgttatttcctctcttaaaggcagggtctcccacaaccacctctgccgtagaatttcttctgtgttcgatagtaatcattttcttccttctcaaagggcatcctctctcaaagagggctggagcaccttatgatcacaggctgatgtgtaagaacagaagctagaccttaggaagacctcatggtggaggaaattggattcagggcaactctttggacaggcgtgggaaaaatccctttctatagtcaaggacgaagaatcaggggaaaggaagggttaatttggaagatgggtagttataaatgagactctgggaattagatatgtggggaaaaaaaaaaacaatatggtggagaacaaggctgcttggctttgtccatcttcccaggcactggaatatacttgtcctactgcttgcctcaccccatctcccaccctctccaccaagggctaacctctatcagtgtctcctgctccccagagctcctaatcagtctgtatgcaaggtagaataactccctttccttcccttcccctaaggaaaacatagtaagttaactctcttcccctggctacattcacacacccaacactttcctctccacggtttctgggctctgctgatagtctcagctctggagaaggagggggagaggagggatgatgcatcatcttgtatccctgtcccgtgtttctgggaattgctcttggacaccccttgccagcaccttgtcctacttccacccgtaatcattcaaggcctctggccactttccagcccaaagccagggaaccctggaaagtgggaggccctggaggagccaagccttgctgaaacaaatggaggtagatgtatgaggcgtcactcacctgaatggggccatgttgacatctgtcctcatctgtcatcagcctccaggtccagcagcagttcagaaggatgggcagatacaagactgtagatggtctgggtaatggaagggagaaccacttccccacttccaggtttccaggaaccaggaggatagatgagttcacctccatgcacacgagtcctatttcagaacttgggaagttggggactgttttggaaaataatttcagtcagggtgggtagatgtcatccaaggaagacgtgaggctacttttatctgtttgtttagttttaatgagacaagtgctggtgcttttaattctcattccaggaaaacgtgaccaggtttttcctgaggtgttccaaccctgggctcaagccacggagggtggacagactgcacggtctggacttgtaactaagtctcctctctgtaactttggtccttgcaagccaaaacaaatccataagccactgcttcagagtcccagagttgtaggaacaccaccttaggggaaaagagaaaacattgtggtcagtttcagatgaacctgcgaagaaatgttcctagagctgctttgcagtgctcagaaaaggctagttggggttggagaatgtcactaggaatgcggcctcgatgagacgttcagcaggagtgctaagagctaaatgttgcttaaaacctgctaaaggtggaaccagagtgcgggacggagactatagcagggagggctaagtttagataggaggaagagcttcctggcagtaaagggggcccaggcactcaaactggaataatggcaagaagtcacagaagtcacttttttccaagtctaaagtgtagtctcccagggagagtctaagtgcattcttgcctagagatagggggtctggaggagttagtttggattgtcacagtaccttagagggaggaggaaagggtaggaactgtaattgtagttttcagcttctctggacaaattcagcaaactgaacacggggctgccgtcctgtggtggcgatgctcctgaaatgaacaaggaagatgagtctctataattgtacataccagagaaggaagcgaggtggggtgggagagctatactgcacacatgtgagtggggaggccagagaccgcccctcgttccctccagacaccccgataactggccctgccttgatcttctttctgtggaccatcaagggccatacaggtctgtcttactgagggcaatggatcaaccatctaccatgtccctttaaggacgtgagcctttttagaacatgtaagctgtgtccttaaggaaaagagtggggcggttggtgaagagaggcatagtgggactctggaagtggcagcctggctaaggagagtgaagagaaggggtttaaacagaaacacaccttaacattcaagacttggagctgccctagcgtcctcctcgatgtgaggaccttgtaggctttgggcagacggccctctcctctcctggcgtgcctccctctcctcaggcttcctctgtttcccaagatgatctaaactaacagtctgggtggaggggctaaataattttatcctcctcacctcaccccaaccctcccctaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggtatgtttctcctgccaccttggccgctggaacatggacagggttggagggggcaggggagaactccttcccctcagtttctctctcagcaatcttggttcagattccctgaattgctctcctgctggcttttatcatttcacctgagaatattgtagccatttccttctttccaggcaggccaccctttaacctgttcagccacaaagatcatctctctatatatctctttatttttctctgtcttatacacacacatccacacatgtgcatatttacatcccttagaagaaaatccctgtccttgtaccctgataggtggttgaagttctgaatctaattcatcttgtctgagggaacccagggaagttattcctgtcacattctatttcttcaaacattgaaagatttgtattttaatacctatccttcatcagacttcctctaattatctctaataccatactaatattcagtatccttcttagctcctccttggtcatttctaaaacaacctcctagctatgcattttgcaggaatagaagctgggtttccttaagttatggatgactctggaagcagaatatctctccttcctggagctaggtctaagaaagtgagattataatctcttatttcttcattgtcaaggtgaggcaccacctctaaaaccctggctgaaacaggaatcttcccctcacaggcacccaacctgatcttcctggcagtgagtccagaagagaaggaatcgtggatcaatgccctcaactctgccatcacccgagccaagaaccgtatcttggatgaggtcagggggctcactgtggggagagggaggaacgctggggcagagggaacagctgtggcccactgaagggggaggattgtgcaggccccgtttactcgctcctccaccagctctacttctttaccgcccttttaaaagccctgatctctttctaccttctctccaagtctcatctgacacctcctcttccccgcttcatgatgggggagccagccttgggtcagcttaaagagcccccttcgtgtccagtaaatccccttgcccattcagaagcagtgaatggagtgggcacatgttcaggcctcgggatgctgggttgggacagcgagtcgctgaagagcactcatgattcacagtacatctcttcaggtcaccgttgaggaggacagctatcttgcccatcccactcgagacagggcaaaaatccagcactcccgccgccccccaacaaggggacacctaatggctgtggtatgtaagactgtaataaacattgccaaagggccaattctgtgtcagtccatctcagacagaactgtatgccaccagaggcatttgcgggaggcctccttgatgccaagatcaaaggcgagggaagtccttccacccaatgcctctgccagatctaaatcaaaaggttttattcagcgcccattaggagttcaaaagtcccagctcccagtaatgttaccctctttcggagaaaatgagttatacccacaggaaaatgaaaaattagctactgtatggtggctgtcttgatgggtaacaacatgtagtaccgcgggtgtttggaggagaaaggatcacaatgaactcctgaaacatacaacgtgctagtttctttcatgcctctgagctcttaagtcttcagagagagaggcaggcaggtataatgcagagaacacaggctttggagttagaacctgagttggaacctcactgtaatcagctacctgtgtggttccctgaagttgcatgtctccaactgtaaaatgaggcagtaatcatgcctgccttgaagggctgctgtgaggaatgactaaaacaacatatttggtattgaatactcatcatttttagtattctggaaataagagaacaaattttattataaggcaagggggctgaagtgtgggactcagaggatgcagatggaggaggacagtcgtgccatggggagcatcctgtgtgcatcagatgcagtttaattgctgagagtccacaataccaaggaagagggcgcccctcaggaagcttatggtagagtggagaatacaggaaacaagtaacaaactaaatcacagaagaagaaacattcaagtcactatcaaaggaataagaaacagcacattcagtaggagggttcagtcaagagcagagggctttgccaggcaggggggctcacacctgtaatcccagtactttgggaggctgagacggtgtatcacttgaggtcaggagtttgagaccagccatggccaacatggtgaaaccctgcctctgctaaaaatacaaaaaaaaaagagctgggcgtggtggtgcacgcatgtaatcccagctactcgggaggctgaggcaggagaatggcgtgaacccgggaggcggagcttgcagtgagctcagatcgtgccactgcactccagcctgggtgacagagcaagactctgtctctaaaaaaaagtacttctcattcaaggaaggcttgtagaggaaaatgaccacagcttgcatcttttaggcagtcattccgaaaatccctcctgatgacaggttccccactcattccccccttcctccacaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccagacactggcttctcattcctagcagtctctcattgagatcgagctgcctggattttcttacatgaggtgtttcttcccttcatcttccacacccttcccaaccttgactcaaagatccacccttgtcgggcgcagtggctcacgcctgtaatcccagcactttgggaggccaaggcgggtggatcacctgaggtcagaagtttgagaccagcctgaccgacatgatgaaacccagtctctaccgaaaatacaaaaaattagccaggcatggtggtgggcgcctgtaatcccagctatgcgggaggctgaggcaggagaatcacttgaacctgggaggcagaggttgcagcaagccaagattgtgccattgcactccagcctgggcaacaagagcgaaactccgtctcaaaaaaaaaaaaaaaaaaatccaaccttgagtggatgagactagtttcattatttgattcagggccctagcacaggggaactagagacagaccccacagaagaactgaactaagaatgaaactggtgtgtgatgcaagctgggtaggatgaaggggaaaaccaaacatctgtccaagttcctctttcagccatgctgaggtttcctgtagcctccccctctccttcctcaaacctcttccatcactaagcaagtccccactttagaaaagcatctggatgcccacgccaccaccctcccagccacctctgaagttgccaggcttcccaacattcttgtctgtggtaggtcccacacaactcactgttcactctttccttggaagtgtgtgagatgaggtttagtaacggtgaggtccccagaagagctatgaagggaataatttgattttgggaaagaaggggacagagtctcatgaatcaagtaaatgaggggttaaaagccacattgaagtgtgccttgctagctgcttgatcctccaagagcagcggggcttcactagaggtaaggggaggagggggaggaaacggggccaagttacatgtagacctggccatgacgctgccccgatgttataggaagatgggataggaggaagcgggggaaaaacctgtgggagaaacagattcttcagtccgcattcttctgctctaacgtcactcctacaacccatgtaagcaaaatgggggcctctgtcccctttccagaaatcatctctttccttcacagctcttctctggaccttatcactgctgttaaaccatccctagggcagaggaattcttgctctctctagtcccttgccactctgtcatggagattgtccccagctctagactgtagttacctagcctcttccttgaagaatgtgtatcccagttgagtgagggaaagtgtgcaagagtgccaccttcatgtcattctatggtctcttggggtatgaggtgagaacccaggcttccagacttcctgtccttcaaatagctgcactctccacagccctaagcatggtcagcagagccatccattgtcacaagtattgaagtctaaggtagaattatgctttctttttacaagtctctatctttgtattttaccagcatttttccttttctttttttcttccttgttgctcccacataatgaaaaaagacaaaagcacaaatgacatgtgtatcccaacatgtcaattatctgtggctcccaggggagccagaagatggagggagacactagagaggagaatgacaggtgaaagaagcagaaaagaaagatcggggacctcacaacagtaagagaggagctgggcactgtgctcctgggcttcaggctctaaaaccaacagcttccagttctccagcagttactggaacatccaggccctagggtggtgaaatgagcccagctttgaaaccagatggatctggattcaaattctaactctgttacttcttgattatgaggctctgggcaaggcacatgctttccgagtatcagtttttttcatctgcaagctgcagagctattggatgggtgaggacaatatggaaaatgcctgtcagtcagaaagtgaccactgcagctactgttactggtttgactctgggcagtgagccgctagctcagttggaaggagcactgtgtgaatgaggccaccggggtggggtcactgtcacttagctagatccaggccacaggctgtgctggacctctctcttcagaggagagagccagaagggatgaaagcatggtccctggtcttcaagaactttagagcttagcatggaaccaggcttcccactagaaaaatcgcttaaggtgcacccttgtggtaggctgctggcatgagttctgttgaagcatttgtattgaacctgggcactgtgacaggaggatgggaaggtgcttacgttcatttcccttcctcccagtgcctctcctccctcacttcatcattttagcccctctgcctgcaatatttcccttccgtgcccccggtaactgtgatgcatggcaaatgggctggctcagtagctgtgtggggcaactttctcagcacacagctgcccccagacactttcagggtgcacttattctccctccctttccactcccaaccgctctgctcccttcttttcttacacagatgaagcaaagggaagtgccctccggaggccctaggatggggagacggggtaaggggtggaacccaggacacagagttgagagggggtgaggggtagaggcaggtaaagaacgaaatcttaattctcatttcagtgacactttcctcaacttttcctgtccttccccatcaggttgttagccaggggcctgaggagggataaaggaactgcagtcccggctccctccattaggaagaatgtctggggtgttggcctggaacgctgatgagttgatttccttctatctccacagcataggtttaccagggagaaaagaaaggtgcaaatttctctaactcctgccctggtcctcacatactatgcggttctgagcctagagctctgtccctggggaaacagctctcgcctccttccccagccgctctcccaacccctctgccagtaataaatttgcctcattctcccaggaaatgagtctctaagaatctctcttctatctaaacctcacaggcaagcagtcccagcccacttctgcaaccctcaagctcagctactgcccccaccccccacttcgtcactcccttctctacgctgggttcctttctctttctgctttcttactacctccctgtctcccaacaggagcagccaatccccagcctgctctagagccacgccatatatggagaggttggaaagaaacccgagtaaatgcaggagcgaacacacacacactcatactcatgcacatactcatgcacacacagcagagtttgaccgcctttctgcatgtgaccctgtgtctatttgtctctgtgtgacacaagtcccacccacagaatgaggaggctgtttgctattccccacctttagtcgtgccccaggagaccatcactccaacccgttgcctctgacctagattccttgcactaattacaagcctaacaagagctaacaaacaccccacttagaacagctgagaccctcgaggtcaattagtgcagcccagctctgctcaggaaatgagagatagagccagaaagtcttgtacatggcccaccccaacctcaccccaaccctggggttggaagcaaggatggggagaatgcaaaaattagcaggaccagtttaaaaacggggttttggagggttaaaaagtgtggagaacacacttgttaagtgcattaaggttggggagcaattggagaatacagattcccaactcctcctgaactatcagaagtgtagaggctggtgcagctacagaaaccatggacataaggcggctttcataaggacttaatatgaggaaaagtaactcatagaaaggcaagtagcactagaactcttgacctttgtcatggtctccgacaccaaatcccttctcctctttgcttcctgctgtgaacaagttggggttatcacccctgtccttcctgctggtttgggatggctcagaaatcacccctttctttcagaaatagtaggctcatgtccgttctttctttcccttcctccagatattaaagccatgacagcaaacagcccctttctcctaaggttcctgatttgaagtggcaaaacaaggcagtggcatagtctcctgtcctatgtccttggcatgcaggtcagttgtcctaataccatccctaatgtttttggctctatcaagtgggggaggcagggaagagaacactagtggaatactctgtgcacaaatagggaagtggactcaaaaacacaatgttcctcttgccccagcctccacccagctctggctgcagagggccgcactccgcttgtaccgcaattcatgcacagtccagacttatacagcagccggcaaccctaagggcaggatgattccgagacacaccaaatctgtatgttgatgtgttgtcccaaatttatttctccagcctaaatttccctctctggcacttagagctaagtgtcaacttgacatctttacctgggtatctaacatgcatcttaaatgtactataaatgtaataaatgactaaataatgatcctcagtgaaccagccccactccaggctcctttgcaatatgagtttgctgttcctcccttttgagaggtattgctttctctccaactgctgcttgaatctgggtttgccagtgacttgttttgcccaatagaacaaagaacatgtgctgtgtacgttccagcgcctaggccttaaagggccttgtagtttccactcctttactctcttaaaattcaggtgcttctaagaagcctgggcgagcatccttgctatgagaccatgaaaccacatggctctgtcccagcatccaagcctccagtcagacacagctggagcagcacacaagcaagaccagagaccagccgctcggccagcccccagaagtgtgagaaactaacaaaccattgctgtcttaagtcactaggttttggggtggtttgttactcagcaatagatactaaaacaaagattgtttcttggaagtgggatgctgccctaactaaaacctgaaacaagtggcattgatcttgggacccagcagcagacagcctagaagggcagcaaggagacttacagagtctggatgagcagggagaaaactgctctcagagacgggagaaagaccacccgtgttatatggcggtggaatcattcacaaaactgtcacctgtggtatcttgggagctagaaaatatacctaataaatttgttggaggtagctaaagagacttccaggcagaatgttaaaagtagcaacaggcttttcttagctgtgattggtaaggtattgcaggaaagaggaactaaaaaagaaacttttcagtttgcaagcagaatttgacagaaaaataagagaccagaacagtctccagcaagaaaaactttcaccgttggtaatttaggagaatgtgctgatggcagggaccacctggtcagtgaaacaattcaggcttttgaaaagtacagagataaattgtaccccataaggatgggcaataacagtgtgtccatttttaacattaaaattaaaacacaccaaaaatgcacaggagaacaaagcacacaatgacaaaggaattggctgttactcagctgcactggtatcgtacagaaagataaggaaaggcacttagcaaacaactgaaactaagtgtgagggccaggggcttctttggtagcaaagagatcgcctgcaacagaagagccataaaagatagacagaactcagaaattgatagcaaccaggagcttcaaaaactaacaccccactgaggctgaggcaggtggctagaaccctcagccaaggtagatctgccccatcaagatcaaggccgtggctgagaatacctgggctgggattccaacacgcagaatggggacatctggtaccttggatggtggagatccctgaagattttggttcccagattcctctgaccccacataccctgctaagaggacccacccctctctattaagagctagcaccacctgctgcccaggaaaggcaatgcagagatctctccctgaaacataacaggagtgccccgccagatcagccccatctcctcttctggctaccagaataactggacataagtcaccacgtaattcagagccaagaatgtgctgggccttacaaggaagaaaggaactaaaccaagcatgtacccacaggagcgggggaggttcccatggacctagaattttttttttgttttttgtttgtttgtttgttttttgatatggagtcttgctctgtcccccaggctggagcacgtggcacgatctcggctcactgcaacctccgcctcccgggttcaagcgattctcctgccccagcctccctagtagctgggattacaggcacctgccaccacgcccggctaatttttgtaattttagtagagacggggtttcaccatgttggccagactggtctcgaactcctgacctcgagtgatccacccgcctccgcctcccaaagtgttaggattccagacgtgagccactgtgcccagccggacctagagttttgagaatatcagaatagaaacctggataagaaagtttattaatttaggggcactttcttgggatacaggatttacactccagcaaggaccccacgaaatagttcagatatatgaatattattgtgctcctacaagccttgaaaaagtaatgacccacgcagcccagttgaaatgcttgaatttcaatgcttcctccacatcagcagtggaggaagaaatttaaaagtttaggaaagtagacatgttggaatgtattatttgaggtctaaagactcaccgtgggattatgttccatggaagacacacatcctttaccacagcattggtgaggggggcaccagcatcaataaacaaaatgggagctagacagacagtgggccagggatgaaggtaggagaggtcataacaaagctgggattattgatagcaatggaaataaccgaccccctccccaatgccaagcaataaaggccaggtggcaacaatagaagccaggaggtcacagttctctcaatgaccagcaaagtcaaagagccagtcaagaccaggtatggttcatgcctgtaatcctggtgcaaggtgggaggatcacctgaggccagggatttgtgaccaacctgggcaacatagtaagacctgtctctacaaaaaaaaaattaaaaattagccaggcacggccaggcgcggtggctcacgcctataaatcccagcactttgggaggccgaggcgggcggatcacgaggtcaggagatcgagaccatcctggctaacatggtgaaaccccgtctctactaaaaatacaaaaaataattagctgggcgtggtggtgggcgcctgtagccccagctactcgggaggctgaggcaggagaatggtgtgacccgggaggcagagcttgcagtgagctgagatcgcgccactgcactccagcttgggcgacagagcaaaactccatctcaaaaaaaaaaaaaaattagccaggcatagttgcatgtgcctgtagctccagctacttgggaggctgaggtgggaggatcccttgagcccaggggttggaggctgcagtgagcctcctaggctggtgccattgcactccatccttgtgacagagtgagaccttgtctcaatcaatcaatcaataaaaaagccagtcaaggggaaattaagttgattaatagaacatgatatccctagggataaaattaacagccaacaagggcaaatcaaacaaatgcaagaataggctgagcacagttgcccccataaaaagtcttgaagtagagaaattggaagccttgtgcagtgttggtgggaatgtaaaatggtgcagctgctgtggaaaacagtctgagtgttcccaaaaaattaaaaatggaattaccgtatgatccagcaatcccacttcaaaagtattgaaagcagtgtcttgagatatttgcacacccatattcacagcagcgttattcacaacagccaaaaggaagcaactcaagtgtccattgatggatgaaaggataaataaaatgggaaatgtacattattcagccttaaaaaggaagaaagtcctgtcacatactacaacatggatgagccttgaggatattatgcttagtgaaacaagccagtcacaaaaagacaaaaatactgtatgattttatttatatgaggtatctaaagtagtcagattcataggaacataaagtagaatggtggttgccaggagccaggggcagggagaaacttggagttgttgtttaataggtatgggggggtcagtgttgcaagatgagcagctctagagctcagctgcacaacactgtgaatatacttaaaactatgaaactgtacacttacaaattgttaagataatcagtgttgttttgtgtgtggtttttttcttttttggggacagggtctcgctctgttgcccaggctgaagtgcagtggcgctatctcggctcattgcagccttgacctcctaggttcaagcgatcctcccacttcagcctcccaagtagctgggactacaaacgcacaccaccacacccagctgaaaatgttatgtttttatcactatttaaaataaaatatatgttttaagaatactaaaaaaaaaagtcatgattccttctcatttcctagacctgagacatttttcagacctgaaatctattgaatgggaaaatgtgacagagtccccgagaggaaggtccctgcaacatcacagcaagtgtgcactgtaataattccaccagtcctgggtgactgtcacctgggagaggaggaatatccactagacacagggcctgaaatgacactgatattcaaagacctgaaatgtcattatggcccctgttacaatgatgggctataggtcaggtaaaatggggattctggctgatgtccagcttcaagtgggtccaccggggccgtggctccacctggtggtcattgccccagtccctgagtgtataactgggattggtatattcagcagttggggaagccccgatgtggggcccctgctttatgatataagagctatcatgtggggaaggtcagtggaagcctctgaaattgtgtccgtcccccttcacccagccaagatagcaaatacaaaataatatctcattccagagggaagatagagatcattgccacccttaagtacctcaaggatgcaaggattgtggtctgtgtcatacctctgtttaattcaccagcctggcccctgcagaaaacacatggatcctgggaaataaccatagacgattcctagctcagctcaagccccgagtgatcatgcagggtgtggtgtcattgctagattatataaatatggcttcaagtacatgacatttggccattgatttggcaaatgcattcttctttatctcgatcaagaaagagaatcagaaacagcattcacatggactggatgacaatattcatttagattcccccggcccccagggttgttgttaactctcccaatctatgtcatgatacattcagaaaagatctagatcatctggacttcccacagaatatcacaatgctccattcatcaatgacattaggctaatttgggagaatagcaagaggtggctgacacctgaaagcctcgggaagacacatgcactctagaaaatgagacataaactctctgaagattccagggcttgcccctcccataaagtcttttggaatccagtggtaaagggtgtactaggacgttgcctctgaaacaaaagacaaaatgctgcgtcttgcatgcacaaagaaggaactaaaatgcctggagggttctggcagcaagcatattccatgcctgggaatagtgctccagcctgtattctagagggtgcagctttgtgtgggcctggggcagggatatagagcctgatcaacaaaaggagctagaactgctcttggacaataaggcaggaatatgtgtgaaactcaggtcagccacttgagcacctcttgatgatacctttcatgcccaatggtgacctgaatggcaagtgcagcccagcctgtgaagggtgacgtgatcagggactcagagcctctcaggaatcagggttgtgctacgccacctggtaggctatcgagaccagcagaaatgacagtggtgtcatctgtagcagagagggagagtggaatttagaatggataatggaggagggaaatgatgttacctattgcaagaccaactgcagcaacagcctgtggttaacccactgacctcccttaactaagtcccttcaagaaaagagcccattgaaaccccggaagagctacccctcaatgtgtgtggaaagtagatccacatggtacaaaaggaagactgtggtagccatgaaggtgccccacttggatttgtcttcaagaaagaacttgctgctcagctgcaaggaggacagttagctgtcagcctccagctgttagtgctgagggatctgtctcagttttccagccaaggcacactgctctcagcaggctctggccagtgactgagcagagtggaggggttcttagggcctggacatttctgccctatgcgaacccctctaatgaaacacctttgctctggagttccccaatatgttgcccaagattctatctgcatttcagtctgaggctctccttgttgaaccctgcttcctgtcccctctcataggtactccctcttaggcctcttacactcctcattcagtatctgcttctcagaggaggcagctgacaaacctttcttcctcttgtctttcccatccccaacatctaatccatcagcaagtctttttggttctaccttaaagcatagctggaatatgaccatttctccatctctcctctgccagctccttccctacatagtctagtgatgtctctttgcctcctctcatccccattcagcagctggagtgtcttcttgtatgtgtgtgggtgtttttgtttttgtttttgtttttgtttttgtgtgtgtgtgtgtgtgtgtgtgtgtgtgtgtgtgtgtgtgtgtgtgtgacagagtttcgctcttgttgtccaggctggagggccatggtgtaatctcggctcatcacaacctccgcctcccaggttcaagtgattctcctgcctcagcctcccgagtagctgggattacaggtatatgtgccatcatgcccggctaattttgtattttttttttttttagtagagacgaggtttctccatgttggtcaggctggtcttgaactccgacttcaggtgatctgccagcctcagcctcccaaagtgctgggattacaggtgtgagccaccacgcccagcctggagtgtcttcttaaagcagttcatgtcacttgactacttaaaaccaccctaatttcatgtcactcttaaaaatccaaatattttctttggcaaataaggcccttctctgccaagcacagtggctcatgcctgtaatcccagcactttggaaggctgaggcaggcagatagcttgagcccaggaatttgagaccagcctgcacaacatggcaaaacctcatctctactaaaaatacaaataaatagccaggcgtggtgatgcatacctatagtcccagctacttgggaggctgaggtgggaggaccacttgagcctgggaggtcaaggatgcagtgaatcaagattgtcccactgcactccagtctgggcgacagagtgagagcttgtctcaaaaaagaaaaagggaaaaaaaaaaggtccttcttcttctgactcatgcatatctccaaccttatccccaggccagacacacagatctcttttctgttctgtacacacgccaagctctttcccacctcaggacctttgcccttgctattccttctgcctaaaatacccttgttctcttttttaacttctttatccaaacatcagttcttatgagccttctctggctgctctgtcttgagaggcaccccttccaacagaattgttaccttatcattctgcttccatcacaacaatgaccacagtctaattattctcctcagttgcctctttattttctctctccctgggtagaatagaagcccgcacagggtggggccctgacttatctccccacacctaaactcaatctttatttgtgtaatgaatgattgaagaaagccttacctaacacatgtacatctccaccacattatccccaccatttagttccattgtaataaaagtaataccttttgatggtcctttacagttttagatagcatgttcttgtttgccatcaatagctctctcacacacacactatttaatttttgatcttcataattaaccctgtgaagaaaataggacaagtatgacccccaaattaaggattagaaaaattgaagccggccaggcatggtggctcacgcctgtaatcccagcactttggaaggccgaggcgggtggatcacttgaggtcaggagtttgagaccagcctggccaacatggtgaaactccatctctactaaaaatacaaaaaaaattagccgggcgtggtggcgggcacctataaccccagctactcgggaggctcaggcaggagaatcaggtgaacctgggaggcggaggttgcagtgagctgagatcgtgccattgcactccagcctgggtgacagagcaagaatctgtcttaaaaaaaaaaaaaaaaaaaaaatgaaatcgagagaagtaaccaaggtagaaagtgtcaaaaagtgtcaaaatcaaaatctaaaagcaggctttgggaaatgcagtgatgtctgaccccaactgcctggattcaggccagacttcacagggtaaggaacagtcctccacttcaggccactctcacttcagacaccagtagccagttcaggggttggttccactacccctgcaggtttgataatttgctacaatgactcacagaactcaggaaagcactatacttatgataagttaaacttttattgcagcaaaagggtacaaatcagaaccagccaagagaagagatacagagggcaaagtctgggaagagctacacgggaagctttgggcaccttctcctgtggagttccagacatcactgcccctccctgctacgaggtgtggcagtgcttgcgagtgctgccaccaggaaagcttgcccgagtctttggtgtccagagcccttgctggagcttgaccacatgctgcctgcatgactgacctttgctctccagtccctatgggggctggaactgatatggcgtgtttcggagcccccattataaatcacatcatttgagcatctggtggccaaactcctcaggcaaacaatgacattcctattgggcaggacattccagaggcctagagatcatctcccagtagccgagggccaaagccagacctctctttgggtaaaatcaattcttcactacacaggggagttttaccttttgttttttttaattcgagatcgagtgctataacacactgttctgtttaatctttgctctcttctttgacctgtttcttctctttccaagttggcttcaggtcacatgttgctctggagaaccgagaagggtgagcagacaccaatcatgaccccaaacagcaagaggacagaaggtaagtgaagtctttatgatcaagcaagaaatattctgtttacaatggaaattattataaattatctttttttacatgacattgaaatgagttctagtaaatgtatctgttagtaaggaaaagaccaaagcaatgccgggcagtgatgtcaaagtaacataatactgtaatctacttgacattctctgataatataccacaacactgcagcctataatttcctacagattaatatgccaagaaggtgccagttacttattgaaatgtaaaattcagatgatttcactggtgtgtggtgggagcttatgcacatgggtatataaacgtgtggctgctttctctcttatttcacaaaagtccattgcgggttttttgttcgtttgtttgagatggagtctcgctctgttgcccaggctggagtgcagtggcatgatctctgctcactgcaccctccgcctcctgggttcaagcgattttcctgcctcagcctcctaagtagctgggattacaggcatgcgccatcacacctggctaatttttttgtatttttagtagagattgggtttcaccatgttggccaggctgttctcgaactcctaacctcatgatctgcttacctaagcctcccaaagtgctgggattataggcttgatccaccacgcccagccttcattgtgattattaattttggagtacaagctgtcatcacactgtcatcaaaaacatttattaagtctccaaattgcaaagtatgttttgtttttgtaactgtttatttacctttctcccaactagatggtgagcagtttacacaggtgctcaacaaatgtattttaatgaatgtctacaagaggttaactaatttgaatttttaaaaaaaaattacccgaggtgggcggatcacgaggtcaggagatcgagaccatcctggctaacacggtgaaaccctgtctctactaaaaatacaaaaaattagccgggagaggtggcgggcacctgtagtcccagctactcgggaggctgaggcaggagaatggcgtaaaccccgggggacagagcctgcagtgagccgagatcgtggcactgcactccagcctgggcgacagcgagactccgtctcaaaaaaaaaaaaaaattacacagcacaatagaagcataataaaagtataacaacaataatgaacctataagaaggcattgaagttgctgcccagaaagtcagtttcccgttccagctctgctccttggttgtttgacattgggcaggtctcaattctcacatctatttcctcatctgaaaaacagaataactcatgtttgctctacttacccaggaggctactgtaagaatcaaatgaatccatcaattttaaggtgttttacaaacgatgaagtattttgctgatgttattatttctttttgttgttgctgttttgagacggagtctcactctgtcacccaggctggagtgccgtggtgccatctcagctcactgcaacctctgcctcccaggctgaaatgattatcctgcctcagcctcccaagtagctggaactacaggcacccaccaccatacccagctaatttgtgtgtttttagtagagacagggtttcgccatgttgtccagactggcctcgaactcctggcctcaggtgatccacctacctcggcctcccaaagtgctgagattacaggtgtgacccaccgcgcccggcctgctgatgttattatttcaacagaaaaattattttagaagtggcatgcattttactaggatgcaaaacatgattggggaaacagactcaagaattctaaacctaggcagattgaggtcagggaaggtacctctcatctctttagtcttgaagtagtctagaagtaatctactcctggtctctgctgtttattatttgtcttctttgagcttcagtttctttttttttcttttttttttttttttgagacaagagtcttactccgttgcccaggccagagtgcaatggcacgatctcggctcactgcaacctccacctcctaggttgaagcgatttttctgcctcagcctcctgagtagctgggattacaggcacctgccaccatgcccggctaatttttgtatttttactagagacggggtttcaccgtgttggccaggctgctctcgaacttctgacctcaggtgatccacccatctcagcctcccaaagtgctgggattacagacatgagacatggcacctggatctttttttttttttttgagacaaggtctcactctcgcccaggctggagtgcagtggtgcgatctcagctcactgcagtctccgcctcctgggctcaaggaattctcatgcctcagcctcatgagtagctgggattacatgcgtgtgccaccacacctgactaactttcatatttttggtagagacggggtttcaccatgttggccaggatggtcttgaactcctgacctcaagtgatcctcccaccttggcctcccaaaatgctgggattacaggtgtgagccactgtgcccggccctcagtttctttatatcattctctctgagcctcgtttatgttatatgtaacatggtgataaaatgtgccttgccccagaaggtttgctagggggttcaaattagatgattgttgctaaggtctctgtgacagctataaagtactatacaaatgtaaaaaaatcttgtatgaattacctgaaggtgatgagctttcagagacagtttcagtaaagcacacaggctgagagtatgggaggctaacattggcagtcacatcccaggaaagaatagaacattttggtatctattatcttgggttggattacacattgccttaggaactccattgtgacaaggccttgcaaaaaagtaaaatgaaacataggccctttcacatacattggctcaataaatcttcccaacactgtgccaagtgggaattatgatgcccatttgactgatggggaactgaagcttggagatgttgaaacatacccaagattatgcaactggcagatggctgcatcaaaacaaatttctccaactccagcagaaaagttaagagcatgcttacatgaaaaggaagagctggccgggcgcgtggctcacacctgtaatcccaacactttgggaggctgaggcaggtggatcacctgaagtcaggagcttgagaccagcctgaccaacatggagaaaccccatctctactaaaaatacaaaaaaaagaaaaaaattatctgggcgtggtgttgcatgcctgtaactcgggaggctgaggcaggagaatcatttgaacccaggaggcagtggttgctgtgagccgagatcagaccgttgcactccagcctgggcaacaagaatgaaactccgtctcaaaaaaaaaaaaaaaaaaaaaaaaaaaaagaaaaggaagagctagtcgggggtggccttaaacaaatggcccatttctcattcctccctgacacaactttctacccaagccagcaaacattttctttcacaaatacttcttttctctttttttttttttttttttttgagacggagtctcactctgtcacccaggctggagtgtagtggcacaatctcagttcactgtaacctccacctccctggttccagcaattctcctgcctcagcctcccaagtagctgggtttataggtgcatgccaccgtgcccggctaatttttgtatttttagtagagacagcgtttcaccaagttggccaggctggtctcaaactcctgaccttgtgatccacctgcctcggcctcccaacattctgggattacaggcataagccaccgcgcccggccagtacttcatatttcttactatggctggggttcccagagaaacaactatgacaacaggtggatttaggatacaacagggtgacgtctgtgcacgggcaggaaggcatttttactggagcggagtatgatcaatgttcacagctgtggcagcctgctcccctgaaagatctttaattggagaagaagtggctatagccagcttcactctgaccctgttagaaatgcccagttcttaagtcacatcccaattctacacatagactcaagggtttgcagaaacacccactactctcccacctccctcctcataaatatgttcatcctatggcctaggcgagtcaagagtagtccgtcagacacaaagacactagtggtccctatttatgtataaatctttttcaccacctagaattcttccttcattattttgtgtctcttcccttatttaaaagctaattttaaaaaatctaactcaaatatcaaaaattagaaacagccccaatgtacatcaatttggagaccaatttggctggactcacacctgtaatcctagcactttgggaggctgagacaggtggatcgcttgagcccaggagtttgaaaccagcctgagcaacagggtgaaactccgactctaaaaagaaatacaaagattagctgggtgtgttggcacacacctgtagtctcagctaatcaggaggctgaagtgggaggatactttgacctcaggaggcagaggttgcagtgagccgagatcacgccactgcactccagcctgagaaatacagcgagaccctgtctcaaaaaaaaaaaaaaaaaggagactagtttaaataaataatgagagcacacattcaaacaatggactattaaaagaacaaagtagacaggacatggtggctcacacctgtaatcccagtgctctgggaggccaatgcaggaggatcacttgaggccagggtttgagaccagcctgggcaacatagggagagcccatctctataaaaaatttaaaaattagatgggcatggtggcacactcctgtagttatagctacttggaggcaggagcaggaggaagtctggggttacagtgagctatgattgcaccactgcaatccagcctgagcaatagaccaaggccctgtctctttagaaacaaaccaaaaatagatatagcaagactgccaaaatataatgttaagtgaattagtaaagggaagagcaaggtgtatagtatgttccaatttttataaaaaataaatattaaacataggcttacagtggcacaaaaagctctagaatacacaagaactgttaagaatggctgactctggttaaggagacacttttcattgtattcctttagtgctgtttgaattttaccatggcatatattactaattcaattcaaacaaaacaaaaacaactttaactaaacatgtttttctaccaaaagctttacttgtccaccctacttcctaagtatctcccaaatctgattaccacccccttcccactgcctctgccccagcccaactacaggagtggactgtgctttgctcctgaattccataatctcaaggggcatgtttcctttaaaacataattgtttaaaaaaaaaaaacacctggttatccagaccatttggttaaattgaaaactatcaaaaggcatattaccagtcacacctggctgtatcctgcattacagagctgtttgaaggtcaattttgagttgtttgccctgagtgccaacattgctactcatggttttgcctctacagtttcaggccatcaacccctctctctccaacgactgcaacagtcttctaattagtgtcactaactctactgtttcttatgcccacactgcaattagagtgatctaaaattttaaatctggcttggcgcagtggctcacgcctgtaatcccaacactttaggaagccgaggcgggcatatcacctgaggtcaggagtttgagaccagcctggccaacatgatgaaaccctgtctctattaaaaatacggaaaaaaaaagaaaaagaaaaaattagccaggcatggtggtaggcacctgtaatcccagctactcgggaggctgaagcaggagaattgcttgaacctgggaggcagaggttgcagtgaacccagatcatgccatagcactccagcctgggcaacaagagcaagactccatatcaaaaaaaaaaaaaattaaaattttaaatctgatatttatagtccccactgcccttgagttagagtccaccttctttaacacggtttacagggcctctgtgatcctagtcgcttctttctttggccttgtccttcctctccattccccttatagacacctcagggctgccccatgctctaaactccagccacactgcacattggtgaactttatgcgctgaatcagcattgctgtctctggtctctaacactcatacctgctgtttgctctttagggatcccccctactccacagcttgacggcagagcagtgaccagaatatatgctcaggaaggccaaagagatgaagccgcagctgcctcttttttttttttttgagacagtctcattctgttgcccgggctggagtgcagtggtgcgatctcggctcactgtaacctccacctcccaggttcaagcaattcttgtacctcagcctcccaggtagctggaactatacaggtgtaccatcacacccggctaattattttttgtctttttttgtagagatggggtttcgccatgttggtcaggctggtctcgaactcctggcctcaggtgatccacgcacctccgcctcccaaagtcctgggattagaggcgtgagccaccgtgcccagccaggcttgcttctctgagccatacccttctgttggaacaagcatcctttctattaaaagcaataaatctcctcttatttaagtggcagatggtttagattgttacttttgctttcagcaatcctctagaaaaagaaggaactttaaggttgagaactaacttctagcagctatgcagaagttctgagaggtgactcgtgttttttacatcaagacctccacaaaggccccttctgtcattgagtcaaagttctagcgacctaggttcatcctcaaatgtgtaatgaaaacctgtaaatcacttggactccacttcccctcccaccctgggtcctccaccccaccttgctttggttttgcttggggagaaagtggtctctacacaatatgtctctctccctatcagtctgcaggatgctcagcaggggcactccctgaacacgcctgctcccacagcatgtgcaaaggcttcacacttggattgagggttatacatttcttcatggacatccccaaacaacacagaacagagacaaggtttctggtccttttggaatgtccacaccattcccattcttcaaaatctgtcacacttccagatagttccagtgaacaatgaactctccccctatgcagtaacagttgattattcaatttaacactgaattatatattctctggaactgttctctaacaactatgaggcgttttcaacggtagttgaatggaaaaataccaaactgggagtaaaaagatctggcttccaggccaggcgcggtggctcatgcatgtaatcccagtactttgggaggctgaggcgggtggatcacctgagctcaagagttcgagaccagcctggacaacatggtgaaaccctgtctctactaaaaatagaaaaattagtcaagcgtcatggtgggcgcctgtaatcccagctgctcgggagactgaggcatgagaatcgcctgcacctgggaggcggaggttgcagtgagccgagatcgggccattgcactccagcctgagcgacagagcaagactccgtctcaaaaaaaaaaaaaaaaaaaaagatctggcctctcaagaggccgccactaactctctgtgtaaccttgagcaagccaatgttctgggccttggtgcttcctgcagggtaagaggaggactgccgatctctaaggatcttccgtggtctatgggtttatgacttgaaactcctcaaagtgcagaaacacaagccacatcccttctcaaggccagacacatactaggagctctattaatacctgaataaaaaccacggatgaagagcttgcctggccctggcatttctataccaaaccaacacaccatggatcattgtatcttccctgggacagaccctcagagcctacaagtgactctacaacttcactgatacagatctattattccttagcttagacttccatctctccagatcaaccttcaggaaaactaggaaactatcaataatgatttcaattgtcggcttcaaattcaccttatttcttctaccccagcatgccttttttgtggcagcacttagattctcattcagaaaacaaacgcattcatgccgtaccagtgattcgttggggaaactgcctcggccccaccacccagatcccccacgttcctaccaagtaagccaagtgaccatgtgaagaactgactgacacccagaggaaactaataaacaaaaacaaataaaagcaaataccttttcaggaatctcacttggaaaaccaagtataatggcaaaaaacaaccaaaaaaaaaaaacccgaatgttttcagcgttggggatgttgggggtgtagacatctcgagagctggtttccgaaggcaccgcaccccagacaatgtgctacaagagcctcccggctgctgtgtcaatgaagcctttcaggccctccacactgcttcacttgttccctaaagtagtgctttctggaagctaaactctcagctggcgagaacagtgaactctgtgccatttgtctatcaactcctttaaaaagaaaaacctcctgtacggctctcttgttttgcattttctattctgcactccagtacgcataacgacacacagaagaggcaagggcctcttttaaaaccgtgaagaaagaataaatttgaaagcacccagaagcctctgctttcagctattagagaaaagtttgcatcccatagaaaccagtactaattaaaaaaaaaaaaaaactcagtcctcaaccctggaatcaacaataagggactcttcagggtgtggagtaacaaaaaaatttaaaaacaaaaaataaatgtgcacagcccatctatcttttcccaatcaaataatacagccttccaaaatgtaaaaatagaaatattttcacatgtgaattttacctcaataaagtaattttttaaaaatctttttagccgggcacagtggctcatgcttataatcccagcattttgggaggccgaggcaggcagatcacgaggtcaggagttcaagatcagcctggccaagatggtgaaaccccatctctactaaaaatacaaaaaatcagccaggcatggtggtgcacacctgtaatctcagctactcgggagctgaggcaggagaatcgcttgaacccaggagacagaggttgcagtgatccaagactgagcctgcactccagcctgggtaacaagagtgaaactcagtctcacaaaaaaaaaaaaagaagaagaagaaaacaggaagtgccttccataattccaaatacagtattgttaaatattaatgtattatgtccaaatagttcagtgaatttcaagttttcatccagatgaatggagttcttcatattcattcaactaataaatattccttgagcatctacgacatgctaggcatttttacaagtaaaaacaaaagtagacaaaaattgctgtctttatggactctatattctagtagagggcagaaaagccagtgaccgataaaagccagtgaccaacacttgtgttttttagctgacttattcttgggtatttaaaagagatcttgggccaagcagtggctcatgtctgtaatcccagcatgttgggaggccgaggcgggcgaatcatctgaggtcaggagttcgagaccagcctggctaacatggtaaaaccccatctctactaaaaacacaaaaaattagccaggcgtgtttggcgcacgcctgtaatcccagctactcgggaggctgaggcaggagaattccttgaacctggaaggcggaggttgcaatgagctgagattgcgccatggcactctggcttgggcaacaagagcagaactccgtctgaaaaaaaaaaaaagatcttgaagttcaaaaattatacgagtctgttattttcctagtcttttctccactccaaagaaagataaacctaattggtattccttaccactacaacaatcaggaccactgaagtgagaggaaaggaagctatacaaggatgtatttaaagctcattacttaaacaaaatgaaaacataagatccagagagttctttttatgtttgtttaagagcttcagaaaggctgggcaggctggcacatgcctgttgtcctagctactcgggaggctgaggcagaaggatagcttaagcccaggaatttgtatccaccccaggcaacatagtgaggcctcattaaaaaaaaaaaggaaagaaaaaagggttttagaaaacataatctgatgcacagattatagagttttgcatttttaaaaaatagatctaattgataagacagcaaaaaatgaatatgtggaacccagcaatttcattccacgtacacactagagcagtaatcagcaaacattttctgcatagaattagataccagatattttaggctttgcacgccatccagtctctgttacaaccactcactaggcctgaaaacggccttaggtaatatataaatgcatgagcatggctgttccaataaaactttacttatggacactgaaacttgaattttcatgtgtcataaaatattagtctttccatttttaaaaaccattcagaaatgtaaaaaccaccttagtgtctgggtcatacaaaaaaaaggtggagggtccacgggccagaccatggtttgccaatccctgctctaaagaactcttacaggccaggcacagtggctcgcgcttataatcccagcactttgggaggccaaggtgggcagatcacatgaggccaggagttcaagaccagcctggccaacacagtgaaaccctgtctctactaaaaatacaaaaattaactgagtgtggtgtcgcacatccgtggtcccagctacttgggaggctgaggcacgaaaaccgcttgaacccaggaggcagatgttgcagtgagccgaagtcgtgccactgcattccaccctgggtgacagagcaagactctgtcttaaaaacaaacagacaaaaagaactcttacatacacataactcaactacacatgagaatgttcataacatcattatgtgaattagcaagtatgcagataccaaaaatgttggtagacaaaaactggagttacatgtatcaacatggatgatcttacaaacctatttaagagaaaacacaaattacagaagaacagttacaacgtcatttatatacaaattttaaatatgcagaaattatatattactgagcatatttaacatatataataaaagtctgaacaggccatgcgcagtggctcatgcctgtaatcccagcactttgggagctgaggcaggtggatcacttgagatcaggagttcaagaccagcctggccaacatggcgaaaccccatctctactaaaaattcaaaaattagccaggtgtgttgttgcgcatctgtaaccctagctactcaggaggctgaggcaggagaatcactgaacccgggagccagaggatgcagtgagccgagattgtgccactgcactccagcctcggtgacagagtaagactcttgtctcaaaaaacaaaaaggaatgttccacatcaaactcatttacctgggaatgacgtcagggggaggcaggagaaggatacaactggagaaggatgcacagggggcttcaactgcattgttgatgtttcattttttaaactgagtgacaagtcgatcaatgtccattcttgataccactgtgtaccttaaatatttaataataaataaaaagaaatgtgcagttttgggcttttttttgttttgttttttgtttttttagatagagtctcgctctgtcacccaggctggactacagtggcgtgatctgggctcacgcccagatcctgagtatctgggactacaggcgtgcaccaccatgcctggctaatttttgtatttttagtagagttttaccatgttggccaggctggtctcgaactcctgacttcaagtggtccacctgccttgatctcccaaagtgctggaattacaggcatgagccactacgcccagccaggaatgtgtagatttaatgtgaatttagcaaatggtttgtcctatttgagggcagaggtgaggtcagcttatattaacatatccaaaaacttggtttgagcccagatttctgacactaaaaacaaaaaaatgccccatttgtttcttttctttctttctttctttttttttagagatggagtctcgctctgtcgcctgggctggagtgcagtggggcaatcttggctcactgcaagctccacctcccgtgttcacgccattctcctgactcagcctcctgagtagctgggaacacaagcgcccaccaccacgcccagctaatttttgtatttttagtagagacggggtttcaccgtgttagccaggatggtctcaatctcctgacctcgtgatccacctgcctcagcctcccaaagtgctggcattacaggcgtgagccaccacgcccagcctatttgtttcattttttaaaattggactgaaccttaggagaaaacagaaaattgtactacattcttgcatagctagctaatgtaaatagcttcaagcaacaaactagatattattgatccgtttcaaaagagctgagtcaggctgtacacggtggctcatgcctgtaatcccagcactttgagaggccgaggcaggcggatcacctgaggtcaggagttggagaccagcctggccaatgtggtgaaaccccatgtctacaacaaaaaaatacaaaaattagctgggcatggtggcacgtgcctgtagtcccagctactggggaggctgaggcacaagaatcgcttgaacccggtaggtggaagttgcagtgagccaagcagagattgcaccactgaactccagcctgggctggaggtttttttcatctcggaaaaaaaaaaaaaaaaaaaaaagagctgagtcagattctgacttgtctaacggactcagtcgtgatgttttgcctgtctgctccaagttcccctgttccagacacatctctcacagcattacaatgatctacatgccctaggaatagcgactttccatcatctgcctcatcagagcaaatagaagtgtaagtggcaatgacgttagtgtttgtgtgtgtgaaaacctagtgtgaattttcccctttctctggcaaaagctcacaagccatcattatagaaaagcagaagaaaaaactgcttgttctgcttttcctgacctcagaagcagtagttgttaaaactctttaaaaaaaaaaaatggggtcttgctatgctgcccagacaggtctccatctcctgggctcaagcagagctgggactacaggcacaccaccacaccaagcaaaactgtcttttgatttaaaattacttaaatacttctttaagggtctcctatagtcacttatcttccagttacctaaatcactagcttcttttttttttttccttcagagaccccccccccaaagtcacatccgttgcaattatcgggcaggtactgccctctagtgtttatacttttataataaaaattttacacactacccttttaactgacctcaaagcatggaaaatctgtcaaaaactaaataatatcctattaacccaagatttttcaccttcgcactactggcattctgatcaccctttgttgcggggctgtcttgtgcactgtgggacgttttggcagcacccctggcatcttcccacttgatgcagtagcactcccacacacatcccggtgtgacaaccaaaaatatctccagacacagctaaatgtccccaggggaacaaaatcacccctgcttgagattccactgtattagtctaaaggttgtccaaaacattcacattagacctgaaaattgtaagggaaaagggcttctctgggctaattccattgaatgagataaagaacttcatttctgcatgaaaaacaaggaggtagagaattaagattttcagctccccgcctccacgtacccgcaaagtcctggccattgggacattttttacacctttagctttctgttccagctttacctcttagacctcttcacttcctttcaaagtgcatcacaaacaaagcttgcccttctagccaaatgcagagaatgtggtagggaaaaggaagaagggaggtctgagcatttgtactcaaaaaaagggctctggccagatgtggtggctcgtgcctgtaatcccggcactttgggaggctgaggtgggcaggagttcaagaccagccttggcaacatggcaaaaccccatctctactaaaaatacaaaattagccgggttcagtggcaggtgcttgtagtcccagctattctggaggctaaggcatgagaatcccttgagcctagggggcagggaggctgcagtgagccaagattgccccactgcactccagcctgggcaacagagcaagactctgtctcaaaaaaaaaaaaaaaggagaggggctctagcaaagcgttaaggctcagcattaataatgccagccaaccaggaacctgtattgattgtcagcctaatatgaaaattcttatcaaatatcaaaataagtttcaaatctggcttttagaaagatatttaggagggtttattccaatctgctatgaatgattattcttcatacaagtgcattatgcttataaaccttggttctgtgatttttttttttccagacggagtctcactctgtctcccaggctggagtgcagtggcacgatctcagctcactgcaacctccgtctcccgggttcaagcaattctcctgcctcagcctcccaagtagctgggattacagacgtccgccaccacacccggctaatttttgtgtttttaatagagacggggtttcaccatgttggccaggatggtcatgatctcttgacctcgtgatccgcctgcctcagccttccaaagtgctgggattacaggtgtgagccaccgtgcctggctagttctatgaattttaacacttgcaaattactgagaacttgatatttaaaaaataaaaaaggagtttggactgtcactaacttcctcccctcatcaaatttctcactgacttagttgatttcactgaagaactaaacaaaaaataagaataatcgggccgggagcagtggttcatgcctgtaatcccagcagtttgggagactgagacaggtggattacttgaggccaggagtttgcgaccagcctgggcaacatggtgaaaccccgtctctattaaaaatacaaaaaattagccaggcttggtggtgcatgcctgtaatcccagtttctggggaggctgaggcacgagaatcatttgagtctgggaggcggaggttgcagtgagcaacctgtatcaaaaaaataataatttttttctgtctcaaaaaataataatttttttttttgagacagagtctcgctctgtcgcccaggctagagtgcagtggtgcaacctctgctcactgcaacctccctgcctcccgggctcaagtgattctcgtgcctcagcctccagagtaacagggactacaggcacgcaccaccacgcctggctaatttttgtaattttagtagagacggggtttcaccatattgcccaggctggtcttgaactccagagctcaagtgatttgccctccttggcctcccaaagtgctggtattacagacattagccagcatgcccggcctaaatacatttgtataattaaaaatatttcattctttattaacattttcagacctagttttttttatcatttagtgaaattgaaagtcatagagctctacaatcgtcaagctcttattagcagaccgttggaatggaaatctgttttagctactgtaacggttaatactgagtgtcaacttgattggattgaaggacgcaaagtattgatcctgggtgtgtccgtgagggtgttgcaaaaagagattaacatttgagtcagtgggccgggaacggcagatccacccttaatctggcaccctaatcagctgccagtgcagctagaatataagcaggcagaaaaatgtgaaaagagagactggcctagcctcccaacctacatcttcctcccgtgctggctgcttcctgccctcgaacatcagactccaagttcttcagttttggaactcggactggctctccttactcctcagcctgcagatggcctattgtgggaccttgtgatcatgtgagttaataaactcccctttattctcccattagttctgtccctttagagaaccctgactaatacagctacccagagcggtttgtgatcactgcccgatctcttcttcagaggctgtggcattactgactctgtttttactgggttcatcctattctctttctctctctctctcttttttttttcttttgaaacagggtcgtgctttgtcaccaggctggagtacagcaacatgatctcagctcactgcaacctctgcctcctgagctcaagcaatcctcctgtctcagcctccagagtacctgagactacaggcacgtgccaactcaccctgctaattttggagggggcacagggtgggatggatttggtagagacaggttttaccatgttgcccaggctggtcttgaactcctgggctcaagccatccaccagcctcggcctcccaaagtgctgggattacaggtgtgagccaccgcacctggccccattctgattaatgcaattagaaagtcttctaatcatacaataaagcaaagtgcaaatagttcttatgctttcatctttaaagggcaaccaaatgatttagaatatatatatttgaaactataacctagaaaagtcatatgacttggaagtaaaaagctaaagcaaaacacaaaatctggaaatatatcattctgatcacagagagaggagaggtatatgtcaccagatattaaaaggatcttttttcagttatataaaaaagtcaagctattctggaatatgcaattatttaaaacatccagaagtttttctaaaaaacaaattatggtagaaatttgtttatatattcattgctaatttcttagcactttaaatcccttaggtgaaggaaaattccttaggtttttatattaaggaactgtggcaggcagaataatccctcctcaccctaagtccatgtcctaatcctcagagtgaatatgttaccttacaggacaaaagggattttgcaggtgtgatgaagttaaggattttgaggcggggagattatcctgggcccagcgtaatcacaagagtccttataagtaaaagagggaaacgggaaagtcagagccagagatgctggaagtggaggtcagcgtggtgcaatagttagctttgagatgaagcggggccatgagccaaggaattcgggcagcatctagaagctggaaaagccaaagaacagattctcccctagagcccgcagaaggaacacagccctgtggacaccttgattttagcaccgtaagatccatttccatcatctaacctctaaaactgtaagaaaattaatttgtgttaagtggcttcatttgtggtaatttgttatagcaacaatatgaaactaatacaggagcattttattagtcttttagtactttgactatcccgttcagtcagaattgtggcatttaaataattacatctcatatatatatgtattttttttttttagatggagtcttgccctgtcgcccaggctggagtgcagtggggcgatctcggctcactgcaagctccgcctcctgggttcacgccattctcctgcctcagcctcccaagtagctgggactacaggcacccaccaccacgcccggctaatttttgtctgtttttttgtttttttttttttttagtagagacagggtttcaccatgttagccaggatggtctcgatctcctgacctcgtgatccacccgcctcggcctcccaaagtgctgggattacaagcgtgagccaccgtgcctgtccaattacatctcatattatcatgttggctataaaactgtatgcaccctttttatggttgctaataaaaatgtttttgctcaaatatacttgctatttacctttaagtgaataatgtattccagaattaaaatccagggcaaatatacacacaataaggagcaccactctagcaataccagacacatttagtagacatgacacatgcatttaaatatgtggaaaattctaagcagctacctatcaaatctcaagagataaagtccagcagcccaaccacactggctgtcaaacaggctgaaatttgattcagaaaatagaatctgattcagaagacaaaaatggtaacgttaacaatgctattttgatgtgaccctttagcagaaagctgaccttttcggcagttgttaaaaagcaaggtatgtctgtaggagagagcagagcttgataaatgaagaaaacaggtctatccccataatatagagagaaatcactgacaatttagtctcatcttgttccactatcattttaacagtggaagctgccactgcgaaagctcgctgcatggcacctgttaggcctcattctcatctcgcagttcccagaattcctcttgattgcagcatccatacactcttcattttcctgcaaggtattatttggacactcttcaagaatccttttttcttttttttttcccgagatggagcctcacttcgttgcccaggctggagtgtagcggcgcaatctcggctcactgcaacctcctcctcccgggttcaagcgattctcctgcctcagccccccgagtagctaggactacaggcgtgcgccaccacaccagctaatttttgtatttttagtagaggcggggtttcaccatgttagccaggctggtctcgaactcctgacttcaagggatccgcccacctctgcctcccaaagtgctgggattacaagcatgagccaccacacccgaccctcttaaggaatcctaattgcaacttttaaggcttgtaattcctccaaataactaaagcaatagcacatactctaaaaagaaaacttttcttcctttgccaatatattgacaaatttggaaaagataaaatcccaacataatgttcattgttcttatgattatgactcttgaaactttatgcagataactctgtacacagactagtccctcatctttcccaaaatgcttaagaaaaacaagaatgtttaatccagatgctgttttctaaattggccaattcagtttagcacttacatcttaagaaagtaagcttcaaaaattctcctgtttctcctgtgatgtgtcaatatcatttggcctttggcttcaattaggacatgagttgatttcttcttagccctaactaatggtcatgtagtagactgacttttcaaatagtgtgtttagaataaattagttcattacagaacattttctttattttcagctggcatcaatgtgggcatcaaggtgtcctcctactaagcagtttaatctgaattggtaacatggattatatatacctatagtaacttggagattttactgtatttctcttttgagatgttttacataatttttttctccttgatgtgctactaaaatgtctgtagaaaactgtatgctttaagtctaaacatcaagtacagtgtgggttgaagggatgatatcaaaaaaagcaaactccatccttttttttttttttttttgagacagagtctcgctctgtcacccaggctggagtgtagtggcacgatctcggctcactgcaacctccgcctcccagattcaagtgattctcctgcctcagcctcccagtagctgggactacaggcatgtgccaccacgcccagctaatttttttgtatttttagtagagatggggtttcaccatgttggccaggatgatctcaatctcgacctcgtgatccgccgcctcgacctcccaaagtgctgggatcataggcgtaagccattgcgcccggccaactccagccatttttaagctatacttaagatctttctgtcttacatttctgtaatgagacagctaatcacaactaagcgggttggttataaagatctaaaccggccgggcgcggtgactcatgcctgtaatcccagcactttgggaggccgaggtgggcggatcacgaggtcaggagatccagaccatcctggctaacagtgaaaccccgtctctactgaaaatacaaaaaattagccaggcatggtggcggacgcctgtagtcccagctactcgggaggctgaggcaagagaatggcatgaacctggaaggcggagcttgcagtgagctgagatcgcaccactgcactccatcctgggcgacagagtgagactccgtctcaaaaaaaaaaaaaaaaaaaaaagacctaaaccgacattgtaagcaagacaatgctacaaaatatggaagacacaaagagagttcctaccctccagagaatttccctgagacgagtactgcctttcagttttctctgttgtggggacagaaagaataatggtaagaggctgagtaatggctgcatcatgagggtagtctagacaagcaacccatggatatgcaagagaaagactgtctccaggggtccatgaaagagactgcctgaaggtgggtgggatcttgatgagatggaaaaccttccaggcagagggaaaagtgtgagcaaagacagagagatttgtgtattcatttcccagggctgctggaacaaggtaccacaaactgggtggcttaaaacagcagaaatctctcacagttctgaaggccagaagtctgacatagagttgtgggtggggcaatactttctctgaaggctctaagagaggattttccttgctgcttcttagcttctggtggttgcagacaattcttggcattctttggtttgtagacacacatcactccaatctctgcctccaccgtgatatgttgttttctttatatgtctctctgttcacatgccccccagctctgcgtctgtatctatatctcctcctctcataggtacatagcttatactggattagagcccacccacccactaggacatcatcttaactacatctacaatgactctatctccaaataaggtcacattcataggtaggcattagaacttgaacatatctttttgaaggacacaattcaacccacaacatatggtcatgagaaggtcagtgtggtcagaaagtagagtatatctagggaaagagtggaagtaactcaggaagaaggggctggagtatagagaaccttgatgaataagcaatgagggtgcacagaatatatatatatattttttcgaggcagagtttcactcttgttgcccagctggagttgcaatgcacgatcttggctcactgcaacctctgcctcccgggttcaagcgattctcctgcctcagcctcccaagtagctgggattacaggcatgtgccaccacacctggctaattttgtatttttagtagagacagggtttctccatgttggtcaggctagtcttgcactcctgacctcaggtgatctgcctgccttggcctcccaaagtgctgggattacaggcgtgagccaccacgcccagccattagggtgcacagaatatttttaagtaaaggagtattactggccaggtgtggtggctcacgcctgtaatctcagcactttgggaggccgagtgggtggatcccttgagctcaggagtttgcgaccagcctgggcgacatggcaaaacttcgtctctactaaaaatacaaaaatttactgggcatggtggtgcatgcctgtgatcccggctacttggggggctgaggtgggaggctgcttgagcttgggaggcagaggctgcagtaagctgagatcatgccactgcactctagcctgggcgacagactgagacaccatctcaaaaaaataaataaattaattaattaattaattaaattaaaaggagtattactaataaagttgtccatttgggaaaattgatttgtcattattatttaaaattcattatagtagaaaaagagaaaagaataggaaaagtcagagagctacttcaggaatagagggggttcgtgatgcatcaaataaaatagtccatagatctgtaaagaatgggacatacaagacagcctggttataagagatgaggtatgactgaagttggggactaggagaatagtgttagaattattatcattgttacattaatcaaactgcattctaacaccaattctcgggtgtcaactgggtgttctacatttcaattctgatactacctactgagaaataaaaatgaaatcctaagtactcccagccaactgaatgggccccctcttggtcaagagaccactgtccgtggacttgttctggccactttacagaggctgtacacaggatgcctctatgtcctccatttcactttctgacattacagcctaattttaattactttctgacattacagcctaattttaatacatttaaatattaagtcaccaccccaaagtaaacatgtgacatttgtaacacgcattttgacttactagcatgtgcccccctctttatgaatattcacagctcctcctgtaacctgttgactgtatacaaagccaatccattcagcataaattcctgcctcaccctctcctccctcaaagtgcctgctttcagtttctaccagaggctacacttcccagcctgcaggctgcaatccatcataaaaaataaaactcttgtttccaaatttatgaaccttaagtgcagaatccacaggttaaggacaaagtccttcacaaaattgcatcttgggtgtccccaaaccacccaaacttctgcccacacaactataaattcggggcttcccacaacctcctcaggttcaataatttgctagaacaacccagaacccactgttctgggtaaataatacaactgttatttaacatcacatttgtatcataaagaatagcattcacagccaggcgcggtggcccatgcctgtaatcccagcactttgggaggctgaggcggacggatcatgaggtcaggagattgagaccatcctggctaacacgatgaaacctcgtctcccctaaaaatacaaaaaattagccaggcgtggtggcaggcggctgtagtcccagctactagggaggctgaggcaggagaatggcgtgaacccgggaggtggagcttgtagtgagcagagatcacgccactgcgctccagcctgggtgacaagagcgagactccctcacaaaaaaaaaaaaaaaaaaagaatagaattcactgcagatgcagtggttcatgcccggaatctcaacattttgggaggccaaggcagaaagattgcttgagcccaggagtttgatactagcctgggaaacatggcaagtcccatctctacaaaattttttaaaaattagctgggtgtggtggtgcacacctgtggtcctaagctactcagacagaggctgaggtgggaggatcacttgagcccaagaagccaaggctgcagtgagccatgtttgtgccactgtactccagcctggatgacagacctgaatgacaattttctttgcctcaaaaaaaaaaaaaaaaggaatacaattcaataaaacaaaaaaccagggcgtggtgatatgcacctgtagtcccaactacttgagaggcctgaggcaggaggactgcttgagtccaggagcttgaggctacagtgagctgattgtaccactgcactccagcctgggtggcagaataagattgtcaaaaaaaaaaaaaaagccaggcacagtggctcacatctgtaatcccacgtaatcccagcactttgggaggccaaggcaggcggatcacctgaggtcaggagttcaagatcagcctggcaaacatggtgaaaccccatctctactgaaaaaaaaaatacaacaaaattagacaggagtagtggcaggcgtctgtaattccagctacttgggaggctgaggcagaagaatcccttgaacccaggaggcagaggttgcagtgagccgagattgtgccattacactccagcctaggtgacaagagtgagactccatctcaaaaaaaaaagaaagaaagaaagaaaccaggcgtggtggctcacacctgtaatcccagcactttgggaggccgaggtaggcggatcatgaggtcaggagatcaagaccatcctggccaacgtggtgaaaccctgtctctactaaaaatacaaaaattagccaggcatggtggtgcgcacctgtagtcccagctacttgggagactaaggtaggagaatcgcttgaacccgggaggcagaggttgcagtgaaccaagatcatgccactgcactccagcctggcaacagagactttgtctccaaaaacaaaaatacaattcaagaacaaccaatgaaaaagacacttagggcaaggtctgagggtgggggagcagggaacaggaacagagcttcccgtgccttctcctcatggaatctgggtacatcaccctccctgtacatcaacgtgttcacaaactaggaagctccactgagccttggagtctagagtatttattaggttttcattatgtagggcatgattcatgaaatcattggccacttgattgaacccaatctctagactctctctcctccaagaagatcagggttgccgggagtagggtaggtcagtaaaattgaaagattgaaagttcagtcctctgaacctatgcttggtctttctggtgtgaccagccagtcccttgaaaatatcaaaggactcacagtgtgttaattcagtcacatcaactcaggtatggtcaaaagaggatcataaagaataacaaaaaaatatccctttctgtcccttaggaaattctaagggttttagtttgtttttagagatgggggtctcactccattactcagtctggagggcagtggtgcagtcatagctcattgcagcctcaaactcctggactcaagcaatcttcctgcatcagcctctcaaagtgctggaattacaggcgtgagccactgtgcccattttccaagggtttttgaacccatgtgctggcaaccagagacaaagatcagacatataggcaaagctcagagatgttgcagtttgtgttccaaaccacagcaataaagtgaatatcacaatgaagcgagtcacacaaattttttggtttcccagtgcttataaaagttatgtttatactatactgtagactattaagtgtgcaatagcattatgtcttagaagtatacacattttaatttgaaaatactttattgctaaaaaaaatgctaacgatcgtctgagtctggtggagagtcttggcttgatgttgatggctgctgactgatcacagtggtggttgctgaaccctgaggtggctgcggcaatttcttaaataaaacaatgacattgctgcatcaattgacctttcctttcacaagagattgctctgtagcatgcgatgctttttgatagcgtttaactacagtagaatttctttcaaaattggaatcaatcctcaaaccctgccactgctttaacaactaagttgttgtaatattttaaatcctttgttgtcatttccactatgttcacagaatcttcacaagtagattccatctcaagaaatctctttctttgcttatccataagaagcaactccacatctgttaaagttttatcatgagattgaggcaattcagattcatcttcaagctccacttctaaatctagtccccttgctatttctaccacatctgcagttccttcctccactgatgtcttaaactcctcaaagtcatccatgaggattggaatcaacttcttccaaatttctgttaatgatattttgacctcctcccatgaatcataaatgttctttttcttttgtttttgtttttttgagatggaggttcactcttattgcccaggctggagtgcaatggtgcaatctcggctgactgcaacctctgcctcccaggttcaagctgttctcctgccacagcctcccaagcagctgggattacaggtgcctactgccacacctggctaattcttgtatttttagtagagatggggtttcatcatgttggccaggctgatctcaaactcctgacctcaggcaatccacccacctcggcctcccaaagtgctgggattacaggcgtgagccaccacacctggccttgaatcataaatgttctaatggcatctagaatggtgattcctttccagaaggttttcaattttctttgcccagatccatcagaggaatcactatcaatgacagttatagccttatgaaatatatttcataaataagaagacttgaaagtccaaattgctcctttatccctgggtggcagaatggatgttgggttagcaggcataaaaacaacagtaatttccttttacatctccatcagaggtcttgggtgaccaggtggattgtcaatgagcagtaatattttgaaagaaatcttttttctgaggagtaggtctcaacagtgggcttaaagtatttaataggccaggtgaagtggctagtgcctgcaatcccagcactttgggaggccaagacaggaggatcacttgagcccatgagtttaagaccagtctgtgcaacatggcaaaactctgtctctacaaaaaatacaaaaattagccaggtgtggtagcacttacctgtggtcccagctactagggaggctggggtgagaggatcacccaagcccaatgaggtcgaggctgcagtgagccacgatcgtgccactgcactccagcctgggtgacagaatgagaccctgtatcaaaaacaaaccaaaaaaaaagtattcagtaaaccatgctgtaaacagatatgctgtaatccaggctttgtttttccaatgatagagcacaggcagagtagattttgcataatactttaggatcctagaatttttggaatggtaaataagcattggcttcaacttaaagttaccagttgggttgggcatggtggctctcgcctataatcccagcactttggaaagccaagatgagtggatcacttgaggtcaggagttcaataccagcctgggcaacatagtgaaactttatctctgcttaaaatacaaaaattagctgggtgtggtggcgcacacctgtagtaccagctacttgggaggctgaggcatgagactctcttgaacctgagaggtggaggctatagtaagccaagaccgcaccactgcactccagcctaagtgacagagcaagactctgtctcaaaaaaaaaaagaaaaagaaaaagaaaacctgttgtttaatggagccaccttcatcaatgatcctagctaaagtttctggataacttgctgcagttcctacatcagcacttgctacttcaccttgcccttttatgtcatggagatagcttctttcctcatgaaccaacctctgctagcttttaactactcttctgcagcttcctcacctctgtggtttggaaacaaactgcagcatctctgagctttgcctatatgtctgatctttgtctctggttgccagcacatgggttcaaaaacccttggagaatgggcacagtggctcacgcctgtaattccagcactttgagaggctgaagcagaaggattgcttgagtccaggagtttgaggctgcaatgagctatgactgcaccactgccctccagactgggtaatggagtgagacccccatctctaaaaacaaactaagtaaaacccttagaatttcctaagggacagaaatgaagacaaggccttgctctggattagggattggtttaagggcatgctgtggctgttttgatcttctattaagaccactcaaacttcctccatgtcagcaataaggctgtttagctttcttatcattcatggctaacttatcattagctagctgcttggcacaagagacctagtttttggcctatctcagctttcttggcttttgaaatgccatctttactaaatgtaatcatttctagcttttgatttaacatgaaagacatgcaactcttctttacaattaaacacttagaggccattgtaaagttattaattgacctaatttcaatgtcgttgtgtctcagggaatagggaggcctgaagagagggagagacacaggaatggccattcagaagagccgtcggaacgcacaaatttatccattaagtttaccattttatataggcacaatttgtggcaccccaaaataattacaatactaacatcaaagatcactgatcatctctgtttccacttgagggttgggaaaagaacaaaaatcactaatcatagatcaccttaaaagatataataataatttaagagtttaaaatattataaggattaccacaatgtgacacagagacatgaagtgactagggctgttagaaaaatggcaccgatagacttgcttgatgcagggttgcaataaacattcaatttgtaaaaaatataacatccaggccaggcgcagtggctcatgcctgtaatcccaacactttgggaagccgaggcaggcagatcacccaaggtcaggagttcaagaccagcctggccaacatggtaaaactctgtgtctacaaaaaaaaaaataataatacaaaaattagccagacgtggtagcaggtgcctgtaatcccagctacttgggaggctaaggtgggagaatcacttgaacccgggaggcagaggttgcagtgagccgagatcgtgccattgcactccagcctgggtgacagagcaagactccatctcaaaaaaaaaaaaaaaaaaaaaaaaaatctacaaagtgcaataaaggtgaagctcaataaaatatgccagtattctttattatatcacatacttttttttttttttttttagacagagactcactctgttgcccaggctggagtgcagtgatgcagtctcggctcactgcaacctctgcctcccaggttcaagtgattctcctgcctcagtctcccgagcagctgggattacaggtgcctaccaccatgcctggctaatttatgtatttttatttttatttttatttatttatttattttttgcgacggagtctcattctgtcacccaggctggagtgcagtggctcaatttcggctcactgcaagctccgcctcctgggttcacgccattctcctgcctcatcctcccgagtaactgggactacagacgcctgccatcacgcccagctaattttttgtatttttagtagagacgggttttcactgtgttagccaggatggtctcgatctcctgacctcatgatccgcccgccttggcctcccaaagtgctgggattacaggtgtgagccaccgcgcccggcaatttatgtatttttagtagagatggggcttcaccatcttggccaggctggtctcaaactcctaacctcaggtgatccgcctgcctcagcctcccaaggtgctcagattacaggcttgagccaccgtgccaagcctttattatatcacatacattttaataaatgatatttattaaggattaaggactagatatataacaggcacatttaactctcataccaaccttatttatcatctctattttacaggtgaggagattgaaacgcagggactatataatgagccccaagatcgtaatatcagtaattggtagagtaaggattcaaagccaggtcagttcactcaagagcctgtgctggtaacaactgatacttcctccctgtgtcctcaagcaagtcacttaaccccacagattttggttttccatgcagttaagatagagaaggtggactccatgattactaatgttcctttcaactctagtgtttccccttttcatttaaattgtttcaaggctgggcatcgtggctcacgcctgtaatcctaatactttgggaggtcaaggcaggcagatcacttgaagtcaggagttccagaccagcatgggcaacgtggtgaaaccctgtctctacaaaaatacaaaattagtggggcttggtggtgtgtgcctgtagtcccagctactccagatgttgaggcacgagaatcgcttgaacccgggagacggaggttgtaagctgagattgccccactgcactccagcctgggcaacagatcgagactctcttaaataaataaataaacaaatagtttcaaaacaccactcttttttttttctttttttttttttttgagacggagtctcgctctgtcgcccagtctggagtgcagtggcgcgatctcggctgactgcaacctctgccttccatgttcaagctagtctcccgcctcagcctctcaagtagctgagattacagacatacaccaccacacccagctaatttttttgtatgtttagtagagatggggtttccccatattggccaggctggtctcaaactcctgacctcaagtgatctgctcacatgggcctcccaaagtgctgggattacaggtgtgagccaccacacctggccaaaacaccattcttaatggctgcataatatcctacttatgagtaaaagataatttactattaccgtactgctggacatttaggctgcttccagtttttccttaacacaattatcctcgcaatgaacattctggtgttttacagattatttttttagaataaatccttagaaataattctatcaccatccattcctgtaatgagtttttttttttaagttttgttcatctaatcaatgtaatttaagctgtgttatcttactatacctgttttttaaaaccagtattatgccactatggggacttagtaagaaaaaataaaacacattttactcttgcctgatttctttaagatttttaatcattaattttttcttttttcttttttttttgtttttgagatggagttttgctcttgtcacccaggctggagtgcaacagcatgatctccgctcactgcaacctccgcctcagttcaagggattctcctgcctcaacctcccaagtagctgggattacaggcacccgccaccacgcccagctaatttttgtatttttagtagagatgggggtttcaccatgttggccaggctggtctcgaactcctgacctcaggtggtctacccgcctctgtctcccaaagtgctgggatacaggcttaagccacagtgcctggacattagtgttctcgtatgtaaaagttgtcagaatcaaaatggagtcactaatgttaagaaaaccctcacaaataaggccagaagaagtcataatgaaagggcttttacacttgtatgcttgagaatgaaaaagactatacaaaaaccacaaccttacaaaaaaagccatcacaatcttaggcaaaaaagacttctacaaggacatctgcccagcaactacttgttcagcctcagactggtatcacccctgttattaatccttgtagccaaagataattatttcaaaacaattgcataatcctcctgatttttccctttaaaaactttggtcttcctttatctccttgaatatgcacatcatttactatggcatgcggattcccattgcaatgctctattcccaaataaacatcatttgcttttagagagcctctctttctgcttgttatttaggttaacatatatcaggtctaggccgtgtgtggtggctcacgcctgtaatcccagcactttgggaggccgaggcaggcagatcacgaggtcaggagatcaagagcatcctggctaatacggtgaaaccccgtctctactgaaaatacaaaaaaaaaaaaaattagccaggcgcggtggcgggcgcctgtagtcccagctactcaggaggctgaggcagaatggcatgaacccgggaggcagagcttgcagtgagcggagatgcgccactgtgctccagcctgggcaacagagcgagactccgtctcaaaaaaaaaaaagagaaggtactttgtaatatcctaccccacccttaagaaggtactttgtaatattttccccacccttgagaatgtgctttgtaagatctacccctctgcctgcaaaaaattgctcctaactccaccgtctatcccaaacctgtaagaactaatgataatcccaccaccctttgctgactcctttttcggactcagcttgcctgcacccaggtgaagtaaacagccgtgttgttaaaaaaaaattttttttgtttgcatttctcttgttaaactgtcttttgttatgtggcctcagccatgaaccaatgggtgaggaaacaatattatatatccttaggtcttggacatggaaatcaataaatatttattaaataagtaaatttgtcttgtacttttttgtttactcttttagataacctttagaaaatttccattagccgggtgtggtggcacgtgcctgtagtcccagctactcaggaggctgaggcaggataattgcctgaacccgggaggcagagatttcagtgagctaagatcacgccaccgcactccagcttgggcaacagagtgagactccatctcaaaaaaaaaaattttttttcatggtttcctccctataaaaaaaatccagtgggaatttagatgggaactgcgttgaatttttaaattgattgaggacaggctaaaatcttcacaatgtttagccttttcatctaaaacttagcatgcctctccttttactcactggtgaaaaattaagagtgtttctattaaagggtgtttctaattttttctctctagtaatagtttgatagtttgtattatatagctcaaacaagtcctcagtaagactatgcctatgaattgtatttgttgatatggtgcatgggatctttttttctctacgttctttacctaattattgccagaatattagagtgctttgttttgttttgttttttgagacagagccttgccctgtcacccaggctcaagtgcagtgatgcgatcttggctcactacaacctctgcctcccgaattcaaatgattctccttcctcagcctcccaagtagatgggattacaggcacccgccatcacgccaagctaatttttgtatttttattatagtagagatgggttttccccatgttggccaagctggtctctaactcctggcctcaagtgatctgcctgcctcggcctcccaaagtgctgggattacagaaaacagcacctggcatgagcccctgcacctggtctagagtgttttttttctgaacaacttcattaattcaaatagtttagttgagcacaaagattccatcatctgcttttctcccagaatttaagccacttatttatttactatcttattgtatttgtcggaacttctataacaacgtcaaattatagaggctgagagactgaataacaaatggacaatggcaagatcatatgaaaaattgaactttgacccatgatgtgcaacaccttgcccaggagatcaaccctttatctaaaataaacaactcaggaagccagcctgctataagtcagacttagaggaagccagtttgctatctctagtgacaatccaagaagctaaaaaataacttctgtaacaattggcctaaaatggccaggacttgatcgataactgacggcgtccagaattgtagtccccatttccagcataggaccaaccaaggaaagccaaatatgcaccactaaccaatcacataagacgccccacttctggttagctcacctacagcttcctcatgccaacagcttccaatcagggcttttttcctctataaagctttcccatttctctgcctgcctttgggtctctgcccaaatgccagtgctggtagctgactcccttgctaaagcaagctcagaataaacagccgttgcttctctcatttggtaggtcttttttcttttaaagacagagtctcactctgtcacccaggagtgcagtggtgccatctcaactcactgtaacctctgcctccccagttcaagtgattctcctgcctcagcctcccaagtagctgggactacaggtgcatgcaggagctcaagaccagcctggccaacacagtgaaatcccatctctactaaaaatacaaaaattagccaggcgtggtggtgggcgcctgtaatcccagctactcgggaggctgaggcagaagagtcacttgaacccgggaggcagaggttgcagtgagccgagatcacgccactgcactccagcctaggcaacaagagtgaattccgtctcaataaataaataaagtggccgggcgcagtggctcacacctgcaatcccagcactttgggaggccaagacgggcagttagcaaggtcaggagtttgagaccagcctgaccaacatggtgaaacctcatctgtactaaaaatacaaaaattatcccagcgtggtggtgcatgcctgtattcccagctactcaggaggctgaggcaggagaattgcttgaacccaggaggcggaggttgcagtgagctgagatcacaccactgcagtccagcctgggtgacagagcaagactccatctcaataaataaataaataaataaataaataaaatttaaaaaaattttaaaaagacaaaaaggagaaatattatcatctaatataaaaaatgattcgtataattattatatttaaaaactgtggccgggcacggtggctcacacctgcaatcccagcactttgggaggccaaggtgggcggatcacttgaggccaggagtttgtgaccagcctggccaacatggcaaaaccccacctctactaaaaatataaacattagccagggtggtggaatcccagctacccgggtggctgaggcacaaaaattgcttgaccctgagaggcggaggttgcagtgagccgagatcacaccactgcactccagcctgggcaacagagcgagactctgtctcaaaaaaaaaaaaaaaaggaaagaaagaaaaatagaaagtatgttaatagaataaagtaatttacatagaatcaaaggaagcaagaatttggcagcattagtctaatagtgctgagcgtactgctgccaaagtcagacaaactgaacacaacaaatactaaaacctctagaaagaatagtgtggatcagggtaggttcctcatacttgtcaaacacataaaatatccctctagcaccctctcctccacttctatgctcacctgagaggattctgattgtgcacttggcctctcagttacctttcctagaagggatacacgagaccttcacctagcaacatgactactgcacttgaaatgtggctaatccaggcactttgggaggccaaggagggaggatcacttgagcccaggagtttgagaccagcctgggcaacatggtgagatcctatctttataaaaagaaaaaaaaagaagaagaaagtaactaaataaaaataaaactctgttaaaaaaaaaaaagaaagaaagaaaagtggctatctgaattgagatttgctgtaagcataaaatccatcccagatttggaagactttgcatgaaaaaaatacaaaacatcttactaatgattttttacattgattacatgtagaaagtataatattttgaatatgttgggttaattaaaatacattaaaattaattttacctgtttctttttagttttttaaatatgtctactagaaaattctaaatacatctgtgacttgcatttttattttatttatttatttatttcttgagacagagtctcattctgtcacccaggctggagtagagtggctcgatcttggcttactgcagcctctgcctcccaggcacaaacaattctcctacctcagcctcccgagtaactgggattacagacacccaccaccatgcctggctaatttttgtgtttttagtagagacagggtttcaccatgttggccaggctggtctccaactcctgacctcaggtgatccacccgccttggcctcccaaagtgctgggattataggtgagagccaccgcactccaccaacttgcatttttgacagaattatatgtctattaaagagcgccaatttagaacactgaacaataataccataaacaatgtaaatatacattctccctgtaaattaataaattgacaacttgatttagaaatctgactttggtgaattttcacggcacaagtctgtccctcacatattgatcgattttgtatttacaaactcaaatacatctccttctatagccctgcaaaatgaaggatcacgccttcactgaagtgagcaaatcaaagttttggcatcttctgagctttctgggcacaagctgtcagctcagccatttctctgcctgcaatttcgctcttggtttataatcttgggtttaggctgtttttcaagggatagagttggtatcattcatatttgttttcctatcacttatgttccttaaacaaaggattttaaaagtttgttaaatattctacattttatgcctttgatcatagctgtaagactgcttgccttgaaaaggatttgcacataattctccatggtttttttcttaatatgttaattgcaaaccgcttgtaaagattgagtacatgaagatctgaaagacagcagttatttacagtcatgtaaagtaaaaatggcaagtgatatctaattaatagctaataacctaataatatggagtggaaacttgataaccattacagcacactgtattttattatcaaggacagagccttagagacagaccacagaattgatgtttcatcattatgcgatggcctacattatatgacctcttatttgtccctcaactccaatagcaacctcaaggctgatatagaatagcagtggaaaggaaaataaatgacacaaaaagaaaagtaggtttatcatgggaccaatgtagtgctttggcctcatagcagagaccagatggtagcagctcctctctcagcaggtagctcttcaatatcctacgggttgtaaacaacaaattcacatcatctccacctgctaataagtattttttaaaatattgcggcaacatcgaaacaatgctgaaaatacaatccctcaatataagaaaaaaagttttcctaaatatttagtctgttaaaagaaaaagtcttttctgagaaatgctattacccactagaaaatcttggcttcttaaaatccaagaatattctcatctcttttttttttttttttttttctttttttgagacagagtctcactctgttgcccaggccagagtgcagtggcgcgatcttggctcactgcaagctccacctcccaggttcaagcgattctcctgcctcagcctcctgagtagctgggattacaggcacgtgccaccatgcccggctaatttttgtattttttagtagagacgaggtttcaccatattggccaggctgctctccaactcctgaccttgtgatccacctgcctcggcgtcccaaagtgttgggattacaggcgtgagccacagcgctcggcctcttttttttaaataaagtaaatggccctcattttacccaattttgtgactttgtaaaagccaatgaaaatgcctgagaaactactgacattagttttactgcagttaaatatttgttaactttgccaggcgcggtgtcccgtgcctgtagtcccagctacttgggaggctgaggcaggagacggcttgagcccaggagttctgggctgtagtgtgctataccgatcgcgtgtccgcactaagttcggcaccaatatggtgacctcccaggaacaggggaccacgaggttgcctaaggggaggggtaaactggccaaggtcagaaatagagcaggtcaaaactcccgtgcggatcagtagcaggatcgtgcttgtgaatagccactgcactccaccctgggtaacagaccctgtctctctagatagatagatagatagatagatagatagatagatagatagagcgtatatatatacatatgctaattctatagaaacatgtaactgtcctttgacattttaataaaaattgtgtatacaagatttcaaatttaattattctcttctccttccataggatcaaagacatcttttggttgcacaagaaaaagtgaagcaaatattctctgaaaagtgactgatgccaataaaacgtataatttttgtatgtttaatagagatggggtttcaccatgtgttggcgcgcgcctgtagtcccagctactctggaggctgaggcaggagaatcgcttgaactcaggaggcggaggttgcaatgagccgaaatcgtgctactgcactccagcctggcaacagagcgagactctgtcacacacacaaaaaaagtataatttgatgacagtttttcttcaatagtttaagacacttctaacaaactataatttagttgtcctaattaaaagaagaaaaatgttaataatctcacacagtgacctctacaaaatgtccctcaatggacccattctttccttcggagagagaggaaaaggatcctacatcttataccttaaagctcttaatcactttacatgtgggctacatgtcatttttcaacggtttccctctgggtagctggttgctccaatattttccagaattgattcgttcttaggtaccaacttgaccgttcaattcagcaattctggctttaaaatagaagaaaaggccgggcgcggtggctcacgcctgtaatcccagcactttgggaggccgaggagggcagatcacgaggtcaggagatcgagaccatcctggctaacacggtgaaatcctatctccacttaacatacaaaatattagccaggcgtggtggcgggcgcctatagtcccagctactcgaggcaggagaatggcgtgaacctgggaggcagagcttgcagtgagccgagatcgtgccactgtgctccagcctgggcgacagagcaagactctgtctcaaaaaaataaataaataaataaataataaaataaaatagaagaaaaataggagtaggaacaacgtggaatagtaggttagcccctggggacaagaagagaaattcacttaagcaaaggtcacctaagtgcaaacttgaaccagactgtgcacaaacaagtgacagaagcgaaagtggcctcagctgcaaacgcagcacttgataaaccacactcatgatcagccctcatttccaccttagagagattgaaaacatacctaactccaccatttatagctgctgagcaggtggatgacattcgtcaacgtggggtttagaataatgcaatgtttgaaataaaattagaaagaaaataaggccaggcacggtggctcacgcctcgaaccccagcattttgggaggccgaggcaggaggatcgcttgagcccaagaattcgagaccaacctgggcaacaggacaagactccatgtgtattaaaaaaaaaaaattaagaaaacaaaagctttgttaatcgttaagtaaggattgcaaaatggaagacagtaaagaaaaggaaggtcctaagaatctgacccacgagtttcagtccaagtaacctggacctgcccagaggaagcaaagcggaagtaggatccaaaacgctttcagcaggccgcctgcgcccccgcgcatgcgcaggtctctgactttgaccgttttggcgggtgcgcgccagccctagtttatctagaggggaagggcggtgcgggaccacgtgactggggttgcggcatttctggcccaatccgagacggtttcgtagagcgccctgtagagcaattcgggttgcccgggtcctttccgagtcttgacctcctcttttgcttctggcttttcgactctgctctcgaatctaaaaatttgccttggcagaagtttttccctgtgttccaggaattacattagggacacactctaaagtgatcagcactttttatttttttccttcatcaactaaaataacattgctgtctccccaagacgctcgaattctgttctattgcttgagattccagaatcgctggagggcgccctgttgtaaaaatagcactccccacaaaaagagagagaaagttttatctatatcagggggttgaggattggagaaataaagatgaaaaatttaaagaagcaagtgtcccctaggactatgacagatacgtacctcaacacgtacccccaaaggtcactttgtcagtttaagcatttaaaatctcccaatctgtctattcaagcctatcaaaaatctgaagtagtgatgctgagataatatgtggttggtccaacccagtggagtgtgacggggaaacagggcttagagaaatttaatcttaaaactggagtactttcctcatttccctgaaataaagggaattgggggaaaagcaaaatggatgaggctgagttctagagctctaatccttcacgtactgactgctacagcccaggaagcttagcagtggttcatgtcacataccccaatatacatggcttggtaaaaatacgtgttgacaggccgggcgcagtggctcacccctgtaatcctatcactttgggaggctgaggcgggcggatcacaatgtcaggagttcgagaccagcctgaccaacatggtgaaatcctgtctctactaaaaatacaaaaattagctgggcgtggtggcacgcgcctgtaatcccagctactcaggaggctgaggcaggagaatcgcttgaacccgggaggcggaggttgcagtgagccgagatcgtgccactgcactccagcctgggcgacagagtgagaatctgtctccaaaaaaaaaaaaaaaaaaagtgttggtaaaagtatccaatttactgaaaaaatttctcacccgtaatccttttcagaaagatttaactaattccccacagataataaatcctccacactacaaaaattggtttgtttttaactcagcatattctcagaaaagtggccggtggtggagcagagtgcaacacagctcaaagcgctggactcacaggagcttcgctgcagacttgcagtgatagtgactgctgcttcccttgggttcctctggtgttgctgtcattgataatttagtagtttcaactgcagttccttccattacacttacagattcttctacggacccccagaattcctcagtcacagctctctatataaatggctttgaaagccactgactacactgttggtgtctactcagtgccaagagaaatggactctgggagaaaatccctccaagtggagaaaccctgtaacccctttgagctaattccggggagtgactctagccaggaaaagtcacaactaaagcggaaaacagatcgtagccttcaccatcggcaagatggtgcagtttatttaatagaaaaatcatcaatatactgccatatttttaaaaaaaaggttttttaaagataataggagtccagtcgtggtggctcacgcctgtaatcccagcactttgggaggccaaggtgggtggatcacctgaggtcaggagttcgagaccagcctggtcaacatagtgaaaccccgtctctactaaaaatacaaaaaattagctgggtgtggtggcgggcgcctgtaatcccagccactcgggaggctgaggcaggagaatcgcttgaacccgagaggcagaggttgcagtgagccgagatcatgccattgcactccagcctgggcaacaagagtcaaactctgtctaaaaaaaaaaaagataatagggaagtcagagaaagtaggcaagtgtttacagtgtcgaagttacttcttgaagctagaacaggtagttttcaccagagctgtgtgcctatttggtggcttgtgtcagtattaaccatcaacatggatgtgtccatattataagggatcaagtccaaacaaaaatttgaattatttgtaaatattcgtgaagttagaaaaggttatacctgcttctgattattaatccgagttttggagtatttatttatttatttatttaagatggagtcttgctctgttgccccggctggagtacagtggcacagtcttggctcactgcaacctctgcctactgggttcaaatgattctcctgcctcagcctccggagtagctgggattacaggtgagccccaccacacctggctaatttttgtatttttggtagagatgaggtttcgccatgttggccaggctggtctggaactcctaacctcaggtgatttgcccgcctcaggctcccaaagggctgggattacaggcgtaagccaccacacccggccccagagtattatgggataaccttacttcagggtcttactacccaaaaatgtgactagatttgtatgaaataaagtatttttggttgggtgcggtggctcacgcccataatcccagcacttttaggaggccgagacgggcaggtctcttcaggaaaggagttcgagaccagcctaggcaacacggtgaaaccccatctctactaaaaatacaaaaaaaaaaaagctgggcgaggcatggtggcgcgtgcctgtaatcccagctactcaggaggctgaggcaagagaatcccttaaaccctggaggcagaggttgcagtgagccaagatcgtgccactgcactccagcatgggtgacagagcgagactagtctcaaaaaaaaaaaaaaagcaattttcttggagatcaactcattttgtaatttccattttgtggtgtaaccattctccttcaagttagggttagtaacacaagtaactacctcaggcggaagtacccatgccaggttctcaaatcttaggctgaattagtacatgaaaaaggcatgcagtagtagaattctatagttaagcaacagctgcagaatatcactgcatccagtactagaaacaagagaggggaaattttcagcaactgaaagcatgtcacattccaaagcctctctttaaaatatagaaaaaactatacttaaaggtgtcttcagtcacaatctctcactgaattgcttcattatctaacaacttcatcaaaaactttgtgtggttccaccactttctgtaaccaagaggtgaaaggctttgaattttttaaagataatacctgcaaaaaattatattaatttcagtaaataatacctttagttgaaaatacttcaatattttccatctctcaggaagcagagttcaataattaaaataccttttcaatattaaactgtaaagcaatcatgaaaacattactaattatacttgtgccttgaatataaaattccagttgtctacatatgaaacattttaaaaatcacttaccgtagagaaaccaaaaagaagagagcagaaaaaaactattgtttcaagtttgattttgctctagtaaacatttaagtattatgtatatttccatttatattatcaagattcagaagataaacatacagtataattggagaactttggattcactttagaaaaaactattgatatacaatagtcttataatcactttaataaaccacagataatacaagtataggtaataaacttattacttcaaatcaaactgcagaaagtactggttcaatttgcaaccccaaaaggaaaattaagagaatacaaattttttttctgccttttggacaagaagttaataaagaaggccgggtgtggtggctcacgcccgtaatcccaacactttggaagaatgaggctggtggatcacctgaggtcagggagttcgagaccggcctgaccaacatggcgaaacctcatctctactaaaaatacaaaattagctgggcgtggtggcacatgcctgtaatcccagctactcgggaggctgaggcaggagaatctcttgaacccaggaagtggaggttgtggtgagccgagatcgcgccattgccctccagcctgggcaatgagagcgaaattctgtctcaaaaaaaaaaaaaagttaagaaagaagatgatgagttaaaactattaaattgtaatgccagctgggagcagtggctcatgcctgtaatcccagtactttgggaggctgaggcaggcagatcatgaggtcaggagatcgagaccatcctggccaacatggtgaaaccctgtctctactaaaatacaaaaaattagccaggcatggtggtgcatgcctgtagtcccagctactcaggaggctaagacaggggaatcgcttgaacccgggaggcagaggttgcagtgagtcgagatggcgccattgcactccagcatggcgatagagcaagattccatctcaaaaaataaataaataaattgtaatgccttatatcacatccaagtatttaaatcagttaactttcaagctgttagtttttaaaaagaccttcaaagccgctaatggtattgttgaaaaagtgaatgctatacactgaaactaatcattataacaaatcttcaatttatttgaagcaattcagtttcaaaaactttaagttacagcagtcacagaaaaaaacagggaacagtcaaaaacaataaaagaataatcaggagtactgcaaatttttttgtttgtttttaacactgtcatggctttattcaaaacacagttgcacaaaagtattaacttcaaagtttttaaggagattcttgaggaacttaacacaatatatacatactgccatacaaagagcattaaaataggaccgaaaacttctacaaaatataaaacccacccttacttatttgcatgaaaataccacccacaaagctaaataagtcttaaaagttatctggaggctctaagtgttgttttcaaaccaaagtactctaattttgattgcacagtaagatgattgataagaaagtcaatatatagatttcattttaaaaataagtattttgtaatctggcatagtatgtaatgagaattgttaggaactagaacagggaatttcagtttttaaaagcagaagaaaaatgttatctttttggggattccaatcccctcactaaacttatccccaagggttttctttcggtcagttgtacaacatttttagtttctccacaagtaacatcataatttttactttaaaacaccaagtcatacattttacattgtagaagcagtagcagcagtactatactcagtatttaaatatgtcccagtatagaagcataacttcaattaatttgctgacactaacttcttaaaaacttacaaatattcaaaacaaagggaaaaaattttagatagccaagatttaaaaagccattgccttgaacatggagcctccatagcaaaagaggagatatacttgtatactcattatattttatttagtagccatgtaaggaaacacacactcacttatcccaaatatttttctacttttaatggacatccacttgaaaacaaatcttaattttaatgtcaatttagtttcaaatacttttccagctgcctagtatattccaattaaatgctattattatatctgttttaaaactgggaattaaaggttagaaatactttgcagagtggtatccaaatcatttgagaggccaacattaaaatttgactttaatgtcttattaatatatcaacaggcaattgttccgacttttgaggaacactaacactgcttccaaaagcacccctgcttttctttcttcatcccactaatattgtcttagatgttgtcaaccaagaaacatttatggtaaggagagcttactgcataaaactgtattgataatatattcttatgtcagaaaatactcaatttcttctacttcacttatttaaaacccagacaggactgaaaggtagttgaggtataagactaaaggttttcctgggtttcacaagtttcccaagttccttttgagagagcgggagggagtgaaacaagaagggaaggtgatcataaaggaattgctaagaagaaaaagaatgcacacctaaaaacaaaataaacaaccatcggcatgtcatgatttgcagcctgacaaaagggctcacctgcatgtctctggacttagtataagcaatttttccttcaaaaataaaatcttatcagtcaccactaaatccatgaaccatattactgaatagaacctccacaaaatccatgaactatgttgctgaatagaacctttactattctgcttctattttccaagttacttgtgacaaaaaagcaaccaaacactcttagtcaaaaaaaaaaaaaaaaaaaaaaggtaactgccttcaaactaaagattcctggatcacctctaaaaaaataaccaacttaccactcaagagactattgtcattttatattatagcaaactgtaatttcagttaatttataaataaggaatgaaatgcaccatactacacctgtgtaaaagtgatcatgttttaattatgggctaaaaatgactaatacagtaagcttgaatttaaaaaattaagtctaaataaattgctagggaattccacaatgggagtcaatgaaaatttttctctacatacaatatgatcattaacagactagttcttatttggaatgataaggcaaaaatagtaaaaccacacttttcctataaaaagttacacattatcttctgtagggatagctatcgtacatgaagaaacaaagatgtgatcactctattgcacacccagaaacattagagaatctggtcttagaatgatctagtcatcttcttcctctccatcgtcttcagcatctcgtttcctcttctcccctcgaagacctccttcttcttaaagagtggaaagaaaaatgcaaagtgcttaattttaacaaatgaggattggttacatttttgaatcttagtgaaaagttaatggcaaggcctagcacggtggctcacacctgtaatcccagcactttgggaggctgaggtggatggatcacttgaggcctggccaacaaggtgaaaccccatctctactaaaaatacaaaaaattagccaggcatggtggcgggtgcctgtaatcccagctactccagaggctaaggaagaattccatgaacctggaaggcagaggttccagtgagccaagattgcgccactgcactccagcctgggcaaccgagcaaaactttgtctccaaaaaaaaaaaaaaaaaaaaacgttaatggcagaagaaaattggccaggtaaggtggctcacgccagtaattccaataccttgggaggccgagccaggcggatcacttaaggtcaggagttggagaccagcctggccaatagggtaaaccccccatctctactaaaaatataaaaatcagctgggtatggtggcaggtgcctgtagtcccagccacctgggaggctggggcaggagaattgtttgaacccaggaggcagaggctgcagtgagccgagattgcaccactgcactccagtctgggcgacagagcaagactgtctcaaaagagggagggagggcaggctaagagaggaagagaggaagagaggaaggaagggagggagggagggagggaggaaaggaaggagagtgggaggaagggagggagggagggagggagggaaggaaaggaaggagagtgggaggaagggagggagggagggagggagggaaggaaggaaggaaggaaggaaggaaggaaggaaggaaggaaggaaattatacttcaagtttcctctctgaatttctttaaatttgagaaggttgaaaacagacttaacaggcttagaaatccataattacagtttgctatgcacccttgtggccatatcatgaagtacagattaagaaaccaagggcttgacatcaatgcaattgttagtaaattttaaaaattattttgaggctgggtgcagtggctcacatttataatcctagcactttgccaaggcaagaggatcagttgggcccaggagttcaagaccagcccgggcaacagtgagaccccgtctatacaaaaaatacaaaaattagcaaggtgtggtggtgggcacctgtagtctcagctactttggaagaggctgaggtgggaggattgcttaagcctgggaggtcgaggctgcagtgacctatgattgccacactgcactcactgctgacagagaccctgtctcaaaacaataaaatgaaataaaataaaataaaataaaataaaataaaataaaataggccgggtgcggtggctcacgcctataatcccagcactttgggaggctgaggcaggcggatcacgaggtcaggagatcgagagcaaccttgctaacacggtgaaaccccgtctctactaaaaatacaaaaaattagccaggcgtggtggcggcgcctatagtcccagctactcgggaggctgaggcaggagaatggcgtgaacccgggaggcagagcttgcagtgaactgagatcgggccactgtactccagcctgggcaacagagcgagactccatctcaaaaaaataaataaataaataaaataaaataaaataaaataaaataaaaatattggttggccatggtggctcacatctacaatcccagcactttgggagggtggggtgggcagatcgtttgaacccagagttcaacaaagcctgggcaatatggcgaaaccccatctctaaaaaaaaaacatacagaaattagctgggcatgatggtgtgtgcctgtggtcccagctacttgggaggctgagatggggggatcacctgagcccaaggagattgagactgcagtgagctgtgattgcatcactgtactcgcctgggtaacaaagtaagaccctgtttcaaacaaacaaacaaaaatatatatatatataaatttttaaaggcctggaaaacaaatctaaaaagagcattaattatctggagttcaactgctcctctcttataagataaggcttcactctgtccaaaatgagactctataaaaataataaattgagctcaaggttccattcatctcttcatttgtttttaaaataaatgttataagctgtttatgagttatgaattaatgagtgccctaagacaattactcttaaaaaaaaaacttttataactttgaaggcactctatgataaagcaaaatcaaagggatcagtaaaaattggcattataggctcattctttaaagtgtatgaaatacaaataaataaagtataaaaaatgactatgtctttaattttataatttgtttatggctaatgtaactcaccctcttcttcctcttcttccccttcttcaacatagtcatcatcatcttcttcatccttgaaattcaaatattcagtttgaagattgaaaaatccatatgatttttcactctttcttgtaatatattccaacaagagcaaagaaactatggttattctgtgttttgacaacctctgccattcttataaaggtcctttttaaaacctaactaaagggccgggcgcggtggctcacgcctgtaatcccagtactttgggaggccaaggcgggcagatgacctgaggtcaggagttccagaccagcatggccaacatggtgaaaccctatctctactaaaaatacaaaaactagccgggcatggtggcaggcgcctgtaatcccagctactcgggaggctgacgcaggagaatcgcaagaacctcggaggcagaggttgcagtgagctgagatagcgccattgcactccagcctggcagaaaagagcaaggcttcatctcaaaaaaaaaaaaaaaaaaaaacctaactaaatctgtagtctttttttttctctttcctttttatttatttatttttttttttgagacagagtttcgctcttgttgcccaggctgaagtgcaatggcgtgatctcggctcaccgcaaactccgcctcccgggttcaagcgattctcctgcctcggcctcccgattagctgggattacaggcatgcgccaccacgcccagctaattttgtatttatagtagagacagggtttctccatgttggtcaggctggtctcaaactcccgacctcaagtgatccgcctgcctcagcctcccaaaatggtgagattacaggcgtgagccactgcacccggccaactgcctaattcctgtatcagaaatcattcttatacaatcagttgaaataaagcatctccataccagaataccagtaagctataaggagcgaaaggaatagatgagatagcaaaaagcataaaaaggaacacaatgaaaatcaggaaatactgcagactaaactgaagaaggagagacaagaaaaaaaggggaagactgaatgtggcttttgttgcagaatttgttcattaaaaaaggaaaaggtggggccaggtgcagcggctcacctgtaatcccagcactttgggaggctgaggtgcatggatcacctgaggtcaggagttcaagaccagcctggccaacacagtgaaaccctgtctctactaaaaatacaaaaaattagccaggtgtggtggtgggcacctgtaatcccagctactcaggagagtgaggcaggagaatcgcttgcactcaagaggcagaggtagcagtgaaccgagatcacaccacccactccagcctgggcgacaagaacgaaactccgtctcaaaaaagaaaaaaaaaagaacacttaaagttctgttcttcattatatatagctcctaactcgccaagaccccaaatgaatataaatcctattttttccatactagtttcatcagcaaatatgtgtcattgatcgtttatattatgtatctaaccaatgcaaaactcattgaaacaaatattagcaacttccagtctaaataagagatgttatttttaataataaaaaatactttaaattatgagtttttaaaataaacttcaatttaacattaggagaaaataactaacctaaactcccaggggctgtagataacttgttctagtcaactgacatttcccatgagcctaccatgtaccagtcagtgtactagatgctgagatacaaaggtgagtggcactccccttaaggagctcaccacttagcaggaagtggccaaattattttacaagtgtctgtaggcaatagaattctgatcacgattcagaggtaacagatggaggagtgactgcctaagaaaaaatatagagagcttcaatgatgaggcaactgaagagttgggtttgtaaagataagaattcacaaagcatgatttgggtggtggttgcacaagtacatgcatatgtaaaattccatggagttgtaaataaaatcagtgcacttcacaagcttcactcagcaaaaaacaaaaagttcatcagaggctcatttcagatagagtgaacaacatattcatacacagccataaaggtaaaatagtttggtgtgatcatttaatttggaatcaagggagatgaagctggaggagaaagcaggggccgggcacagtggctcacacctgtaatcccagcactgtgggatgccaaggtgggcggataatttgaggtcaggagttcaagaccagcctggccaacatggtgaaaccctgtctctacaaaaaaatacaaaaattaaccaggcgtggtggagtgtgcctgtagtcccagctacttgggaggctgaggtgagaggattgcttgagcctgggaggcagaggttgcagtgagtcaagatcgcaccactgcactccagcctgggcaacagagtgagactgtcaaaaaaaaaaaaaaaaaaaaaaaaaaaagcagaaggaagcaaaggccagaaatgaaaggccttgtatgtcttgggggcaagagggaaacattaaagggtttcaagaaggctgatgtataatcacatttgcattagactaaacaggcagcactgtggagaatactcctaagtggtgatgctgtattcagacagactatttagaaagctactacaaaagtataagcaagagataattaggagaaagaaacttaagttttcttgagtgcctataatgtgccagggactatattctttacatagattaccttgttaaatccttaatcctatgaggttgatataacctgtttttttttttttttttgagacagagtcttgctccgttgcccaggctggagtgcagaggcacgatctcagctcactgcaatctccgcctcctgagttcaagtgattctcagcctcagtctcacgattagctgggactacaggtgtgtgccatcatgcccagctaatttttgtatttttagtagatacggggtttccccactcatgttggtcaggctggtctcgaactcctgacctcatgatccacttgcctcagcctccaaaagtactgggattacaggtgtgagccaccatgcccggcctaatctgttttataaatgcagaaattgaggttcacagacatttgtaaaatgtttccaccataccatgccattgaggctgtaacagatttgaaagttatctgggaggtaaaatcaataggtgtttatgattatctggatatagtttggggtggaggacaatgaaaaaaaagacaggtggatagacatatgcacacccacaacttagaaacaactctcagattgctacaaaacacactttatatagtacttactcctatgcctagaaattaattttcagtgcaggtaagaagtgtgtattcacctgaatttcttctttcattaagtatgagaggcccacttcctcttctccctctcccaactctgaacctgcttcatcttcatcttcatcctcatcctcatcctcctcttcctcttcctcctcctcttcctcatatccttccggtggaccagcttcattttcctcttcctcttcatcatcttcatcgccatctttaaaaaatcatttaaagatgagtaaatgactgggtaaatgtttcttcctaggatgttgatgctttttacccttgcccaatcacttcaaacttgtaagccaataggtggaaagtaactcacagcgatacttttttttttttaagatttctgtttcacaacattcctagttattcctacaaaccaaatgcgagaagtatggcttctaaatactggtatccaatatatatctagattctcatgaaaatattgcatgcactaaagtttgttttactttgtgaacacttcaaaactttgcttgtgagatgttggagaggctgcagagaaaagggaatgcttgtacactgttggtgggaatgtaaattagttcagccactatgaaaagcagtttggaaatttctcaaagaactaaaatacaactaccattcgacccagcaatcccattactgggtatatacccaaaggaaagtaaatcattctaccaaaaagacacatgcacttgtatgttcaccacagcactattcacaatatcaaagacatggaaccaacctaggtgcccatcaatggtggactggataaagaaaatgtagaacatacacatgatggaatactacacagccataaagaaagaatgaaatcatgtcctttgcagcaacatagatgcagctggggaccatcatcctaagtggattaatgcagaaacaaaaaaccaaatactgcatgctcactcttacaagcaggagttaaacactggggacacagggacataaagatgggaacagacactggaaacttcaaaagaggggaaggagggtggctgaagaactacctattaggcactatgttcactatttgggtgagaggatcagtagaagaccaaacctcagcatcatgcaatacacccatggaataaacttgcacacgtacccccttaatctaaaataaaaaataaacctgcttatctatcatttcatcattttataacagtatttatccatcaaatttctttttacgatgaagaagttttcactcaataataatgagcagtatcctattactaacagctattctgtcatctgatctgttagtcatccacttacctaaaactgtatgctcacaatatacttctagattatttttcatccctcaaaaagaaatcccatacccataggcagtcactctcccattttcgtctcccccagcatcaagcaaccaataatctactttctgtctcaatggatttgcctatcctgaagtttctgcctattctgaaccatatatatattatatatatatatatggttttttgtttgcttttttgttttgtttttgagacagagtctaactctgtcgcccaggctacagtgcagtgacacgatctcagctcactgcaaccttcgcctcccaggttcaagcaattctgcctcggcttcccatgaactttccatataaatgaagtcaaacaacacatggtcttttgtgtctctcttctttcacgtagaagaacattttcaaggttcattcatgtggcatgtatcactacttcattcatattaatggtgatataatattgcactgtatagataaaccacatttctaaaatctgttcatcgggccggggcgtggtggctcacgctggtaatcccagcactttaggaggctgaggcaggtggatcacgaggtcagcagttcgagaccagcctgaccaacatggtgaaacctcgtctctactaaaaatacaaaaaaattagctgggagtggtggcgggcacctgtaatcccagcaacttgggaggctgaggcaggagaactgcttgaaaccagaaggcagaggttgcagtgagccgagattgtgccactgcactctagcctgggcaataagagcaaaactccctctcaacataaaaaaaaaaaaaaaaattccgttcatcagttgatagacacttgggttgtttctactttctggctattataagtggttgcttttttaaaaaaatactatttaagaggttgccacttttactgggtgtacaactttctacagatataaaatttcacagagcttcatgttataatagtcattaaattccctgaaactatgggaaatctgaaagaagaaatactggctagagctatgggtttttaattttttcttgtcttactaatatcttgttgtggattttttttttcacacctaaatttccaggcccaatctaatttgcacagctacagcagaggctataattatgacacacttatgagtattaagaacgattaccctcatcatcctcctcttcagagtccggcgcttcattatcctcctgatcaaatccatctaagtatgtgatttgctgcagtagttcaaaaatactttctctataatcttccaggtttgtgatctcacagttaaacaggtcaagacttttcaaatttttaagattttgctggaaaagtaaagttaaaacttacattcaagatttaaaataccatgttatttcttttttctttttttttttttttttttttgagacggagtctagctctgttgccagctggaattcagcgccacgatctctgctcactgcaacctccgcctcccgggttcaagcgattctcttgcctcagcctcccgagtagctgggactacaggtgcgcaccaccatgccccgctaatttttgtgtttttgttttgttctgttttgttgagacggactttttgctcttgttgcccaggctggagtgcaatggcatgatctcagctcaccacacctccgcctcccgggttcaagcgattctcctgcctcagcctcccgagtcgctgggattacaggcatgcgcctccacacgcagctaattttgtatttttattagagacagggtttctccacattggtcaggctggtctcgaactcctgacctcaggtgatctgcctgcctcggcctcccaaggtgctaggattacaggcgtgagccaccgcgcccggcctaatttttgtatttttagtagagacgggcttttaccatgttggccaggatggcctcaatctcctgacctcatgatcggctcacctcggcctcccaaagtgctgggattacaggcgcaagccaccgtgcccgaccacatcatttctttttaatttatgatccagaaaatatatatttgaaattgagaatgatttttgtatttttcgagttttataatgaagggttattatatcaagcacaaccagctcacctggctaatttttattttttattttttatttttgtagagacagggtctcactatgttgcccaggttggtctcaaactcctggactcaagcgatcctcccacctctgcctctccaagtgctgggattacagacataaaccactgtgcccagcctccaatcttttttcaaaatcagagcaataattttcagcatgtcagtttttcttttccttccctcaaaccaggaaagaaggggacaaataataaaaaactcaaaaaataatcaagaagcaaagaaaaagaatgaaagaaggttaaaaaaaaatactggaaatgttaaaaccagatagtcaactcctgaagttgatgataaaataaatttctcattgatttaaaaattcatctgaatattttagtctaaaagaaacaaaagcagtaactgcctagatcacaacatacaaaaaattcttaagttttaagagttaaatagaaattaatagacacaaacaaatctcagaaaatttaaccaaaaaaagcaagtccagagacaaaactgttccacttaccagagcttctactgtactgagatcttttattttgtttccactcagattgaggtaggtaagatttggacatttctctgccaggacttccaagcctccagaaattatattatcactaagctccaactatacattcaacaaaggaaaaaaacaaagaatggtaaaggtatcatatcaaactttttttttttttttgaaatgtagtctcactctgtcgcccaggctggagtgcagtggtgcgatctccactcactgcaacctccgcctcctgggttcaagcaaattctcctgcctcagcctcccaagtagctgggattacaggtgcccaccaccacacccagctaacttttgtatttttggtacagatggggtttcaccatgttagccaggctggtctcgaactcctgacctcaggtgatccacccgcctcggcctcccaaagtgctgggattacaggcatgaaccactgagcctggcatatcaaagatttttaaagtatatcaatttgaagaaaaaaaactgtcattctctctggcttcaagaaactatcacgacagatcattaatttccaaattcctttctacatctgccaaataatgtattagaacacctacataatgggctcttaacccagcttggattctagttgtactacatttggatttcatgatgtagagaaaaatatttggtatatattaaatccaaattcatattataaggcaattccactattagatttacatttctagaccgggcacagaggctcactcctttaatcccagcactgtgggaggccgaggcaggaggatgaccggagcccaggaatttgaaaccagtctggacaacatggtgaaaccctatctctgcaaaaaatacaaaaattagccaggtgtggtggcgcatgcctgtagtctcagctactcgggaggctgaggtgggaggatgcttgagctcgggaggcagaggttgcaatgagccaagatcttgccacggcactccagcctggcaagaccctgtctcaaaaataaataaataaataaatttataaaagcagtattagagcttattctcaaaatcctatataactttttcttatctctagaaacttaaaaacttctaattaacaagcagaatggtcattccatttggccaaacactagacatatagccgtggcattgaaatcatgatgcttcacgtaaatgccaacttacttttcgaagtttatttaagctgggaagccgggccagcgaacttagttccacattagccatactcagaaattctagttctttgaaagtatcattcaggccttcaatttccccattgacacacaggcaattatcaaggactaactctgtcacctgtaagagggaaaacattaattaatgattctttagtttgtaatctgtttaggtagagacctgggtcttgacactctggaaatgtattaaaaccaccaatctccagtttgattgcccgtcagttaaaacaaaatacggccgggcgcggtggctcacgcctgtaatcccagcactttcggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagggagactccgtctcaaaaaaaaaaaaaaaaaaaatacaacacaacagaaaccccaccaatccccttacacggatccttttcatttccccccaaaactgatatacaatctaaagtcatcactataagtaatcttttaaatttcttttttttctttttttttttttttgagatggagtcttgctctgttacccaggctggagtgcaatggcacgatctcggctcactgtaacctctgcctcctgggtccaagcaattctcctgtctcagcctctggagtagctgggattacaggcgtatgccaccactcccggctaatttttttgtatttttagtagagacagggttttgccatgttggccaggctagtcttgaactcctgacctcaggtgattcgcccccctcagcctcccaaagtgctgggattacagggatgagccaccttgcctggccattttttaaatttaaacttggactaaagttcaatgcctgcttcaaatcactgatgcataagaaacaaactttgaagaagttcccatgtgaaacctgtttctgaccctgataaggaggaccctcaacatcagataatatatttatgcaaggagcgagtacctgagctaccaggaaaagattcaagtgagctgccctaaaacctacaaagagtgccaggctcgggggctcacgcctgtaatcccagcactttgggaagctgaggcaggtggatcacttgaggttaggagatcaagacaagcctggccaacatagtgaaaccccgtccctactaaaaatacaaaaatcagccgggcgtgatggtgggcacctgtaatgccagctactcgggaagttgaggcaggagaatcacttgaacccgggcagcagaggttgcagtgagccgaggccgcaccattgcactccagcttgggcaacagatagagactctatctcaaaaaaaaaaaaaaaaaaaaaaaacctacaaagagaagaaactgtttaatcactttttcagtttaaacctccttctctttggttgataaaaccatcataactcaaaaaatcctccttaccctttatgaagaaacgttagaaagctcttctgggaacagcccagagggtgttattggttctcacatccaggccaaacggtatcacccagaacaatacattcttaacaaaatgttacttctccctaccactctggtataatagcatttctgtgcacttttccccattcctcaaggagtggggctgaattccctattaggtaagagttgtagtaacaaacttcctggtgtgggcctgaatggacttaatctttaagggaaaggttgaagatcctggttctctatacccaatgtgaaaacctgtttgaggtatccgagggctaaaatttggcaacaaggaatgccaccttctctatttgaatatgattttgacataattatttctgtggccagaaagagcatcttgagctccgttttggagaagaggaaactatggcccagagatgaagaatggcttgcctagagtcacagttggtttgccgaaggactgtgaattggttctgtcttcagactccccgtttagctgaggagtgggggctactagatttggtgtcagaaaaccagttcctccacttctgtaaatcatttcactgccctgagactgtctgctaatttggattctagaacaacacaatccaccttacaagtacgtaaggaggaaagtaaataacaaacgggtaaagtgctttgtaaactgtctatacaaatataagagaccgttattacaacacagcggaagaagttgaaaaaaggcaacgtcttgcacaccccaaaactggcaaagaaattactacaatcactaagtgaaagaatcctggcgggggaggcgggggcgggattcaattttccaacccaagccaccaaaaagtattctaaacgtgtgcttgtgagagacagcttttaaagtttgattttggttttttttatttttttcctgaagcctctaagaataagctctagaaacttcaagttatctccgggatgaccctgatagcaagcaactgtttcctctccctggcccctgccaatttcagaaaacaggcacttaaaaaaaaaaaaaaaaaatcttagttgccactccacacgccggacgcgaaagcccagacagaccctgctcatcctctatgccgatctgcacagacaccaccccagttatatccttctatcgatcggtcgattcagctacagacaactcccttacgttccaattctaggcttatttcagcaagactgatgctttcctctgcgaggctccccgctggccaccagccctgctctcgcgacctgccgctccgactgacgggaaaccccacacggggcggggactccccaaggaaaaaacgggtcgcctcccaacccgcgttgtcctcgcgccttcgccctgggtaggtgaggccgagaaggcaaccgcgaaaaggaggcggaaacgcctcctacccgacccccgaaaagttgaccgcgaccccgcctcacatggcccctcccaaccccgtctctttaaggcgacagcagtgagagcgcatcatttagtttcggcgaacccatctttaaagcacgaaactactacgtcccttatgttgagttttgtgaaaccgtctccagggatcaaattcagagttgcggccacacgacgtgccacatatcgttacacggcgggggaagaagcggattacgcctcccgtcccctctccacctccggtcactgcgacgagtccccaaactcgcccgcggtcggagaacccgccgctgacccagattccgccgggcgaagggcagagggcggcgcgcgcggcttcccggaggagtgggcgccgccggagcagacagtgcgcggaccctgcaagcgaccccagcccgcgcccgtcgcgacgtcggacgcccagggcctcgaggccggggaagcccaccccctaaaaagatgagttggccgcactgcagaaaagttggactaacttctcaggcgcctatggctgcggcaggggctgagtgggactggggggtcgcgcccacgccgccggcccccaggaggaggagtgccgggagcgaagcggcggagcgcccccaccagcccgcttcccgcccccacgaggtcaggacgcccgactcgatgaaagccgaaaggagctaagcccccatgcacacacaaaaacgcccctagaaacttcaacccttcgccattttaagtagaagattttaatgatttaaaacttaaaattaaacatttccccaaccctaacccggggggatgggggctaacttattactccatccccgcacacccacccaggaccaccagaaatccgatcctcagaatactggactgatggggaagcggtgggggctgagtcatctcacctcctccggggatctgttccttaactccaggttaatcttcttcttcatctccatgtcctcctcttgctcttcagctactactctccttttccctttcctgccttccccaatacccccaacccaaaatttttaagagatttagaaatgaatgaaaaggaacgcaaatataaacgcccactaccaccaccagataggtgtgggggagaaagaagagaatagcaaatggagtccaagagttgggactctaactcagctgcccccacctccttgtccacacactagcgcgcgcacacacacgcacgcacgcgcgcacacacatacacacacacatacacacacacacccgcagttccttccccttcaatggctgctcagagactgagcctccatgacacggcaccgccaaccccctggcctacactccacccacctcccaaacgtgttggttgattcttcagcgtcacattacttcattgggctaggtaaaggtctatcagtcttcagggaggccctggaccagaaattccgtacctattggctacgatcaagcgcgcagttaattttgataggtccaggagggtgtacgtcccggagaaatgattttgaatcccagtaccccccctacttttctttatgtagttggcgcgctttccctaggcactcggacagtttcgttgtctgttggatttggtttttagtttttggttttttattctgttgttagtgttaaagagggagaaagcatccttccgtgcccaacttgcgatactgagaattcaccacacggcacgcactggctcttggccgttttaaaagcatagcctctgctttgcaaccaaggtgtacagcaacgtgcgcatcacattaaaaagatgccttcgtggcattgtcctgctggggtcaggctcttcacagagactgaccttccgtgatgcagagctagagccgagattttaaagatggtaggttaacaccataaaagacaacaattttgaaagcagttgggtgaaagcagtatgtaagttagtaatatttaaataaaactatcctggaggaattgttactgagttaattgttgctgtaataaacactaagaccttggaggaaaaacgacgctgtcctaatgaaaatcagacattaattagcatagaaatggcaccgcgatgccgctctaatttccctttggttggtttccatggaaatctgtaggtaaagtgtgcttttaaaagtgtttatcgcttctctgccttttggctaagatcaagtgtaggatctgttcttaacagtttaatatctgatatattttctatccgagtccaatatattaaatggatttggggagcaggaagacggaataggagcttgcttgttcacttcacgcatcgatctggtattgcagtacctccaggaacagtgcaccccctcaggggattaaaatttaatgttcaaaacagaagaaggaaaaaaaaacagtctgtctatgtgggatgggatacaaaagagtgggataagaattatcttttggccgggcgtggtggctcccacctgtaatcccagcactttggaaggccaaggcggttggatcacctgaggtcaggagttggagaccagcctgactaacatggtgaaacctcgtctctacaaaaaatacaaaatattagccgggtgtggtggcgtgcgcctgtaatcccagctactccagaggctgaaacaggagaattgcttgaacccgggaggcggaggttgcggtgaaccgaaatcgtgctattgcactccagcctagacagcaaaagcgaaaccctgtctcaaaaataaaaagaattatcttttaaaattttgtctcgacggtctaacttttttcttagctcttgcttaaattatatcattcttattcccttacaccattctcaggataaataaccaaataaattccaaatgatttggggaaggaagtggaaagtgggggaattagtcccatgcctcccagaactggttgctatttttcctgtttctcaggttagagatctttggctttccaacacagactcctcacaactccaccttccctactccaccccactcagagacacactgctcctcaaagaggattacatttaaaatgtaaatgctgacccggcgcggtggctaacgcctgtaatcccagcactttgggaggccaaggcgggtggtcacctgaggtcaggagttcgagaccatcctggccaacatcgtgacaccccatctctactaaacatacaaaaattagtgggacgcggtggcgcgcgcccgtaaccccggctagaatcgcttaaacccaggagcgggagattgcaatgagcctgagcgacagagtgagccgagatggcgccaccgcactccaacctgggcgacaaagtgagactctgtctcaaaataaataaataaataaataaaatcccatagggcatgtacataagattctcaggcaaaggagagcaaaacatggttgaaggggaaaagagaagagggagggactgtctaccaaagtcctcaatgaaactgaggagtaggtagagaaggaaaaaaatgtatggaagccaaagaagagatggaagagattattaatggtagggtttcaaataaaagatgatgattgggattaaattgtatcctggaaataatcaatgtgaagaaaggccatgaactcattttaccattgaatagtggctgcagaaagtacgccatagggccgggcacggtggctcacgcctgtaatcccagcactctgggaggctgaggcgggtgtatcatgaggtcaggagatcgagaccatcctggctaacacgatgaaaccccgtctctactaaaaatacaaaaaaattagccgggcgtggtagcgggcgcctgtagtcccagctactcaggaggctgaggcaggagaatggcgtgaacccgggaagcggagcttgcagtgagccgagatcgcgccactgcactccagcctgggagacgagcgagactccgtctcaaagaaaaaaaaaaaagagtgaaatttagtcaggagaaaagccaaagccaaacacatgtaccagatcagatcactctttatttaagctgaagtaattaggtagggtttaaatggcaaaatgaaaagtgaggttaagtaaccaagttaaggtggggcacggtggctctcgcctgtaatcccagcactttgggaggctgaggtgggcaaaccacttgaggccaggagtttgagaccagcttgaccaacatggtgaaaccccatctctactaaaaatacaaaaattagccgggcttggtgtcatatgcctataatcccagctatctgggaggctgaggcacaaaaatcacttgaacccaagaggtggaggttgcagtgagccaagatcatgatattgcactccagcctgggcaacaaagcaagattctgtctcaaaaaaaaacaaacaaaaaacaaaacaaaaaaaaacaagttaagtggagcaggcgagagagtgattcagaaactcctttaatccaccagtaagaaagctccctcaagatatttattattattatcattttttttttttttttttgagacagaatctccttctgtcgcccaggctggagtgcagtggcgccatctcagctcactgcaagctccacctcccaggttcacaccattcccctgcctcagcctcctgagtagctgggactacaggcgcccgccaccaagcccggctaattttttgtatttttagtagagacggggggtttcaccgtgttagccaggatgatctcgatctcctgatctcgtgatccgcccgcctcggcctcccaaagtgctgggattacaggcttgagccaccacgcctggcccctcaggatattattaaattcaacatgcctttaacattcaaaatccaagctcatctactgctgctgaatatcttgtttgcacttctagatctactcttcacgcttctccaccctgctctgtaacccagaacctatatggactgcgtgaagtcctgtggcttcctggacttggtcctgataggaaatcaagtcaggaggaaagtgaggttggacatttattccccagcttcctctctgccaggtccatacaaaatggctgagtccctctaaggaaagccatagatggtgtcagaactgtggtggacactgtgatgtaccacccagcttttccttcaggaatgaggaacttgttcctgtagctgctgggagtactactggaagatgaccctaaactgtcagcccttttaggggattgcctggctcaagattacctcactcaaggttatacctccttttggggaagcctgaatccaacgagtgattaacacagaggtgtaaaggaccagcctgcccttttgcccagttttagacaaactcagaagggtcatcccagctccagagcaccctgttggggtcagctgaggccttcgttaggatggcattgccattcagtttctctctctacttcatcctgcttctttcttcttcctcccacaggtaatggtcccaatatcactcaacaacaaatgtcccaacatctcagtctgcttcctggggacatgtgacagtggctctctccaaatacctaccctctgagaacgcccaaactaacctataaaagcaatcacctagagaagccttgagaccatgtgaagagagtgacaggtgcccagccagcccccagcttcttcaacccccatttccagttgcagccaccatctgacctcatgagagatcctgagtcagaaccagccagctcagcctttcccaaactcctgtgtcacagaaatcaccagaaataataaaataatcattattcttttaaatatctaaatttggggttgttaggtagcaatagtaattggaacaacttcctagcacacatttttctgatcaaatctcactagtgcaccgggcacagtggctcacgcctgtaatcctagtactttgggaggctgaggtgggcagattacttgaggtcaggagttcgaaaccagcctggccaacatggtgaaaccttgtctctactaaaaatacaaaaacttagacgggcgttgtggtggacacctgtaatcccagctacctgggaggctgaaacaggagaattgcttgaacccaggaggcagaggttgtggtgagccgagatcgtgccattgcactccagcctgggtgacagagtgagactccatctcaaaaaaaaaacaaaaaacaaacaaacaaacaaaatctcactagtgccctttttgttctgtgatgacaggtgatagtcattctgctccttttagttttgcttatgctattttctaccttaaacaaaacaaattccctcctctgaattctcagcacttattaaatgttctactcatttagcatttaccctatgatgccttgcaacatctcatatatgtttgtgtgtgtgcgtgtttttttgtttttttttttttgagacagagctcactccattgcccaggctagaagtaagtggcgagatcttggctcactgcaacctccgcctcccgggctcaagcaactctcctgcctcagcctcctgagtagctgggactacagctgtgcactaccacacctggctaatttttgtatttttagtagagatggggtttcaccatgttagccaggctggtcttgaactcctgacctcaggtgatccacccacttcggcctcccaaagtgctgggattacaggggtgaggcactatgcccggtctcatatatgttatttaactctgattgctcccaactagattggaatttcctacagggaaattaagtcagttaacttggctttctctggcatcactcataggagtgggcacagtgctgagcacagagtgggtatttaagacagttttaataattgattatacctcaaataagtctcagctagtagtttaaattcatacttctttttttttttgacagagtctcgctctgtagccaggctggagtgcagtggcacgatctcagcccactgcaacctccgactccctggttcaagcgattctcctgcctcagcctccggagtagctgagattacaggcacgtgccaccacgcccagctaatttttgtatttttagtagagatggggtttcaccatgttggccaggatggtcttgatctcctgacctcgtggtttgcccaccttggcctcccaaagtgctgggattacaggcgtgagccaccacgccctgcctttaaattcatacttctattaggaaataatttggttgatgctttcttggggaataggtgatggagtaggagttaagaataactacaagccaggtgcagtggctcacgcctgtaatcctagcactgtgggaggccgaggcgggcggatcacgaggtcaggagatcgagatcaccctggccaacatgatgaaaccccgtctctagtaaaactacaggaattatctgggtgtggtggcacgtgcctgtaatcccagctactcaggaggctgaggcaggagaaatgcttgaacctgggaggcagagattgcagtgagctgagactgcaccattgtacttcagcctgagtgacagagcaagcctctgtctaaaaaaaaaaaaaaaaaaaaaaagaatagctacagactgctgttctgctcttctcttaaccttttcactttcccttttccaaactagttaatttgcagtttaaagataaaggtaggccagtgcaactaatgcattttctccagagtttaaactcacttggaaccaccagaaatcattcccactcataccactaagaaatcctgtcccagaaaaccacccaacagggtcactactgctctccttagcactaggagagatgatcaatacccagagaacaccaataattctagatgcccactgtgctaatatgttttgagaaccttccaggtcaacaccttttaaggcaatgtaggtttttatatttgtacaggaccttagagttaggggatatatgtctatatatttatattctatctatagatctaaagtgagttacttttacaaaaaaaacaaaaacaaaaacaaaaaacactgaattttatgaggttaagtggtgtggtaaattgtctgcaaaagtagaaaaatagtcatcaacagtttctcccatccctgtgcacacaccacactccccccatcaggaggtggagtctgtttcttttccccttgaatctgggctagtcttatgacttgctttcaccaatagaatgtagtggaaataacactgtgccagttctgggcctattccttaagagacctggcagtttccgctttgctctttgggaagccatttctcatataaagaagtctaactaccctattggagagagtggccatgtatctttcattgtagatagaggccctgggaaatgagagattatgaagggagagagagcctagacatcctccagctgtcccagccaaccagtgcaggccccagccatgcaagtgaagttgacttggatcctccagccttttgtcaagctgcccagccaacaccatgtggagtagagacaggctattccactatgttctggccaaattaaagaatctttctctttttttttcttttttttttttttgagacagaattttgctcttgttgcccaggctagagtgcaacggcatgatctttgctcaccgcaacctccgcctcctgagttcaagcgattctcctgcctcaggctcctgagtagctgggatttcaggcatgcacaaccatgcctggctaattttgtattttttttagtagagatgggggtttctccatgttggtcaggctggtctcgaactcccaaactcaggtgatccacctgcctcggcttcccaaagcgctgggattacaggcgtgagccatcacgcctggcctaaagaattttgagtacagccagatgtgatggctcacacctataatcctagcactctgggaggccaaggtggccagatcacgaggtcagaagtttgagaccagcctgatcaagatgatgaaaccctgtctctactaaaaatacaaaaattagccgggcatggtggcacacacctgtaatcccagctactcaggaggctgaggcaggagaatcgcttgaacctgggaggcggaggttgcagtgagccgagactgcaccactgcactccatcatgggcaacacgagtgaaactccatctcaaaaagaaaaaaaaaaagaatcttgagtaaggccagatgtggtggctcacacctgtaatcctagcactttgggaggcagaggcaggcggatcgtttgagcacaagcgtttgagaccactgtaggcaacatggcaaaaatccatctctacaaaaaatacaaaaaattagccaggcatcgtggcatatacctgtagtctcagttacttgggaggctgaggtaggagaaccaactaagccatggaggtccaggctgcaatgagccaagatcatcccactgcactccagcctgggtgacagagtaagaccctgtctcaaacaaacaacaacaacagcaaaagaatattgaataaataaagcatagttgttgttttaaactactcatttttaaggttgtttattaattattaataagtaaacaatagcaataatagataactagaagataactaaaacaagaggtagtgattagtaatttgtaaatatgaaactcaaattcatttcctctatttcctctttttcgaagttcaactctttttccaaaggttaccaatagaatcctgtttaattcatgggtgcacaaaaagttctgctccctaaaatatcattcttattatttattgatgctcaaaatgccacaaatagatactcaatcttatgactcccattgagatacaaaaactccaggatgactaacaagtaaacttttttttttttttttttgagacagggtctggctctatcacccaggttggggtgcagtggtgggatctcagctcactgcaacctatacatcccaggctcaagttatcctcccacctcaactccccaagtagcagttatcctctcacctcaattccccaagtatctgggactacaggcatgcctggttagttttgggtttttttgtttttgtttttttgtatttttagtagagacagagtttcaccatgtcgcccaggctggtctcgaactcttgagctcaagtgatcctcccaccttggcctcccaaagtgctgagattacaggcgtgagccactgcaatcagcctagtaaacttgattaatctattaaacctttgttgaatatctttatcaaataatttttagaaaagattctgattggcagcatgaaaactataaaatgatcaaactaccctatattttccaggatttttcaagttttttctttaatttgggatcctcttctctgtagagattgtcagtaaatggtgaagagagaagattgcatattgttacggtaaactctttttttttttttttttttgagacagagtctctctctgtcgcccaggctggagtgcagtggcgcgatcccggctcactgcaagctccgtctcccgggttcacgccattctcctgcctcagcctcttgagtagctgggattacaagcgcccaccaccacgcccgactatttttttgtatttttagtagagatggggtgtcaacgtgttagccaggatggtcttgatctcctgacctcgtgatccgcccgcctcggcctcccaaagtgctgggattacaggcatgagccactgcgcccggccagtaaactcttgattactgccatgtgaatacaaaattctgcggaatatctgcaaaaatataaaattctaggttgagctttcccagtttgaatcacctctctacatgctaagggagtgagtgtaaacaagttctaacattagccaaagtcaaacaaaattagaagagtaagtctcctagaaacaaatccatattgcaatatcaaatagatatgatttagagattttggctgggtgcggtggctcacacctgtaatcccagcactttgggaggctgaggcgggtggatcacgaggtcaggagatcgagaccatccttgtcaatatggtaaaacctggtctctactaaaaatacaaaaattagctgggcatggtgtcacgtacctgtaatcccagctactcaggaggctgaggcaggagaattgcttgaacctgggaggtggaggttgcagtgagctgagtttgcccactgcattccagcctgggcaacaaagagagagactccatctcaaaaaataaaaatcaaaaaaatttacaaatttatcttacggcaactctttgtcatctgtgctactggataaacacagtaattctgtcacccaggctggagaacaatggcatgatattggcttactacaacctccgcctgctggttcaagcaattttcctgcctcagcctcctgagtagctgggactacaggagtgcaccatcacgcccagctaatttttgtattttgtttttgagacagagttttggtcttgttgcccaggctagagtgcaatggggcaatcttagctcactgcaatctctgcctcccagattcaagcgattctcctgcctcagcctcccaagtagctgggattacaggcatgcaccagcatgctcggctaatttttgtattttcagtagagacggggtttcctcatgttggccaggctggtctcaaactcctgacctcaagtgatccatccccctcagcctcccaaaatgttgagattataggcatgagccacggtgcccggccaaatttgtaattttggtaacaaggttaccttcaaaacataacttgaggctaggtccagtggctgacacctgtaatcacagcactttggaagcctgaggcagaggattgcttgagcccagaagttctaaaccagcctgtgcaatatagcaagatcctgtctctattaaaaaaaaaaaaaaaaaaaaaaaaaaaaaaaaaaaggtgggcgcggtggctcacacctgtaatcccagcattttgggaggtcgaggcgggtggatcacctgatgtcaggagttcgagaccagcctggccaacatggtgaaaccctgtctctactaaaaaaatacaaaaattagctgggtgtggtggcaggtgcctataatcccagctactcagcaggctgaggtaggagaatcgcttgaacctgggaggcggagattgcagtgagccaagatcgtgccattgtactgcagcctgggcaacaagagcgaaactccatctcaaattaaaaaaaaaaaaaaaaaaaaaaaaaggccaagcatagtggctcacacctgtaatctcaacactttggaaggctgaggaggattgcttcaggagttcaagaccagcctgggcaacatggggagaccctgtctctacaaaaaataaaaaattagctgggcgtggtggtgcccacctgtggtcccagctactcaggaggctggggtgggaggatcgcttgagcccaggaggttgaggctagagtgagctgtcattttgccactgcaatcaatcaataaaaactgaaaacttatggttaatatggagaatttaatatctatatttacctatatttcctcccaaatcttaataaaatgactttgaaagaatgagatctaaatacaaaggacaaagagaatgagcaagaagacaactgaggagagacctcaacaaaattttggaatctgtaaagctgatgaacaatgtagttcagatatgcttctttacttctgaggttttccttctttttttttttttttttttttttgagacagagtctcgttctgttgcccaggctggagcacactggcgcgatctcggctcactgcagcctccgcctcccaggttcaagcgattctcctgtctcagcctcctaagtagctgggactacaagcgcgcagcaccatgcccggctaattttttgtatttttagtagatatggggtttaactggctgggcgcggtgtctcacgcctgtaatcccagcattttgggaggctgaggcaggagaatcgcttgcaccggggaggcagaggttgcagtgagccaagatcgcgccattgcactccggtctgggcaacaagagtgaaaatcagtctcaaaaaaaaaaaaaaagaagaagaagaagaaagaaagaaatggagtttagccgtgttagccaggatggtctcaatctcctgacctcgtgatctgcctgcctcagcctcccaaagtgctgggattacaggcttgagacaacgcgcccggcaggttttccttcttatgaagagacttaattcatgtaactgtgccttttttagccctttgttcatacactctttttctttttctttttctttttctttttttttgagacggagtctcgctctgtggcccaggctggagtgcagtggcacgatctcggctcactgcaagctccgcctcctgggttcacgccattctcctgcctcagcctcctgagtagctgggactacaggcgcccgccaccatgcccggctaattttttgtatttttagtagagacagggtttcaccgtgttagccaggatggtctcgatctcctggcctcgtgatccacccgcctcagcctcccaaagtgctgggattacaggcttgagccaccgtgcccagcctttgttcatccactcttaatggtctgttccactcagttctatcctgttgctcttgggaagaggagcccacccatcagaacacattttctgcttgtttcctccatgctgagatctgccccaatccaagctgcctgatcctgggatacagttagcaggctcttttttttttttttttttttttttgagacgaagtttctcctttgttgcccaggctggagtgcaatggcacgatcttggctcaccacctctgcctcccgggttcaagtgattctcctaccttggcctcccgagtagctgggattgcaggcatgcatcaccacacccagctaattttgtatttttagtaaagacgggagtttctccatgttggtcaggctggtcttgaactcccgacctcaggtgatcagcctacctcggcctcccaaagtgttgggattacaggcatgagcctccgagcccagcttttttttttttttttttttttagacagagtttcactctgttgcccaggctggagtgcagtggcacgatctctcaagtagctgggattataggcgcccaccaccacactcagctaatttttttattttttaaatagagatggggtttctccatgttggccaggctggtcttgaacttctgacctcaggtgatctggcctcccaaagtgctgggattacaggtgtgagctgcgcctggccagttagcaggctcattgactcccatactaacccacatcctccaatctggtctcaaacagtaataaaggtgatatgttgacctctgtatttattttttgcttgatttctcaatgtgttcaggaccttagaacaaagaaggaatgcttttattgggatccccttcagaggtcccagtaattatcttagcagggccgggaacggtggctcatgcctgtaatcccagcactttgggaggccgaggcaggcaaattacctgaggtcaggagttcgagaccaacctggccaacagggtgaaacactgtctctacaaaaatacaaatattagctgggcctggtgactcgcacccgtaatctcagctactcatgaggctgaggcacaagaattgcttgaacgcgggaggtggaggttgcagtgagccaagattgtaccactgcactccagcctgggcaatggagggatactctgtctcaaaaccctgccccaccccccccccaaaaaacccaatatacattatcatgaaattatatataacacccaggagaaaggaaaattactaaaaagcttccagagagaagagccagttgaactcagaactggaggttaaagggttccaagaggaatatctcttttaaaaatgttatgacagaatgaatatctgacaggttggaacataataaaataagagttagattttcaacagtgaatttggagatgaataagcaactagaaaactaaaacaaaagaaaaaaataaggccattattaatttgagggaaattaaaagttatacaagaaaggaaatataatacacttcttggctaagctgtgagtaaatactgatgataacttaaatgttaatttaactaatattacgatataatagttatttccaaggggctgggggcaggagaagtgtgttttaggaaggaagtattatgtaaaagaagtaactcctcatcttttgtggttggaagttaataggtaattctgtggcagagggcaggcctatgcaaacctgttccaaaagtccaaggaagctgagaggccaaagaaagaggctgacaagtccagtttcttagaaataaacatttaatagagacttatgaacagaggccgtgtgcatgtcttgggcaatggtgagatgagatggtggtttcctgctccattacccccagacctggggcttctatactacagggaaagggtgattcagaagggatgtatagatacgataacatcaaggttgtttgagctaagggcagaatgtatggtaatacctgctcttacaccaggaacaataggcaaacttgaaatcttagaggccttcccagaactggggttaatcagaagccaacatggtggattagctttcacaaatacctgaaactctaaaaaatcaagacatagcagtataaatatgtttttggaaatttgaggtgaatactaggaggaagttagaaagttgcagcaattatctctgggaagtaagaattagatgtgggaagaatagagtgtttaattataacctatgttgatctatttgactttttaaactatgtacctgttctactttgataaaaataaaaattaaatttaaaaataggctgtgcgcagtggctcacgcctgtaatcccagcactttgggaggccgaggcgggcagatcacctgaggtcaggagtttgagaccacctggccaacatggcaaaaccctgtccctactgaaaatacaaaaattagttgggcttggttaggggagccagtaatcccagttactcgggaggctgaagcaggagaatcacttgaacccaggaggtgaaggttgcagtgagctagatcacgccactgcactccagcctgggcaacagagcaagactctgtctcaaaaaataataacaataataatgtgagttagttaaccactgacttgtggaccttccataaacacaatgaaacatattgagtggaccagcagtctttaaactgatatcaacattttttattctgtggtgaaagataagaatgtaggtatattgtttgtttgtttaacttttttgatttgtttttgtttggttcatttttttggttttagagacagggtctttcttgctccatcacccaggttagggtgtagtggtgtgatcatggctcactacagcctcaaatttcttgggctcaagctatcctcccacctcagcctcctgaagtgttgaggctataggtgtgagccactacacctggctatatcttgttatatagaaatttagcatgccaaattcaaacttattcaatgtacaatatctgttgacaggaccttgctatactcatctgtcatgtttcaataggtatatttctctatttattaatacagtttagatatttttgccagtgttgtatttgtgtttccatttaattttagctcgatcaagccaattgcttccacaaaacaccaaaaacaaaatctaagtaatcagagttgaatgtaattctactgaaatatagtgaaatttgatagaagctgggtgattatttggtgcaatctgatctatttaattatgattttctcctgcttaattatttgagctatttcaacaaacagtattttgcattagtatatattattttagtgttatactttctcataaaataatgagtttactttcaatatgtgttttttaagagtttgctacactcactaatgtagcctttacttatctttaagccaaaatttcctccaaatgaacatatctctcattttattctgaaagtccatgaaaggatgatattcactgtacagaaatttaaccatgttacaagtgaattttatttctgtatgatagctaaaaggtcacaagggaaagaaaaatattgaatttttgcctagtgtgaaacaccaattgtagagtcctttgtttatctccccaaagaagaaaagagtaacaacttgtataaataccattggaggagtataacctttatggaaggcaatatggtaacaaatatagcaaaaaccctttaaaaagttgatatcctaaattaaaaccaaaatgagataccattatacactagaagaatagctacttttttcttttttttttttttttttgagacggagtcctgctcttgtcgcccaggctggagcacaatggcatgatctcggctcacttcaacctctgcctcccaggttcaagagattctcctgcctcagcctctagaatagctgggattacaggcacgagccaccacacctgactaatttttgtatttttagtaaagacggggttttgccatgttggccaggctggtctcgaactcctgacctcatgatgcgcccgccttggcctcccgaagtgctgggattacaggtgtgagccaccgtgcccggctgtaccttttttttttttttaaacggacaatatcaaatgcttgtaaagatgaggacaactagaactcatacattgctggtgggaaagaaaaactgtataagcactatgaaaaacagtctggggaccaggtgcaatggctcacgctggtaatcccaacactttggaaggcctaggcaagagaatcacttgaacctaggagatgagaccagcctaggcaacatggcaagaccccatctctattaaaaaaaataaaatagtctgggcgcggtggctcacacctgtaatcccagcactttgggaggctgaggcaggtggatcatgaggtcaggagttagagaccagcctcgccaagatggtgaaactctgtctctactaaaaatgcaaaaattagccagacatggtggcacgtgcctgtagtcccagctacttgggaggctgaggcaggagaattgcttgaacctgggaggcagaggttgccagtgagccatgatcatgccactgcactccagcctgggaaacagagcaagactccgtctcaaaaaataaataaataaataaataataaaataaaagaggccaggcatggtggctcatacctgtaattctaacactttgggaggctgaggcaggagaattacttgagccaggagttcaagaccaacctaggcaatatggtgaaaccttgtctctacaaaaaaattaaaaaattagctgggagtggtggcatgaacctgtagtctcaggtgcttgggagctgaggtgggaggatcgcttgagcccaggaagggaaggctgcagtgagccaagatcacgccactgcactccaacctggacaacagagccatgccgtctcaaaagaaaagaaagtaaaagaaaaacagcccggcagtttttttacaaagttaaacatacgcttcccgtacaatccagcactcagtatctatttattcccactcctaggtatttactcaagaacaataaaaacatatgtctgctcaaagacctgtactcaaatacttatagtgcttttattcatggtgactagaaagaagtggctgcggtggctcatgcttataatctcagcactttgggaggccaagctgggcaaatcactcgagcccaggagttcgagaccagcctgggaaacatgacaaaattttgtctctacaaaaactaagaaaatttttaaaacctgccagtcatggtggcatgcgcatgtagacctagctactcaggaggctgagaagaggatcatttgagtttgaggctgaagtgagctatgattctgccactgcactccagcctaggggacagagtgagaccctgcttccaaaaaaaaagagagaggctgggcgtggtggctcacacctgtaatcccagcactttgggaggctgaggcaggcagatcacctgaggtagggagttcaagactagcctgatcaacatggagaaaccccgtctctactaaaaataccaaattagccgggcgtggtggcaaatgcctgtaatcccagctacttgggaggctgaggcacgagaatcacttgaacctgggaggcagagtttacggtgagccaagatcatgccattgcactgcagcttgggcaacagagtgagactctgtttttttttttttttttttgagatggagtctcgctctgttgcccgggctagagtgcaatggcgctatctcggctcactgcaaactcctcctcctgggttcaagcggttctcctgcctcagcctcccgagtagctgggactacaggcgtgagccaccgcgcccagctgagactgtcaaaaaaaaaagagagagagagagagagagaaagagaaatgctaatttctctaatgccaaatctctaatgtagatttggacacacccagaactatagaatcgggtactatgggggtgaggtccagaaatctctatttatttattctattttatctttgagatagagttttgctcttgtcacccaggctggagtgcggtggtgcagtctcggctcaccgcaacctctgcctcccaagttcaagcgattctcctgccttagcctcccaagtagctgggattacaggcacccgctaccacacctggctaatttttttgtatttttggtggagatggggtttcgccatattagccaggctggtctcaaattcctgacctcaggtgatctgcccgcctcggcctctcaaagtgctgggattacagacatgagccactgcacctggccagaaatctgtattttaataagctttccaagtttaaaaagctttccaggtgattctgatgcacattgacatttgagaaccaatggtgtaggagaaagctcactggtgcctgtgtccttgttctggtttagcctagcagctatatgactaaccatggctaaatccctaaatctctcaaaactcagttttacagggtataacaaggggtttagaatgatgcctgagggcccttctgctctaaaattctgtgaaagacagtaaataaatgttgcaattactagattcattcaatcaacagttatgtaccaggcagcgttctgttcatggaatcaatgtataacacaaaattgcaactgaaatagtgtaacttatcgcttataattaaatgacttgcaaattttcagaccacaaacttttaccggtcctcaatttacaagattctcatactacatttgttgtgtaatgtgaactggaaaactaagaaaatgatccaaagggtcattttttccaaaattacttaattcttttttgtttgtttgttttttcttttttgtttttgtgacagagtctcactctgtcacccaggctggagtgcagtggagcaatctcaactcactgcaacctcccactcccgagttcaagcaattctcctgcctcagcctcctgcgtagctgggattacaggcatgcaccaccacgcctggctaatttttgtatttttagtagagacgaggttttgctatgctttggccaggctggtctggaactcctggcccacctgcctcggcctcccaaagtgctggcattacaggcgtgagccaccacgcctcatctcagtcaagtttcagtatatctacaaggacaggagatggcgccagaaggcagtgagatgcttggttttggttttaacggttttagccaatgcaagcaaggaaagggcttgagagagaggtcagaactaaaacaaaggtgccagagtttgagtggaaactaagactgagtggggagagggagctgtgtcagttttttttttttttaacttacatataagggtccccttgacacctactccaaatcagcacagctagaaagcaacaaaagaaatatccacagtaaagccaaagatcaagataaagtcaagtgcctggaggacggcgctcgccttctggctccctctgtcctagaaaggagggcctttgtcgtctgggaagcataagcacctggatgcgttgctcacccaagatcagggaagtgttgattccaggctaagatatctttgtgaaacaatgttcagttgcgtaggcaaaatcccaaagcccagcagcagtgaaatacctcccagaaggaaccacatacacaaagcattttaaattaaaatttaaaaattcatagacgagccaggaggtggcgcctggcaagacacgctatctgccttggaaatcggaatctcagctcagcgctccaggggaactctgttccggcagaggtcattctgttcagacctcttctttcctactaaatctcttctttcataccaagatgtctctgctttctttttttgtttctttgtgttaagtaccctgattcccgggaaatctaatttatacttcaagtcttttactcttcttagatgggatggatggggctttggggaacctcaaaacataaaactttcctgaaggggacaaataactcagagggtgataggagaagaaaaagggaaatgacatcagcaaaatggcttggctttgcagatcaatcacaggggatagaaaggcacagtgagctcctgtctctgcaggagctgatgatccagcacatgcattattctgttcatttggcttttatcctgctcccttatttagcttctgctccctttgtttggctatttattgctactcggcaggagcaaggagggcagagggagcttcagatgggtgcatcctcctggctggtgcctctggtgaagagcatggaggagaaagaggtttcaatgtctggcttgaaagtatctgtgggtttcacattctctaacgagggatttaggatgtacattccaatcgggatttccagtcccgtggggagcaaacatcagttcacattcctgagacgtgcagcctccatgctccacggacgcagctccttggtggcaggtttcattcagtgccacatgtcctgcctcagccctttgttgggctggaaggaagaccctgagcccctcttccatctggatcacatggtctctccagaccctcccctctctttctctggaaaccacctttttctgatggtggtagtgattgttcctaaagtctctcctttcctcctgccctggcctctctgccggaggtcagtgtcctcttcagtgacaaaagccgccctagatctgggctccctggagagggaggtggctgggtctggcagttacagccgctgtctctccatggtgctgctacacccctcccccactgggcatacaaatgggctttatccagcaaacaacgctccctccccgcactccccccaccccaggccacacaggcacgtggacccaggcctcaccgtgggaagggggtggtggcaggcacagaagagattgctccagatgagttctccttgcctcacttctcttccttagaacttaggacacaactcaggttttagttattgacttcctccacccctcccctgcaccctgagtccctaattccttcttgttatatatctcctaattctggactcttcccattccagggcagctcagattatgcagggaattgggaacaggtacccccaccatctgccgcataccacccagggagctgctcctcagaggagaaatcaggcggggggatgaaaatacagtgtccttttgagggggctgagttgaaccccaaagccccttccttgaccctgcctgctccagggaacacccatctaaacagcatctgtgtgactagcagaggaaggaagagctcaccccagctgggctcctgagccagggccagggctccagtgaaacttgccgcgctccagctccgagtggggccatcctgcatgcctaattggctatttaaggagctgttcaccagcagcccaggcagcacccccgtccccacatacaccagttcagagccaccttaaaagcaggaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtaggtacaactaaatgtctgtgtgtggatttgtgctgatgttcacatgtcgccaggtgtgcttaatggggggaggagaggtgtgaaaggaagcctagaggctggaataataggctcagagatgaggaaaaaagagtggggtgtggaggagaccacttcccttctttaccttttgtctctccagccttgttgttattggaggtcggggagaactagcggcaggcaggcagagtgtgtacacatgcaagtgctggaatctctttgcaggctacagattttctccagagctctttcccccactgccctggtcccaggcaggactcctggacttctttatttacaaactcctccaaatagggagtcaaagaggcctggagtaaaaagatggatagatgggggtagggggaagaatacttcctgcccaactcagaccctgatctccaattcatccccttttggccaagattccctcttcattctgtggagcgactaactccccagttatcctctgaaagtggcagtaagagtcaacatttgtttgacattttacagtttacaaaggactttcaggagctcccaggagatgaggagggattcttgggagaacaggctgaagcgctccaggagtgtccccaggaactcctagacctcatttttgtgtttcctgtgcctagcacagtgtccagcacatactaggtgtgtaactgaggtttgtggaaagagcagggtgaggtgggtgtccagagagcagaaggcaaatgcagagaggatgggggcaggcaggcagccaaatggagagtcacaaatctcatctgaggagaaagaaaaaaagagggaaagaggaggaagagacagaataagtgtgttgaggctctgaccagagtggacaggcacctttacagaccagggagtttgagttgttggggggtcccacagatatggtaaaatgagaggctgcctccagctctcccttgggctagcagaataggtcaaggataagagcaggacatctcacaagtttgaggaatttaagggaataagagacagagagaggaaggaatttaggatttttctccagagtttctagtagtatgaatattgcagcataaaccatgaaggccttcgttttcttcttgaggcagtttggccgtagggaggggctggacctgcagaccctcagcctttgcgtcagacaggactgcacgagagcctggcatgtgacccagctggcagctctcttctctacacacaatgcttcactttcatcctgtccctgccagcctggctgcctgtgcccacccaccaccctcaatctagagtagaccctgccctgactcccacccttccctaaccatctcagaatgtagggagcagagcctcctggtgatgaggagtttcctctagagctaatgggaccagaaaagaagaatttacatatgagtttacagctcagtggctttattcatgcaattttttaaagcaaaggaataatctccccttctcccctcagtagcaccccccaacacacacacactctaaactcctttctcctccccgctttctagtccctatccttccaaccctctgcccacaccctcaccccacccaccccaatcttctaagtgttagattgacttggcacaggttacagaaaagaaagggttgggccaatcgcacatttggatccaggttaattttagtctctgggctttacctcttttccttcctcctccccttttactcggcaggcaccaacacagcctggctggtgattttaaataggccccccgacctttccacagaggtgtccggtttcagggcttcctttgcaaagtgctggagcagagggaggagagactgcagagagggaggtggagcagtacagaatgccagagggaggggagtgtggaggccagggttctgccccaggctgcgctggctgtaacccaaactattctgccttgcaggtcaacactggacgtatgagggtgagcagatctcaaggcctcccgacaaccctttcacactgggacctcctcacctggcaggaagacacactgtgcgggtgggaggagacttcctttaccttctcaccctagctcctcccttctggatctcctcctgccttgagtttcacatatatggctcctagatcctgctctaatcatcaaatcctacacctcctgatttggcagaaaagctagttaagtcctcagtaaatcgtgtaggagtgagggagctggggtggaaaggaagctgggtgggaactctgagcttagctgccaggtctccttctggctccgtctatcctaatccatcctacccctaacctgcatctgaaattgggacagagctggaggtcaggggtgaggaagaggctggcaggatagtttctgaccctgggggaggtggaactcagttcctatgaactactgattaatgacttaaccaaactcaagttcatgataaacggtcagtgtgagagcaagaagtgaatgatgagaagtcaggatatctgaatcccaaggccacttgataggggcctccaggagaccgtatctctctaggatttttttttttttttttttttttttttttgacacagagtcttgctctgtcacccaggctggagtgcagtggcgcaatctgggctcactgcaaactccacctcctgggtttaagtgattctcctgcctcagcttctcgagtagctgggattacaggtgcccaccaccacgtctggctaatttttgcatttttagtagagatggggtttcaccatgttggccaggctggtctcgaactcctgacctcaagcgatccacctgcctcggcctcccaaagtgctgggattacaggcatgagccactgtgcctggcctatctaggatcattttatttctcccatttttctactcctactctctaatcccatctctcagggtattcaggttttctatgcatcccctctgccctcattcagctttcttgtcctcaaaatacaggtaagtaaaagagctaccactccccattcatcaggatagttggggaatcatcactgcctctgggtagggaaggggaactgcagcatgagactcaacaggactcctacctcacccatccctatacaactggggtcttaacctgggtggagggaagtccatttctacctccacacagatgtatggcttggttaggggaagggtcaaagggagggggtgctgttgaagggtagctagagctggaggacaggaccaatgtctttggtaacccccaccaggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacaggtaaaagcacaggctccaaggagttgtaggctccagctcagatcttaggagtcagatccttttgtagttcatgggcatgatgatggggtgttcctgagcatgcgtaagatgtgccgccctcaaatcttgtcaagatgttggcacattacccatctgacataaataaacaaacaaataacctcaggagtcagaggaaagcagcattttcctaacctacgaattctcaaaaacctttgtccatgaatttggagatatgagaatggggatcaggatcctgtagccaaagcgggaatcgaaatgtttataaccaagctcagtaggtaggtatcattgcactgacttggtcttcaccaagaaaaaggaagatatgctagaaaagcactggcctatgggaggaactgggtgctactgggggagaaaactggaagagggccaagtctcccaagaagtggtggcaacccaggagtgggaatgtatccacatgcctccaccaatccgagtttgctcttttcctcacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagaggtaccagggaacaaagagctgggactcagacaaagtaacagggatgggtggtcctggggaaaggatctggaccttaggaaaagtcatgctggggggataaggccaatctctgagggacagacttagtgcctgccggggacagcggggggatggtggcagctaggatcaaggccttgaagggggtgcagacattccatgattcaattccctcttccttcctttagctccacattgtacattatgactctgattcctatgacagcttgagtgaggctgctgagaggcctcagggcctggctgtcctgggcatcctaattgaggtcagtagcccccagtcccttccaggtttctctccacttcctctgcaaccctcaaacctatttctgttgctggcctccttcctatggcaggcagcagcccaccctgaccatttattctgtacataaatttcttattccaaacatggactcattccaaactctctccctttccttctcttccaggtgggtgagactaagaatatagcttatgaacacattctgagtcacttgcatgaagtcaggcataaaggtgagccttaaaaatctatagcaggaagtaagattagactttcaaaaactatccttaaaagccttgggatgaagcaattacatagagccaaggaattttgcttctgggagccctatctaggtaagctagggcacactgaaaggaagatgagtcccagtctgttctccccagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacaggtaagtggtggagaaacgaggtgaggtgagacacagttgtaacttcagaccccttcccactccccaaagtaacacctctcccacgcttctgctcctcagctggaaaagcttcaggggacattgttctccacagaagaggagccctctaagcttctggtacagaactaccgagcccttcagcctctcaatcagcgcatggtctttgcttctttcatccaaggtgattctgcacggctcagaagagatgggaaactgagggggacacaatggcaggaactagggagccaatgggaagaaaaggctaaaaggggagggggtttctgggacttgcttggactgggaaccaacccccaccccagggtgcccccgggggattctcccaggcacagcagcagagagtgctgctcccagctgggatggggatctgaagtcccactgacccattttcttctcttacagcaggatcctcgtataccacaggtaagccagccttataagataatgcggggaggggaggtgtcctcaccgagtgggggaaaggctcaaaatctatgttagtcctaggctgacaccttttacctttatctcccccaggtgaaatgctgagtctaggtgtaggaatcttggttggctgtctctgccttctcctggctgtttatttcattgctagaaagattcggtgaggccctactttccattcctccagtcccttcttcttttttttttttttttttggtaggtgggagacggagtcttgctctgttactcagtctggagtgcagtggtgtgcaatctcagctcactgcaacctctgccttctgggttcaagcaattctcctgcctcagcctcccgagtagctgggactacaggcacgcaccatcacacccagctaatttttgtacttttagtagagacaaggtttcaccatattggccaggctggtctcaaactcctgacctcaggcaattcgcctgcctcagcctcccaaagtactgggattataggcatgagccacccgctttttgagacaggttctcactgttgtcgaggctggagtgcatggctttatcacagctcactgcaacctccacctcccgggctcaagtggtcctcccacctcagcctcctgagtaggtgggactacaggcatgtgccaccatgcccagataatttttgtatttttagcagagacgggttttcactacattgcccaggctggtctccaactcctgacctcaagtgatccgcccgcctcagcctcccaaagtgctgggattataggtgtgaaacaccttgcccagccctcttttctgttaaaaagcattctcctatttcacctctaatctgcttcacttagatagcagtcattctcatgagccattcccctttccaggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaattctggcctatcctttgaggctcttgagggtgggcaagttcctgaatccctcaggtggtaaagatgggcaaaggatggggaaaagaagcatgggtgattaactccttttatcccacccctggaaggaaagataagcttctgggaagacacttaacccaaagtttcagacatgttaaaccactagcccagatttctgcccttgcaccaaggctatgcttggaaatcagtggttgccaggttaggaaagtggctggatgagagatctgaggacagaaatctcaattaacatgctatcccctcccttaaaagccaagttcccccacaattacaaattcttttttattagtcaaaatcacaatcaccttgattaaaaggatgggacactccaccctcagcagaaaatgatacagtttatagaaaacctccccgcccctcccacaccccaattaaaaactacaaaaaaatctcccctccttccctacgatgtcatggtagtctgactcctccagtggcactgcagctctggagtggccagctcaccacagcaccctccacttcaccttggggagaggagggatgctggtggttaaggaggttaaaaccattagttccagtaatgccagttcccaaacatgcacttccttcctttcccccaaggtctgggaccaaggagaaagggaccgaaatgagcccagccatgaggagcaactcgaggagagaaaatatagcccaaggaggttagaagagttccaatatacctcctccctccccccacctcaaaaaagaaaaaaaggcagtttagggtatttatcacaccaaaaatggttccccctcaggcctgagaaaaagaccaagatgtccagtcttgagggagtactgagaaactcagagctcatctatccttgagcctccattaatttcatctccagggcaatggctaaactaggtcccttttcttggcaacctgcactgtccagaactggagatggagaaatacagggcgaggacatcaggagggcaccccaggcccaggggtcccccctaggttccctcagtcctcgggtgggatgcgcagggcagaatacaccatcacccgactgtcctcctgccgtcggcctgcagaggggaagggaggtgagtcttgggcagggtgagagcagagcactgacacagggggagtcctggacacaacaagggggtccccaggtggtggggataagtgcagattcaaacccaccagtcactgactggctgaacccaggctgctcctggtaaagcttagagactaacggtcacaaaaggacaaagcaaaaccctggaggtagtggggtagaccgacgagaaggagacagagaatgtgggcaatggacccgggctggggctgggctcagtcatgggcagtggacaggcaggtgggatctgtcaggcgatcagtccaggtagtcagtccttacacaagaggctgcgctgaatacttcggagggaccctccagctgtgatgaaggcccagagccccatggaaacagtgactgcatagatgggcagcaggctggcctcataccaggggttcaggaatgtctaggaaggagggtaagagtaggaaagagattagattctccctcgacctaatccccatattctctctgtacctttctgactcccagatatctctctcaaattctccagtctttcccttcagagcaccaacatcttgtggttaaggggacttttgattttcagctcctcagaaactcaaaggtttctgccgctcctgctcacctcaggccctctgcattacagtttgactaatcctttcaacctcctccccagagcaggtgatagaaatgatgctgaggtgagagaccttgaaagactcacctttcctcctcctcccaggtaagttaaaaatgttaagaagtgaggataccctttcccccacatcccactcaccattaaatgcttttctccctaactcaggcccctgtctccaactcaccagtcccgatgtcagtaggtgactcccaaccaccaggcccaaagcccagtaccgtctcctctcacaggcatcaaagaacacaactccccaaaaggtatggagcaggataatggctgctgtcagaaaggctgcagggagggagatggggaggagatacatccctgatcttctcccaggctcctgagatgttgagccaaagaagtctctcagggaaggccaataaatcagatcagggacaaggatggatggggggtaaaggctagatagaaggtggatcttacctgaagtcaggaagtaatagggtgagtctccatggatcccaaccacacctggcccaagtgcatcagccaaaatattgataacagagaagacaccactgatgataccgaaggagagaccagaaactgggggaagggaggatctcatcaatgtcagagatcacactattgcctgttcaccactgacccctccccattcccggttacaattctttcacatctactctccctccagaccaactttctttggaagtgacggatgaaggaaagtaagaagccacttagaacatgtggatatttagagacttccctagaggagggggctgtccaactccctcctccagtccctctcccttggctcaccataggccatctggcggatggagatgggtgatcttccgtcctcactcagcgatgctaacccctcatctgccttcctggggtggggtggggtaggggaaacatgagggagggcagggatgctcctttccctctaatgtcctcccttagtgcctcctcttccaaaccagcacccaggggctgccccacttcccatagtgcagtcctttgcccctctcccctccagaccactccatcttcttacttaagcagcttgtagtaggcaaagcggaacacctcctgtagaaggacagagacagcagcaccaaaaatcaggaggccgtactggagccgggcatctgaccggtcggtcacatggaccaagatgaaccagaccacagaggccaggagcagggagaccagccagaaaaatgccctgagaaaagacaggggcagtgagacaagcaatagtagtgggagccagagaaatcaaggagggaaaccagccaaagctgcttgaaaagtggaagttagccttccggatggttagggagacatggaccaggtagggtaactgtctccaccaagagactcatctgtagaaaagtgaacgcactggaaaggggagaaatctaattaaagagtcttcagagcgatgacagccagagtgtgcgagcacggaagggcgaggtatccgttcctggatcctcccctaaggcacctgactcggcctgcctaggtcagcacagccccctcacgagtctcggccttgggccttctctgacgtcgctgggaggaatataggaggaatctgtgagatccttggaaggtggaaaccaactgcgggaaaggacaaatctcccagacccaacccctcacctccgcccaaacttcacctccgacttatcgtccccaattcaggctcccaggcttgccccagttcctccagccccttccgcacctctctcttcgacgctctcccgcgtctcccgggccctctactcaccctgcgaccaggatgataacgcgaagcgggtccccagccacagtgatcaagaaaagcgcgaaggccgggccgaacgcgacgaaagtgcagccgaaaaacaccgcagcccccatggctggtcaggtgggaaggggggtgggggcctgaccaggacaggcaaatgggaggggcgcgccagctggggagtccgcgtggggtggcaacgcgaccccacgaggggcgcggtgcaatgtcacccccagaccccggggaaggggaagggggggaaccgaaaccccaaatgaaggtccgcgccacttcctctacggaagccgaagaggggacaaatcccggccgcagccccacggccacctcccatctaatccccacccccggaaggccaatggagaatcagcgcgggcggagctgctcgacctgctgggagttgtagtcgccttccgaggccttgacttcgtcctgggagtggctcgagccggttaatgggggtgggccgggaatggaccagtcgagacaccaattccagggttcggttgcgcttccgtcgctgtttcctttcgtcactttgtggggaaaagtggtagcaatcatacctcttcttgaagggctgcagagggggtagatcctgtttgaatctaagggacaaatacaaagagagcacaggatggggcgcagggagatagggacgggtattgttcttacttgaatgagaggaaatgggctagagctgctgcctaagagatgaagattacattaaaaagtaggagctcttcggacagactagtataataaacatggaatacagtatatcgctaatgaagccttcatctgtaatgacaagagaatcggagagaagcaaaaggagcctggagagaaatgttaggaaggcattttgaaagagtccgggagtttaaaagcaattagagcgatggggttgaaggaaaacgacacccccaccccacccccgccataaattccttttatgtcatacttcctctatttattttctgaaaaatgaacctcagtggtgcgttttcctgaggctgagaggggttgtatattagagtgaatgaaagttaaagtaggctgagcgcggtggctcacccctgtaatcccagcactttgggaggccaggagtttgagaccagcctggccaacatggcgaaaccccatctctactaaaaatacaaaaattagccagatgtggtggcgcacgcctgtaatcccagctacctgggaggctgaggggcaaatatagcttgaacccaagaggcagaggtggcagtgagctgagattgcgctactgcactacagcctgggcaacggagtgaggttctgtctcaaaaaagaaaaagaaagttaagtaggagaggagggtattgtaatctcatttggatggggagaggttagtccttagggaagatgttaggcaaaggaatctgaggatggaaaagaggaaagaaatctggaatattgtttttgaaagcataatcaaagtaccaaaaaaaaaccccacagaaattgtttaaagataaccaaacttcctttccttcctggaagtgatttattatttaatccatatgtgcacactcacatacatgttttacatgtcttccaggatattctggaaaggagctgaggaatagattgtatagatttacacggaggctggtcacagtggctcatgcctgtaatcccagcactttcggaggccaaggcggctggatcacttgaggtcaggagtttgagactagcctggccagtgtggtaaaaccccatctctactaaaaatacaaaaaattagccaggcatggtggtgcgcacctgtagtcccagctactcaggaggctgagccacgagaatagcttgaatctgagaggtggaggttacagtgagctgagatcccaccactgcactccaacctgggcgacagagcaagactctgtctctgaaaaaaaagaaagaaaatatttacatggaaagtcaccaggcaaattattccctaatgagactaagagggtagctgggcgcagtggctcacgcctgtaatcccagcactttgggaggtcgaggcaggcagatcacgaggtcaggagatcgagaccatcctggctaacacgatgaaaccccgtttctactaaaaatacaaaaaattagccaggcgtggtggcgggcgcctgtagtcccagctactcaggaggctgaggcaggagaatggcgtgaacccaggaggcggagcttgcagtgagccgagatcgtgccactgcactccagcctgggcaacagagtgagactccgtctcaaaaaaaaaaaaaaaaaaaaattaagagggtagcgttatcatgacctgtgttcaagactccagtatgtcctgcttctgagcccagcaggcagagtaaggtggataggaatgagacaattctcatgtcttttttttttgagatggagtctcactctgttgcctagactggagtacagtggtgctatctcggctcactgcaacctctgcctcccaggttcaagtgattctcctgcttcagcctccctagtagctgggattactggcgcctgccaccaagcccagctaatttttgtatttttagtagagacaaggtttcaccatgttggccaggctgatctcctgacctcaggtgatctgtccgcctaagcctcccaaagtactgggattacaggcgtgagccactgtggccagcttcatctctccattgagctgttaccacagcatcttctgaccattgacaggaggctgtaaacctatcttgttcatgggtgtttccacagacacttgcatagtgcctgactcatagtagatgttgagcagatacttattaacttcccttaagaacaaagcaaaactgtcttttcttattcccttgcctataagctctcaattgcctatcacactaggcctagcacactgtgcctagcacgtatgttgctaagggtttctgaattgaatgaacatgggaaacataaaagcagaggaaaggataaaaactctacacctgtaggacggaatgaagggaacataccaagtgactgaatgtgggagggaaggtgtggcacctgtagcagggaaagagactatctgctttctcccttcttccaacctgcatcctggaagttgagaaagagatgaggtgaggccgggcacggtggctcatgcctgtaatcccagtactttgggaggccaagacaggtggatcatctgaggtcaggagttcgagaccagcctgggccaacatggtgaaaccccgtctctactaaaaatacaaaacttagctgggcatggtggcacgcgcctgtagtcccagctaccagggaggctgaggcaggagaatcactggaacccgggaggcagaggttgcagtgagccgagatcgcgccactgcactccaacctgggtgacaaagcaagattctgtctcaaaaaaaaaacaaagaggtgaggtgaggtcagtgttaccagaaaggaaataactgaccatggctgagagacttttagctgaagccatgcagcaggtgctttaagtcagacaatgatgggtaaatattgttcctattctctatagctccagacagacagaagaaagggattcttttcagtctagaaaaatgctcaccccttcctcagaacatttccactgtgacgaaaagagactgatgaagcctcagagagaaaggcaactctgggtggtgatggtaagtcagagacagtgagagggagggtgaactttttatgaggccttggaggaaggaaggaaagccgggagaggggaaacttcttggtaggcttattttttatttttattttggtagtgacagtgggagtcttgaatggatctaatctagggcagggggagcttaagaaacatgtttgcatcaaaacccccttttgcctctcaatctgggcagctctggctggggaccggcagtaaccggagatctagtcagtcagccagtaggcggggagttctgccccctgggaggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggtaagtccactcctctctctgagcttttgtgccaggtcttctaccataaatggggtgggagaaaaaaaatgaggagtgggtgagaggtacatttcagtggggagcgatagagttttctcatcgtgctggggtccggtgttgagggcagaatggagatctggaaggcagagccaggaaagggggaaaaaagcagagtcctgtcaaacaaggaggatggagctccagacacaaggaggccctagcaacactgagctcagttctccatcaccacggaagttgaacaagatgacaggggctaaagtaagggtgaaggagggattattggaaggtgtcacagtctgaaactagtagttagggtatctcctttcccagagaattggagaaaaaaacctgctattagtaaagacacagaagtggggtgacctttagggtagtggaaaactggctgtcttcagggacagggtcccaagagtagcttggctccttccctcctttgttccccagtctaccaggtgtgtctcattgtttccttttcctctagattcttgtgtcattagcttggagttgaagggaaagcattcaaggagctcagggaagtgtttagcaggaggcctggagttcttgatccagtcatatcaaagccacatatttttagttctgaaagggaagaaaaactaacagagatgggtcattttagtccagctgactcattttaagaaagcggatgttaagtggattgttcagggttattctgttagcagtgaaggtggaactaaagctcaaatccaaagcctaagggtgtatgttagttatttgtaagagatactgataagaaaagatgtctcacaaatacagtaagatctggagcatactaaatagaagacttggcgtttttaattcctggtctctacttttcctaccttttttaggtctggttctccctttgggtttatagtatgtgaaggggactgttttctgttttaggagttcctggattgaaagggcacggagtaacaggcctcattacagatatggatcccagaagactgagaggggtgtagaggtgcacaggcaagaaaggagtatgactattggaggagagagagagagagagaaaagaaagaaagagcaagaaagctgggagcgctgaggtcatctccaggtgtccttttgttagtaaggtgttccagatgtcccttgacctctagtccttgtccccataggacaagaatatgaggatgaagaaagactgggagaggatgaatattatcaggtggtctattattatacagtcacccccagttatggtgagtacatgaaaggctcttgcccttagccaactggagagaggcttcaggatatttagttctgagactttgctcttcactttgaagcagagcaatggggtcagagaaaaatctggctatgaacaaaacctatcaagactcatgatggggccgggcgtggtggctcacacctgtaatcccagcactttgggaggctgaggcgggcggatcacgaggtcaggagatcgagaccatcctggctaacacagtgaaaccctgtctctactaaaaatacaaaaaattagccgggtgtggtggcgggtgcctgcagtcccagctacttgggaggctgaggcaggagaatggcatgaacccgggaggcagaggttgcagtgagctgagatcgtgccactgcactccagcctgggtgacagagcaagactccatctcaaaaaaaaaaaaaatgaaaaaagatttatgatgggctgggcgcagtgactcatgcctgtaatcccagcactttgggaggctgaggtgggtggatcacctgcggtcaggagtttgagaccagcctggccaacatggtgaaaccctgtctctactaaaaatacaaaaattagctgggcatggtggcacctgcctgtagtcccagttattcaggaggctgaggcaggagaatcgcttgaacctgggaggcagaggttgtggtgaactgagatcacaccactgcactccagcctgggcgacagaatgagactacgtcacaaaaaaaaaaaaaaagactcatgatgatgttatttttccagatagtgatttttagatgggaggattgcttgagcccaggagttcaagaccaccctggacatcatagcaagaccttgtctctatagaaaaaaaaatttttttttttttgagaccaaatctcatgctgtcacccaggctagagtgcagtggcacaatctcagctcactgcaacctctgcctctcggcttccagctattctcttgcctcagcctcctaggtagctgggactacaggcgtgtgctaccatgcccggctaattttgtatctttagtagagacaaggtgtcaccatgttggccacgctggtcttgaactcctgatctcgtgatctgcccacctcagcctcccaaagtgctgggattacaggcttgagccatcgtgcccggccaaaatttttttttttttaattagctgggcatggtggcacatggctgtagtcccagctactcaggaggctgaggcaggaggatcacttgagctcaggagctggaggtggcagtgagctatgattgaaccaactgtactccagcctgttaacacagtgagaccctgactctaaaaaaagaagaacttgaaaatttttcaaatttgtaaattattttagatacctacattgaaaatataaatgcatacacattcacagtcatttttaacattagttaaataaaattggattataccaataaatgttacaacttaagttaaactattctgagtaatttcttcccttttcatttccagatctagagttacatttttctttaattattactgattttctttctcctctgcagatgactttagtgcagatttcaccattgattactccatatttgagtcagaggacaggctggtgagtgaactctacatctaaaagggttaggataagtaacaattaaaaagaaactggccgggcgcagtggctcatgcctataatcccagcactttgggaggccaaggcgagtggatcatttgaggtcaagagtttgagaccagcctggccaaaatggtgaaaccccgtctctactaaaaatacaaaaacattagttggacatggtagcatatgcctataatcccagctactcagaaggctgaggtaggagaatcacttgaatccgggagatggaggacgcagtgagccaagatcgttccactgcactccagcctgggtgacagatccagacttcatctcaaaaaaaaaagaaaaaagaaaagaaaagaaactgggcaatgttgaaatgtatctgattaacaagaataaaaatgagtttgatgaggagaaactaagtagtaggcccaaaacagatttgttaacctatctggggaggagaaaaaagccagaactttataaattgtcctcagtaagtttgctaagacactgaggaggggcatcaagggacttttgaatgagatgggtacaaatctatgcaagcatagggtaggggggaatccctgagcttaagtctttgggctgggtggaggtggtgaaggggagaactttaagtagagaatctatgaagatgttggatggaaaaactgataactctgtgtttcccaaatcctactgagggtagaacaggttggataaggacataacagaagcaatagagactaccattagtcttgaaacagcacgtgcagaccatccgaagcctgtaactgtgaaaccagtaacaacggaacctgtgagttgattggggattgggggctggggggagacaggacatccctagtgacgtggaatacatagagggctggaataccaggctttggtggatgggagaaccaaataattagtacttcattgcaggtattcatctcaacttggccatgtttcactaagatttaatactaaccctgtttacagaacactgggaagatatggtacagttaaatttcagttcagtagtattcaataggtatgtaatctatgcctaaggctgctaaggtaactgatgctgataaaaaagaaatctatgttactgtcctcaaggatttataaaattcaagtttacgaaacacttagaacaaaatgaaaaggtatgttatgatgttaaattatatataaatttgaaagcagaagatactggcagtgctttagccaatgtaagaagagagattagtacaggctagagttgtctgaaaagctttcaagaggcatttgtgcttgagatacaccctgaagaatagatgagcttttgattggtgggtagttatggaaggacagaagcaattaggaggaagaatagttattccaagagtgaaagaggccaggtatggcggcttatgcctgtaatcccagcactttggggaggccaaggtggtcggatcacttgaggtcagcagttcaaggctagttcaatggccaacatggtggaaaccccatctctactaaaaatacaaaagttagccaggcgtggtggtgcgtgcctgtaatcccagctacttgggaagctgaggcatgagaatcacttgaacccgggaggcagaggttgcagtgagccgagatcacgccactctactccagcctgggcgacagagtgagactctatctaaaaaaaaaaaaaaaaaaaaaaaaaaaagagtgaaagagctgcacaggaggggggaatagaacaagcataatatgtttagcaaatagggtatgattgaaggagagggtatatggaagggaacagtgggaattaagaaaaatataaaatttacaaggctcctaatacttgcttagtaatttcacatgtggcaacataggggcaaatttcagagagtctcaggtgtcaggctgaagtctggactcataatcaacaaggagcctagtaagttcttcattatggtaaaaacacgatgaaaagtgatattttagaaaaaccggccaggtgtggtggctcacgactgtaatctcagcactttgggaggctgaagtgagctgatcacctgaagtcgggagttcgagaccagcctgaccaacatggagaaaccctgtctatagtaaaaatacagaattagctgggtgtggtggcacatgcctgtaatcccagctacctgggaggctgaggcaggagaatcgcttgaacctgggaggcggaggttgcagtgagccgaaatcgcgctattgcactccagcctgggaaacaagagtgaaactccatctcaaaaaaagaaaaaagaaaaaccactcttcaggttgtatgcaggatgtaaataatttagtggaaagcaactcatgagatttgcgttgttccagaaacaatctgtactctggcattatgaatggagaggagaaaaataaatattatgaagaaaataccttgcttgagtgataattttatatgaagtataaatgaggagtgagttaaaataactcatgggttttaaacatggatgtctgggaaaatggttgaccaaagtgggaactatgggaggccagagtggtttaggacagaagttattaatttggtaatggccaagctgagtttatggtgacagccctatgagggtgtcctaaaggtcactgaactagatcagggctagagttctaagtgcaaagtcacagatatgaaagtaaatgagctcaacagagccagtacacacaagctcagaaggccagtgactgtgcctgtagtgagtgggaggaagagaaattaatgaatggaatggagaaggatttgactggagaagtaggcagatagccaagtttgtattatagagtctagaagagaaagtttaatataatccatcaaaagctaccaagaggccaaggaggaggaggtcacttgtaactctcaagaaagtagttttaactgagtgcttggagaaaagctagatttttgtggagttaaagagtgagtacattatgaggaaagggaggtgagtacagaccaaccatctaaaaaatctggtaatgaaaaagagaagcaacggctggaaaggggaataggaccaaagagcagcctgcatatagttgagcacagatgaaagaagccagtaagaatggaagtgaaagattgacaataagggcagttaattctttttgaagtatacagtaggctgggcgcagtggctcacgcctgtaatcccagcactttgggagctgaggtgggcggatcacctgaggtcaggagtttgagaccagcctggccaacatggcaaaactgtgtctctactaaaaatacaaaaattagccaggcatggtggcgggtgcctgtaatctcagctacttgggaggcaggcaggagaactgtttgaaccctggaggtagaggttacagcgagctgagattgcaccactgcattccagcctggtggatataaaaataataataaataaacaaacaaataaataaaatatagagtagactctctttagattgtaaattccttgaggacaggaatcttgtcttattcatatttatgtccctttctatagcacctagcacagtgactagtatagtataatgcacataatagataaaaaatagaaacaattgaattgaattggcctccctggtatggtcagggatagctgaaaggcacagaaggactccttacagtgatggggaaggatggatctttctctaagcccaaaggaaaggaagacagaggttgttgtaaagaggtggcagtctttctggagggggacagagaagtggtaggaggaatgacaccagcctactgtgtggggatgtcggtattttagcagagtccagatctgaacgatgccgtgtccagtttgcgaagtcctattcccctcctcctgtcgtgtgcctttgttcaggtggggatgtatttcatgtagaaggtaagagtgcagccactggctttgggggagtctgtgaaataatattttttaacttcccacactaaaccgaagtaattcttaccagtatctctagttagtgtttccagcctggtcaattatcagccactgaaggaagagatttaggctcatccctataatcccagcactttgggatggtgacgtgggaggatcgcttgagcccaggagttccagaccaggctgagcaacatagtttaagtccaggctgagcaacagaccttgtctctacaaaaaaattaaaaataaataaataagaactcctctacaagacgttaaaaaaattaaaaataaaaattagttgggtgtggtagcacaggcctgcagtcccagctattgggggggatggggtggaaggatcccttaagcccaagaattggaggctgcagtgagccatgatctggccactgtactgttgccactgggcaacacagtgagactgtctcaaaaaataacaagtaaaatgaaagaagagggatcacatttagaaaaatcttcttattcagtcttaaagaagtttaggagatgctgaggcagacttttgtgatgagtcattactttttctgaactaagaggacttcaggatctcctagagcagatagatgatggggttgggggaatacttctccaagcttccaaaatgtctgaacaatcaaagctagttccagcctggccacgtttcaagtcatggcgaatgccagagggcaaagtgggtgggtcttacaacctggtagagtcaagaggcaaagttcagaggcagaacggatggcggttctctgatgtatggcagggcggtgggagagaagggaagagaaagccgtattataggaaaagaatttttaaattgggatgctaaataaccattgatcatagagagattcagcaggaggtgaaaggactgtggaggagaggggtacacacacatctttcccaggagctatcacagagcaatcccagctcagaatatctggggagtttccatagagtgtggggggcatgaaggggtttctcgggtctcctgactccttttattttctttctttctctgcttttttaggtggaagaaggctgctatgactctttggatgggagtctggcaagaggaaattggaagataaaataaataataagtgaaataa

SEQ ID NO: 37995 - DNA, 534 bp, Homo sapiens
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccaccca

SEQ ID NO: 37996 - DNA, 54107 bp, Homo sapiens; identical to SEQ ID NO: 36723

SEQ ID NO: 37997 - DNA, 54114 bp, Homo sapiens; identical to SEQ ID NO: 36724

SEQ ID NO: 37998 - DNA, 54107 bp, Homo sapiens; identical to SEQ ID NO: 36723

SEQ ID NO: 37999 - DNA, 54114 bp, Homo sapiens; identical to SEQ ID NO: 36724

SEQ ID NO: 38000 - DNA, 4160 bp, Homo sapiens
cggagggataatcggggcggccggggctgaagggagaggcgcaggagccctggggagagtggtccctgcccttccgcgcctcgagccatcgctaccgcccttcggaaccagtgcagcggccgatcagtaaacacagagactggggtctgtagagaaggggcgggacttggagggggtggggctcaggagaggtcttgggggcggggccggtagtatcggggagcctctgatggaggggcctggccgggggcgggatccagaaggattgaggggtcgccggaggcgggatttatgcagggggtgtttctccgcataaggagggacagtgggcaggaatctgagatcggggcgaatatgagaggtgtctgggggagttaagagtggaaactgggctggtgagagcgtagtggtggccaccagaacctgacttcctaccaactcatgcccctttcccaggatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgttcccaagagagagtctggtgcacagtatgtgctcaataaatatttattgattaaacaaacgaaaggatgagtctcctctgtggctagagaaaaagagacagtcggaccttggggtgataggccgagcagccccagcaccagttgtgacatctctctcccactccagtgcatcgtccagtcctacctgcaatggctccaagatagcgactacaaccccaattgccgcctgtgcaacatacccctggccagccgagagacgacccgccttgtctgctatggtgaggccttggcacctcggggggatcaggccagcctcaggggccagcttggtgactggtttccaggccctcctcaagcagcaggacagtgagtcccccgagtctcagagcccagattctagtcctgttaaagttccttacctgctgtgtaagttcaggcaagttattcttcctttctaggcctcactgtctttcctaaaaattaaagctcctagttcctctttcctaaaaattaagccctgccaatctggaggtttcagcgagaaccagtcaagcttacgggtatgctggtggccgtgactattagctagccagaccggcatgttgctttcagatattcaggatccaccactgattccaaggctaaacagagaggaagtgagtttcccacattaaagttagctaaaagaagtcagcagacatatgtgtcatgactttgacctgaatctggggtaagagccttagctccagtttttgaaggagctcatgcaagagtcagctccatatgtgtttctccttgtgagtgcatgtgtgtacttgcaggcacttaatgtacattgtgtgtttaaatgagtgttagtgtgttgatctgtacttggggtgaatgaatgggtaaatgtatgtatgtgaacatatgaacacaggtgtgttgtgggagtgcaagagaatgcatggttgagggtgcctgttagcaaacctgtgagtgtatagatgtgtatgtgtgagggctcctgtacccatagtgtagatatagggaatgccacttgtgtttgattatgtgcttataaggacatgtacatttgtgcccagggatgtgtacatgtatatgtgtgcctgtgtgtgtatcgaggaaccttttctgaaactgttcattattagccattagcccaaagaatatgatgagtgcaggcccagagaggactcattgaaaggactgaaaggggaggtggcgttttcttcctacccaaacttacccctgtgagctggacagcttggtagcacctgcctggacttagatggtggtagccaagaagactgacattttagggaacaggacggggaggagaaggctctggcacacacacatgtgtccatatgtcctgcaatggtctggggactattgctaggctaggagccctaagtgtcttcttcctcatgtctcttctcccctgtctcatgggccctaagatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctggtgagagtccctcgtctgtctgaccatctatctgccctgggccccacctgagtcagatgggtgggtggggacaatactaggcagcctggtgacccagattccttcctccagatcgatgaggtggtgagcccagagcccgagcccctcaacacgtctgacttctctgactggtctagttttaatggtaagtggtggcttccaccgactgtttgggctttagcctccctgctctgctgacagctcccttggtctgcagtcacatgctctacccctgagctctatgcactgcttctgctgacggctctctttccacccacagccagcagtacccctggaccagaggaggtagacagcgcctctgctgccccagccttctacagccaggccccccggcccccagcttccccaggccggcccgagcagcacacagtgatccacatgggcaatcctgagcccttgactcacggtgagcctgggagttatccaggccgcagaaggataggaagagggtggaatggtttgtatagggggagcttgaggatccagagacccacccggaggaacctttccttaatccaggcacagccattacctcctcacaattctgagatgttctgtcagactgaggagagcaggtgatccccctagccctccccaaagcggccagttttcctgagtctattgatgctagtggctccaccctgtagcccctaggaaggtgtatgatacgcgggatgatgaccggacaccaggcctccatggagactgtgacgatgacaagtaccgacgtcggccggccttgggttggctggcccggctgctaaggtacacagggtcaggcagggcggaatgccaggaaggggtggagagggaatgggagccagaggtcctggaagggatggtttcatgacaaaaggggcttgttctggggagtaacagtacctggtgctggggctgtgcagagaggccttggctgtgcagcagaagctgtgttttgcttctctctgggactgtctctatgcctcctacacaggaggtttgaactcaggctctttgaggccccttcccgatctgacaccccctaatctttgtaattctccccgacgtctgacacactgtggtttccagaatacagtcgtgcgcctcagctggtttgagctgcacaataacgccctatggtggcaggtgcaggagtgatcatccctgaggcacagacgaggagatggaggctcaggaatgggtggtgaccagggcttctctccagccgcgggggccaccagggactggggcctgacctgattttcccctcatccccccaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatt

SEQ ID NO: 38001 - DNA, 54394 bp, Homo sapiens; identical to SEQ ID NO: 37032

SEQ ID NO: 38002 - DNA, 12179 bp, Homo sapiens
tgcagcccaaagcctggagagaggctgctgcgccattgacctgtggactccagagactcccgctgtgcattcctctgatctggaaggtttcctgaattacgtgacgagaaacctgggttcgagtcctaacttgtcaccaacttcctgagtgacctgggctggtcccgtcccctcttggaatctctgtcttccatctcttcagcgaaggggttgatttataagggtgttttctgctctgacactgtgatttgaattctgtgtttccacatgatattcgagaagtctggccggaaggatggaatctgaaatgacaatggttctggactgggctttgtgctcagcccagctcatctttgcctgagacctaggagtggccccaggctctcctgatgtgccaccacgcttggcatctgctcctctccctgcccccatattcccatgctctgaaggggagttctctttcatagcaaatccgagaggagccgaggagccaggtcctttgttccagacccagaagcagccatggggacctgtgacattgtgactgaagccaatatctcatctggccctgagagcaacaccacgggcatcacagccttctccatgcccagctggcaactggcactgtgggccacagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggcaagagggtccttggggaagctggggggagcctccccactgagccggggctcagataagggtggtgacatgcctgtgattacacagcaagtttgggtagaaccatgggaatggcttcccaaatctggtcatggtccaaaactatgaatctggaaggcagggggactgtggagctgaagaaggtagactgagggttagacacagagaaggactttgcactagatgcactagacaggttgttcaagtctgtaggggaagtgggcaatgttttagcgaccttctgaagtgttctttcctggagttgatctttgttttgttgtctttatttcactccaaagatatgtcttatacagttttttttttattattccggatagattacacgaggggaaaatgttaagtttgcttgcagttacaatctaatagggccaattattttcccaacgctgctcagggctgagcttcaggctaatgttggatgcttgatcttgccctgagatgggcttccagtgtggctttcttgtggccgtccacgggcatgtccatgcccagagggaaatggtgggccgaggtgcctgggccggggttccaaggcatcagtgtgctgtgtggctgtgggagagtcacccagcgggctctctgcaggtcggctgatactatgatatcagcagatggcagcagtgcggggaatggctagaaggcgtgggcctgggttgggagagagggagacaggggaaagggagctgggctaacaggagggcccctgccgctcaagctgccctctgctcacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaaggcctctgggggattgtggagggcaacagtgtgtgtgtgtgagtctgtgtgtgtgtgtgtacacacgcgtgcatgcatccatgtccatgcatgtgtggtgtgcatgcatgggtgtacacatgagtgagtgtacacgggattgtgtgaatatacctatatgcttagtaagcaacacacacgatgtagccgatctgtttttcacactttacatatattgacccatttaattctcctaactatgtgggatatatattatattattattcttaccattttttagatgaagaaactgaggcactgaaaaactaagtaacatgcccaaaaccacacagctagtaattcaaatccagctagtcatttgaatccagctatggattcaaatctaagcaatcctgcccagggcccaatctcctcaccactctgctactcaaatatgcacccttgcatccttagataaggatatgcatgcatgcacacgtgtatgtgactgtacatgtcacgtgaacatgcggcacccatttctgcctgtgtgtacacgtgcaagtgtgtgggcatatttgtagatgtgtttgcacacaggcacgtgttagggacatgtgtaggcgtgtgtctgggggagactctctatatgctcaggccacaaagcggcaggagactgaggcagaacgagtccatgatggagcctgggacattttcaggctgctgaggtgggcatcacaggctggaggcagggagggcagggttagaggaattcaggcatggcccagctgctgtgtgaccctgggtgagtcctttctccattccggcctcagtttctgaggatctcacgatgtgtctttgtggtccccaggcactgagccattgcttggtagaggctaaagaaccgactggggttctgggctcagtcaggcccaagtcgtggcctggtcccacgtggccggaggatgcctcacactcacgtaacctctgaacctctggctttctctctctaaaatgaggattcataatagtacctcgctctgtgagcataaatgagatagtgtacctgaagcccttagcaccatgcctggcacagaactggtacccagtatgtggcagcttaaataggggacacatgaaaacacacctgggggtggcagatccttcccacaaagtcccagctgccccaagcatgagggtgtgcatggtctgaggtgagggctgccaggtagccatggcaacacacctctcctccaacatcctccctgcctggtctccatctgtcctgagcacctgccaggagaaggctgctcttgtgggcttcagggatagggaaggtgccattcttctgagaagccgttcctggggactggcgagtctcgagggcaggccctgcccagggtctctgccccctccctgcaccccaccctctcacggagggcgatatccatatatggggaatgcccggctttctggctcagcaaagggtggagagcagaacatattgagaccggccacttggggtcggtatttctccatcttcatacaggaccactgtgcgtgccagctctctgagaacagcgagttccatcccagattcaggcgactgggaaaaacaggcgggcaggggtgggctaggaaagccatactttggtgttgcttaaaattccgaaaggatttggggaaagcctggttttaagtgtgagaatgtgttattgtttttcttgggggagagcctaatttaggatgagggctccatccacacaggctcatgtaactgtgtgtaattaggaatctgatgaaattaaagatgccctcttcaggaacatgcgcacacacccccaaaatcaaaatacaaaaagactacctttgggaggccaaggtgggcagatcacctgaggtcaggggttcaagaccagcctggccaacgtgatgaaaccctgtctctattaaaaatataaaaattagctgggcttgatggtgggtgcctgtaatcccagctacttgggaggctgaggcaggagaatcgcttgaacctgggaggtggaggttgcagtgagccaagatcacaccattgccaccagcctgggcgacaagagtgaaactccgtctcaaaacaaaacaaacaaaggcggtccctggaactcttcccctctgccttctgcatggagacctagcccagggtgaattcctgtcctgcacaacatcctaggagcaagcaacagaggagtgtggctcctgctaaggaaggacttagagatggcctcctccttttacagatggggaaactgaggctgagggaaagccctgacttgcctaagatcatgctttaaacaagaggctggacaagagccctgtactgactcccacagtgctgaccctcagaaaaggggaaatttggtcatgattaaatctgtagacgggtatgacacagacttcctgtgcctctctgggcctcagtttcctatctggacactgagataggtggccctgtagatcctcactctgtaaggtgatgggccctggccctcgttgcccctcctcccctcttatctgctccacactggggttctcaacccaaagcctacttgaggatcagggagtctaggagcgcctgaacctcttgtaattggcatgcttgccaaaagaacccaagcagaattctaaacacaagactttaggagagagatttactggagccattataatcacccagtgggttcaccttgcctgctgcctagacagaaattatttatcaagacaggggaattgcaatggagaaaaagtaattaatgcagagcctactgtgcaggagaccagagttttataattactcaaatcaggccaggcgcggtggctcacgcctgtaatcccagcactttgggaggccaaggcagtggtcaggagttcaagactagcctggccaacatggtaaaaccctgtctctactaaaaatacaaaaattagtagggcgtggtggcaggcacctgtaatctcagctacttgggaggctgaggcaggaggatcacttgaatctgggaggtggaggttgtggtgagccaagaccccaccattgcactccagcctgggcaacaagaacaaagctccatctcaaaaaaaacaaaatcaaatcagtctcccttagcattcaggaatcagagtctttaaagataatttggcagctagggccttggcaaatggggaatgctgattggtcgggttggagatggaatcacagggggtcgaaatgaggttttctcgctgtcttctgttcctgggtgtgatagcagaactggttgagtcagattacccggtctgggtggtgtcagctgatccactgagtgcaggctctgcaaaacatctcaagcactgatcttaggttttacaatagtgatgttgcccccaaggaatttgggggaggttcaaactcttggagccagaggctgcatgacccctaaataatttctatccttgtagctaagttgttagtcctggaaaggcagattggatcccaggcaagaagggggtcttttcaggaaagggctgttatcaattttgcttcagagtaaaatcatgaactgaattccttcccaaagatagctcggcctacacccaggcatgaacaaggacagcttaaggattagaagcaagatagagttggttaggtctgatttctttcactgtcgtaatttcctcgttatttttgcaaaggtggtttcaccatgggtccccttcccttggggtagcagcacctctagaaaggggcgcagcaagcctagcatgtggcaggtagaagcaggaggtttgggaacacctcagtcctcccagtaagaaagaaaaagtcaaatgacgggaccaggggtctcaggcccattggtggaatgctctaaggactctgttccatgaaagggacccccaaatgccaaaggagcccagacccaaagaaggaggcagaacaaatccagtttgtcaatattgggtgatttattgagggaatttacagaccgaagtgggatcttgggtggccacaagacaggtggagctctgcattctcacaccccagatgcaaggcttagataccatagggaaagggtattcgtgctccagcaagacaaccaaaggcagccctccagaacaggcaagaacgctacgtgagtcacagcctacgatttgtggagtaacatcaaggttgacatgttcttacactaggggcagtaaataaagtagaaatcagaaggcattcacaagactggggcgaatcggaagtcaacacaggggagtggcatccaagatggagtcacttttgtctccacaggttcccactgcagacctgccgaggagtcagtccccagcctgcagctcatcagagagaggctgcagcgtcactcataaaccagagatctgagaactggggacactgtcgtttttttgttttttttttttgacagggtctcactctatcgcccaggctagggtgcagtggcccaatcatagctcattacagcctcgatctcctgggctcaagtgaacctcttgcctcagcctcctgagtagctggaattacaggtgtgccccattacgcctggctaatttttttaattttttttaatagagatagggtctcactatcttgcccaggttggtctcaaattcctgggctcaagcagtcctcccatcctggtctcccaaagtttagggattacaggcatgagccaccacgcctggcctacactgtttccaaaaggaaatgaaaagcctcaacacaacccagtgtcctccctggggacggggtaggaagccacgcaatggtactctgcatcacttcctcaaaggtggtatgaaagagcatttgctgacacaaacgaggttcccagccaaatgctgataaaccataagcagatgacacagcagcatgtgatatatggcgcttttccactgtcccatgcctccatagcgatgttggtgcagatggagccttattaacaccagtcattctatccatccagacagatacagattatatatatatatatatatatatatatatatatatatatgtatatatatatatgtatatatgtatatatatatatatacatatacatatacatatacgtatacgtatacatatatggctatactgtaggatacactccaagacacccggtggatgcttgaaacttcagatagcactgaattctctctatatagatatatactgtttttttcctcaacatacctatgataaagtttaatttataaattaggcacagtaagagattaacagtaactagtaataaaacagaacaagtataacaatatactgtaattaaacttctgtgaatgaggtctctccctctcaaaatatcttgttgtactctcctcccctattttggatccgcagttgggaggggttactgaaacccgggaaagtgaaactcccatcaggggtgactactattcatacatatgattctggaaaaaatatgccagatattaatagttaatgttaatagtggtgggagtgggataattttactgcctcctttgtgcttaatggcattttaaattgcaaacaaattatttcttaatttgtttcattcacttttcctttttttgacacgtgtctatcacgtggaaggatgtgatatggaaggacgcagggctactgctggcgtcccttttgcagggaagccgtctcctggcacacaggctacccaatgccacctttatttttgtttaaatcaaaccaagtccctgggaggcgcccagggtgggcccgcaggggcggctccacagtgcccgcggggtcccaggaccaggcgctggcagacttcggagtcgcccccgggccctccgctgcccaggcctcggctctccctgcaggtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaaggtgggcgcgggggcgggggcctggagggggcggggcctggagggggcggggggctggcgggggcgaggcctcatgggggcggggccggacggggtgggacgggggtgggacgggggcgggacgggggcgggacggggcctgaccccgccctggggagccgcccttacggtctcaaggccggtccgcaagagggcgcccgggagaagcttgcggaagctgccttcgcgcgaagtctggggccagagcctgaccgcgttcctcccagccgggcggatttgcctttggtctttggccaaatacaaaattaaagaaacttgccgggcgcggcggctcacgcctgtaatcccagctctcagggaggcagaggcgggaggatagcttgagcccaggagttcgagacctgcctgggcaacatagcgagaccccgttctccacaaaaaggaagaaaaaaaaaagacaaaaaaaaattaacttcccagaatgttaggggagtcagggactcctaaagccccgtagaattcagatacccccaagaatcttagaatgataaaatattaaaatcttagactttttgaataatcagaatgttgaaattgagaagccccacagaactatagaaggtgcctgacagtcacaggagagccctcaaaggctggaactgcggaccccggaggtcgtggagaccagatagttgtccagcttcatcaaatctgtctccagtttcttccggaagtggcagtgtccccctactccctgccatccagggtcccccgaaggtcctgatgtagccctctgtgcccaagacccccttcaccctccttcagtccaagcttgtccttgcccccttcctaccaggcaacaggggaggtaatgggttaaccacatcatgtagccaggtcaaagccatgcttctcacccaaaagtaggcatctttcacagggtggttcggggagatagctgcacatgggcgccatctggtgcccctcatggagcactggcctccatctgctccacactaggggtctcaacccagatcctacgtgaggatcagggtgcccaggagcccccagaccttttgtaattggcatgctgggctgccaaacggagcaggagtgtgcctgcaggggccaggctctgaggagggggaggtccaggagctgacccgtgggcagaggcaggggtccctggttggaaccttacagcccacagagagaagggctgtgccgatacggatcccagagagggggcgtcctgggaacgcatagctgacacaggggctcccccagggatggggttaggagagagagctcagccactctccagggagggggagctgcagtgaatgaaggggtcccagacaccttttgtaggaagtggccattgagctgggcttcaaggagtgaggacttcaaaggaaggatggcagtatgggcagagggacctgcctgagcacaggcctctgaggttgggggctcaggaaggtctgggcaaaacatgctcagaggcctgagtaatagagctaacggggtctgtgtgtggagcagttcccaggtgggtgcaaggggtcctctgtgtctgccctcggagggctggggctggggcttgggcactaagaagtaacttgagcctctcctggaccagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtgagcccccactccagccccaccctctgccctcagggccccactgcccagccccaggtgggctcccctgcacagctcaagcatccatcctcattcctgccggaacctgtggccctgtgcccccagcctacatgagaaagccgtcctcacactcagcccccagcacaataatccctctggcctgggcctagcttgagcccccttcctccccaaatcctcaccgtctcccaggctgtagctctcactgtctgtctgttcctgctggctcttctgggttctgtgtctggggcaagagaagagagaagggagggccagagagatgaaggggaggggagagtcacagagagggggtgggacagacagacgaaggaaagaaaagctaagtagcgggagggagggactgacttctgttctagtattttcacaagcttcctactgagggctttcctggagccaagtgaatggcacccatccggcagtggaagcagtggatgggggctggggccagcacaggggtggggcaggctgctccctggaaagctcacagtgcatgccctgtcctccagggactttcagggcagctgggaagtgaccctgtcagagacagccaggaaggagggggccagaatctcactctcctggcatcatccagtttccctacgcctcgtgattctgaggaaatgagtcccagagaggggcctgcacttgctctggggcacctggagaggtggggggtggtgagtcagggaggaacccagccccaggagttctgcagagcaggcctttcagtggcaggaaaccctgaaggtggggcaaataaggggcggcaagaggtggacacagtctcacctcagtgagacaatgatgtgggcgaagttggccttggacctctttgttcatgttttttgtcacctccctggccaggtagccaggctactcataatgccattgggatctttgtggctcagacatttcacccgcctggggcaggccaaaaggaaataaggagctatgattttttgcaggaggccagaactctctatctcctgagagggaagtagataataggagagaagcaggtgtcacccccactctacagatggggaaactgagcttcagaaagtaagatgctcccaaattcatacaacaaacagtaaagccaggactccatgggtctccaaggcctgtcatcttatccccacaccacgcatttctcttttaaagacttgtgggattgaaaacctggagacagggactctgacatctgggaggggccaccagcccactgtgtctgtgggttgatcactctcctgctacccaagggagatacagtccctgggagtctaaacaacaccccaggctctacaagatcctgacatcacttctggatcattcccttctctgagcagccagcgttccctttctgccgtctgatttcttccactcaccgtgtgtgcttcctctgaactcccgttcagtgctgccatggggagagctgtttgttttcaagcaaatgcatcagaacttggtggctccgagtgtgggtttttcaatgtagtccccttgggaaaagcatccttgttctcccaagttgccaaagcctccattgtgttttagcaggttcttctttgactcatcccttagaagccagttaacaagtcagacaagaacatctgctggtttttttgtttgtttgttggttggttggtttttttagtaattatgctggggtcattttttgttcgtaataacagatgacctaaatcagcttagtcacccacttcattcactagacccagctccagaacactctggcagtttccaaaaatcaaactcacccacgaaggcatctctcaagagcccctgagccatgggaggctcttggagagagacagtgactttcctctggaagggagtcagtttcctgggggtgggggcagtcacatcacagctcctgagcccctaactccctggctcaaggtgcccctcgctcccccaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgt

SEQ ID NO: 38003 - DNA, 20624 bp, Homo sapiens; identical to SEQ ID NO: 36987

SEQ ID NO: 38004 - DNA, 67197 bp, Homo sapiens
gagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaaggtcagcgtgggggtccctgcagcaccgcatcccggcggaggcgaggctcccggaccggggagccaccccgcgaggcccttccccacccccttcccccagcccgtccgcgcagccctgcgccccgggcagccacgcgtcgtagagtccctggtcggggcctgtggcatgttttatctcgggagcggcgatgctttgttgatcttgtctgcgtgtcgaggtccgggcgtcggggagggcatcagctccccgcggccgcgtcgctggcccccgcctcccccgcgccgctgtggggcgcagagcccgcgagcgcggcgcgagggtgggggtagggcggcgagcgggcttgtgtgtctgcgtgtcggggtgggggcttcctcggctcccaccccgtccctctgggaggctgggggcccgttgtggcgatcccggggcccgccgaaggcagggcagggtcggggcctcctgtgcggcgttggagctgggccggcctctggtcttcccgccaccccgtttcccgcctgccctcggcgaggcccgctccattccccccgccagccttgggctccgcggcggttaggccggttctggacgaacccctcggagctgcactgtcttccccctcccccaacgcccctgcaggcccgcgtgagggctggtggccccagggtcgcgcactccgttctccctccccgcttccttctcagagaggaaagggtgtgtgtccaggtcccgcccccgtccagcttgctccctgtcgagcttgctggtttgcggggtaacccgcttccccgcctttggggtccctccccgggacgcgagccgtgccagctcgcccgaggcctgggcagtccggagttccggagtgctggaaaagttgccgccttgacgtacccggcggggagagcacgtttgaccgctgctgctcatctctcctccaactcacttttcttagaccgttcctcttactttcgtcccgcttttgaattgggcaccttcgctttcacctctgtattaaaattttcattggcctggagttctttctgaccttcactaagtcagttttgccagcgggaaaccgtgcagttttgaattgcgatttacttcattaagatacacctcctctgtacgctgttgagggcctagctttaggaaaaaacttaattaaatttcattcggggggtgggattgtatacttcgaggtggatttggtgctctacgtcagatagtagtgccttgttcaggcagaattttaacattctttttaaaaggtgctgctcaagggtcacatcttaggaggtcctcttgaatggttgcttagcacccggtaatcattcaaaaagtatttgtcgaacaatgagtaaaagattataaggtagctgattttaactcttttaaaccaaggcaccagtggtgcttaggtccagggagctgttaagacacacaaacctttagtttctgacctaaggagcaaatgtaaaccccattgtccagctctttcccgattactagtcgacttgcaaagcatttttctgcctagttttgagtcttacaactcattggaaagattcatctttatgctgatagatgaaataactggtgttagaaggactgaaatttaatttatgggctttgaaaaatatatagtgcatttgagaggagtattttcacaaaactaagtgacagaaaagtataagatttgtttccagagtatataagaggatttttctttttcctaactggtattttttctttgttttgctctagttggaatgacaaagataatcttatcagtttgctatatttgagcctagggtgaattaattttatttcaaggttctttatgttttatagcataattaaacattttaaaaactatgttaacaattagttgtggactgaattggaagcattttcaagaggaacatctggagaattaatatatttcatcaaatctatgattattgtatgtacccctgaggaagaaagtcctgacaaaccataacatgccagtgatcataaacattttaagtaaagagatattaaatatggggaaataccttatatcacctactttattatgcatatttctaagaggcccacctggaaataagtaggagtcttattttccatagcctaccactgaaccacctttcccttgggaggaaaggcttactttgtacattgattgggccttggctgtgtgtatcttagttcataaattaaaagttgggcaagagctggttttgattcctgtttctggtacatttcagttatcaggattttctaaaacggcgtttttgcatgatagaaactggagaggggcctaaaagctatgaaagcatttgggttattttaattattttttatacacaatattttatttaatttttaatttatattatttttttgagacaggatcttgctctgtcacccaagctggagtgcagtggtgtgatcacagctcactgctgccttgacttctttagcctcctgagtagctggaagtacaggcgtggatcaccccgccctgctaatttttattttttgtagagacagttctcgctgtgttgctcaggctggtctggaactcctgggctcaagctatcctcccactttagcgtcccaaagtgctgggattacagtagtgagccactgtgcctggccagtattttatttatttaaattttttatttccgtatgttattggggagcaggtgtcgttaggttacatgagtaagttcttttttttttttttgagatggagtctagctctgtcgcccaggctggagtgcagtggtgtgatctcggctcactgcaagctctgcctcctaggttcacgcagttctcctgcctcagcctcccaagtagctggaactacaggcgcccgccaccatgcctagctaatttttttgtatttttagtagagacagggtttcactgtgttagccaggatggtcttgatctcctggcctcgtgatccacctgcctcagcctcccaaagtgctgggattacaggcgtgagccaccatgcccagccatgagcaaattctttagtggtgatttgtgagattttggtgcacccatcacccgaacggtatacacaacacccagtatgtagtcttttatccctcacccgcttcctaccctttccccctgagtctccaaagtccattgtgtcattcttatgcctttgcatcctcacagcataggtgatcagcttttctttaaaaactttttattatggcaggggtgtatttgacatagtaacttgagttttattaaggcagcattatcagagtaatgctttgggtgacttgtcaagtttcctactcttttcccctgtctaagggtgaaactcttggttggagtaaaggtggtacctgtcctatcattgagaggttatgactaggttatatcatacttggatgaaagatgttttataaactctcccttagtgattgcatgtgatacagaatctttaatggcatttaataatgttaattttaagtttggaatttccaaatttaagattttgaatggaatgggaatataacttgggatttttatctgggatgtactgagaattaaacaactatatcaccttttgtcacaacttagtaaatttttttcttagataaaagttagatttttcagattttattccgttaggatattcatttagagtggaagaactgctgcagacaaaaggaatggtttttagtgtagtgtgttcttagacctgaaaggttttgaaattcctccaggaatctcggatgacattgcctttagcgtgggccaacttgtcacttaaggaaaataattcagtcttttaagaatttttacaaaaagtatagacttgtcttatacttgtacaaatgtatttgatacttttttaaggttaatgaattacattccaaaggatgttgtttgaagtaatgaataattatttgctacccagaataatcaaattttgctgttgtagtacattcttaaactttgttttcttttttttttttttttttttttttgagacagagtctggctctgttgcccaggctggagtacagtggcatgatctcggctcactgcaatgtccgcctccctggttcaagtgatccttgtgtgatccttgtacctcagccacccgagtagctgggattacaggcgtgtgccaccacatacggctaattttatatttttagtagagacagggtttcaccatgttggccaggctggtctctaacccttgacctcaagtgagtcgctcaccttggcctcccaaagtcgtgggattacaagtgtgaaccactgtgcctggccttaaatcctgtgttttgttttgtttgtttttgagacaaagtcttgctctgtcacccaggctggagtgcagtggcatgatctcccctcattgcaacctccgcctcccaggctcaaggaattctcctgactcagcctcctgagtagctgggactaaatgcgcatgccgccgtgcctggctaacttttgtatttttagtagagatggggtttcaccatgttgcccaggctggtctcgaactcctgggctcaggtgatccaccggcctcacctcccaaagtgctaagatgataggcgtgagccattgtgtccggccctggccttaaactttgtttttatgcctctttctaacctaaaccatatttagatgctgaaaatgaatgaaagtgtcagggttaatgcataattctgaagcactttgtgaatcaacagaaaaataattgtttcatagaattttaaatctttgtgtggcatatacaattctgggttgcgtagaatattatttttttcatgcttattgtggaatagagatgcttctgtatttgctcaagaaggacggtggttaaaaaaattgctttattatagtaaaaacataacagtcaattggttttcttgttggtggacccttgctatggcttcaggttcatggttttgaggacctaggagattatatagttaagtctatacactcattaagattgttataatgtgaaagggaataagatctctaaactggggcacatgagcataaaaaaagaaggtgtggaaaatttaaatttataataattgctgcaaaataaaatattacatacaaaaaaattgtagatttacacaatacaattagtaagtaaatggcaaaactcctgtggcaagagtgttcagattactgtcttctgtacattatacacagggacatataacatctctttcctgcatgtgttacacaaataccccatatttcccagtgacccagcttataatggcctcgaggctcctgtgcatcttgcaaggtgaggagtggctgtaacacaactgggaggtacactgagtagccggcaggaatagcaacttcagatatttctcctgtcatcacccaagactagatagagttagctatccttaattgcctgtgtccaagagtacttgattttattagaaaagagtaaggaaggatgtgttaccagtatttggcattcagactgaacgagaagttaaaaatgagaactgtttactatgcttgcaacccacacaacactagacaaagccatagccgaaggtggtattagatataaggtgaaagtttaacaaacccgtcctattttactttaaggcagttattcatagtatgttgttaaaaagaaaaatctgagacaaatgttaagctgggtgggatatcggactaacagatgtacatcaggagagtcctgggcagactggaccatatggtcactccatttatagagcacatattgttctgagtttggctctgatttctccccagtgatgtgtatttaaaatttggctaaaatttaagtctagtgtgtatacattagcattatttttctgagttaattatataataagagtattattctaaaattcttgaaaactgagtgtcattaattacctgtgttttaaaagtggtgtgagccagcagcactgaacctgaccctaaggtaaaataatcttctctagtctgccataacacttgcaagggatgtttcccaaacctttaaagctgcctggacatgtgaagttttctgtttagttactcccgtttgtcactggaaaaacagtaaccttttaatctcaaaactcacagcggtccatgtaaatttaatttctacctcatttgcaatttggagaacgagtctcagtaattcttctgaatcctattatgaatgtaaatttaggactccagatttctaaaattctgctttggacaaattttggatcaacgatctctgattaatttgggaaattttagatgaacaaaagtacctgtagatatatcattattttgatgttattggtagcagtagaacttcattatacttattatttggcaagcaaattaaaagaaattttagtcaacatccatgtcctcaatctggattctaccatttacttttcctaaaaaaatttttataacagctttattgagatataattgacataccatgtactctgcttaaagtatccaaccccatagttcttagtgtattcacagatttgtacaaccatcaccccccatttgtacagtcaaaaaaacattctcatccctcctcccaaaaaaaaacctctacccttcagcaagggtccccattttcctgcaaccaccgctccctcccagtcctagtcaaccacaaattcattttctgtctgtagatttgccaattgtcttagtctgttggggccgctaaaacaaaataccagaaactgagtggcttatgaacaacaaaaatttctcacaattctgaacgctgagaagttcaaaatcaagggacctgcagattcagtgcctggtgagggcccacttcctgggtcatagaagtgcttgatgctgtgtcctcaccttggggccttttttttttttttttttgagacagagtctcgctagtacagtggcgcgatctcagctcactgcaacctccacctcctggattcaagccattcttcttcttcagcctcccgagtagctgggcatgcgccaccatgcccagctaatttttgtatttttagtagcaacggggttttgctatgttgaccaggctggtcatgagctcctgacctcaggtgatccgcctgccttggcctcccaaagtgttagaattacaggcatgagccaccgtgcccagcccctagggcctcttttataagggtactaatcctatccgtgtgggctctgccctcatgctctaaccacctcccaaagacctcacctcttaatattatcacattggtgattaggtttcaacatatgaattttagggggacacaaacattcagaccgtagcacctattttggacattttgtgactagaatcttaaaatatatggtgttttgtggctttcacttagcataatgctttcaaggttcatcttgtagcatgtataagtactttattcctttttattacctgctaatattccattgtatgtataccaccttatatttatccacttatcagttgatgaacattgggttgttttcactctgaatattatgaataatgctgccatggacatttctgtataagtttttatctagacaaaagttttcatgctcttgagtataaacctaggagtggaatttctgggtcatagagtgactccgtttaaccttttagtgaactgtcagactgttttccaaagcagctgcaacattttatatttttgtctgctgtgtggcagtttatgtcaggattctccagaaaaacagtaggctatagatagagaaatagataatagatatatatatagagagatatatgagaggaaatttgttaggggaattggctgacgcgattatggaggctgagaagtcccacgatagactgtctgcaggctggagaacctaccaagctggtagcattacttagtgtaagtccaaagacctgagaatcgggagtccatggtgtaattctcagtgtgagtctgaaggcctgagaaccttggtgggagagggatggggggagggtgatgggagagtggctgctggtgcaagtcctggaatccgaaggccatatcctgaaattcttatatacaagggcagaaggtgtcctagctccagaagggagataatttgactttcccctgccttgactttgttctgccctagcctcagctattggataatgcctgctcacattggatgagggtggatcttcctttctgtgtctactgattcaaatgccagtctctcctggaaacaccctcagagacatacccagaaataatcctttactagctatctgggtattattagtctggtcaagttcgtacctgaaattagccatcacaatttctccacatccttttctgcacttgtctttttttttttttttttttttcctgagacagagtctctgtcgcccaggctggactgcagtggtgctatctcagctcactgcaacctccacctccccagttcaaacgattctcccacctcagcctcccaagtagctgggattacaggcatgcgccaccacactggctaatttttgtacttttagtagagttgaagttttcccacgttggtcaggctggcctcgaactcctgatctcaggtgatctgcctgccttggcctctcaaagtgctgggattacaggcatgagctaccacgcctgacccacttgtctttttgattatagccatcagagtagctgtgaagtgggatctcattttggctatgatttgcatttccctaatgactggttatgtgcattttttcatgtgcttattggccatttctgtattttctttggagaaatgtctgttcaggtcttttttgcccttttttttttttttttttgaggcggagtctcgcactgttccccgggctggagtgcagtggtgtgatctcagctcactgcaacctccacctcctgggttcaagcaattctcctgcctcagcctcctgagtagctgggatttcaggcgcctgccaccatgcccagctaattcttttgcccattttaaaattggattatttttcttttttattgagttttaagagttttttttttttaagtctagagatgtttcttatcaatatgatttgcgattattttctgccattctgtagattatctttttacactttcttaatggtgttctttgaagcaccaaaacctttaattttgaggcttaatttatttcttcttttgtcacttttgtttttggtgtcatctaaaaaactgttggcctcattcaatacatatcacaaagatttgtgtaattacctatgttttcttataaaagttttgtagtttttgctcttatttatgtctttgtttcattttgagataatttttgtatcttttctaaggtgggtttaatctgacttagggttttttaacagactggctcttagatttggatgattgttggccttgttattgaccatggcagagcttgaccatgagtgcccctgaaggctgagggtaacagttgctcattgtggtagtatctttttgtatcagttttgtatctttagtgtcagtttgtggagagaggtggtagtttaaaaaactcactaataggtgttttgttttgcttgtttttattgtggtaaaatgtacatgcagtgaagtgcatagatctttaagtatgtagttgagttttgacatatatatgtactcatgtaaccatcaccccaatcaagatatagaacatttctgtcactcacaacattcccttgaacaataaatagaatcagaagcactctggatttaacaaagttgtttttaaaaaatgcaaacttggtattggtgcagtatttttaagttaaaacttttttcagttattaagaaaatctctgtcggtttgtctgttaggcatattatcttgcctaaggtggtacatcttgggttaaccacgtctggctctctagaggttaatagtgcttctcagtggtttcttttctctgatgtctttccttcattagttaccctcttattaaaaagaaaaaaataagtgtgcgtttgtattttaatgtctaaagccaaagaatcagtgtaatgtttatcataaagacaaagtcaccgagagatgaccataattatagacatttggtacagttttacttacattcttatgtatttctgttagcaaaggcagaatcaaaatatgttattaatatttattgtatatatttatggggtacaatgtgatgttttgacaaagtatgttaataattaagagcctgctatggatgctttgatattagtttttttttttttttttttttttttgagacggagttttgctattgttgcccagggcggaatgcaatggcatgatctcggctcaccacaacctctgcatcccgggttcaagcgattctcctgcttcagcctcccaagtagctgggattacaggcgtgtgccaccatgcccggctaattttgtatttttagtacagacagggtttctccatgttggtcaggctggtctcaaactcccaaccttaggtgatctgccctccttggcttcccaaagtgctggggttacaggcgtgagccactgctcctggcttgatattagttttttaaatgttacttaagctggtggtagaaacatcttcacaaaggcatatgatgatactaatttttaaaattgtactgtggcatttcagttagctattgccacggtaatggtaattaacaatcacaaaatgtaagtggcatacaaacataagcacttattttttgttcgtgagtttgtgggtcagctgacattgctcagctccacttgatcttgtccttttcctgagactagtacactcatgatgttctcatggtggcagaagtctaagaggcaagtagaaacattaagactgcttaaagcagcagggcctggtggctcacacctgcaatcccagcactttgggaggctgaggtgggtatatcacttgagctcaggagtttagaacagcctgggcaacatgaggaaatcctgtctctactaaaaatacagaacattagccaggcatggtggtgcatgcatgggtggtcccagccacctgggagactgagctgggaggattgcttgagcctgggaagcagaggttgcagtgagctgaggtcgcaccaccgcactccaacctgggtgacagagtgagaccctgtctgaaaaaaaataaaaataaatgaagactgattaagacttggtgtactatgacttctgccctcattatattggccaaagcaagtcttgtgcttgagcccagtgacaaaggtgaggaagtatgttctatctataataggacaagctgcagacttaagtgataaaatcatggatacagggaatgatgaagaattagggccaacgatgttatatatggaaaattgaaaacatttgcataagtacagtgaagaatataatgatccctcaggtccctatccagttcagcagttatcaacatgtgaccagtctttcattcatgtttatgtagtgcatcacagtaagagagttacatatgtctggttgtctgtttttgtatgttaagctgcattagttgattcagatgttaccagcttatccgtcattatcaggtttctcattaaccttttacttaatggttttaatagccaccgttcagtgcttatcaaacatctgcaatgaagaccatttaaaaaacatttccagtactgaggactgctacttttgtaaaatacagtaaatttctagacaaatgaaaatttaaaatccaatatattttaaaagcccccaatttttattatagatgcaacagaaataaaattactttgtcaacttgttatgcaaatttatggatgcttatataaaacttatggattctttttttgtcatgaactggtaacagtttgcttaaaaacgttccttcactaactatgtggttaccctggtaaagtcagaatacatgcttgattcattctcattattaatactattttaccaattttgtaaatagttttttcagattttattcattatttccaatggtgcaattaatgtatgctgtataatagaaagggtcgtatgtagaaaagagactgggtttatgaagtacagaaacatcttgaaaaatagaccacatactaccacatactaaatacttgtgaaattgtgacactctattacttgaagtttaattttttttctttttctgtttgagacagagtctcactctgtcgcccaggctggagtgcagtggcactatctcagctcactgcagcttctgcctcctaggttcaagccattctcatgcctcaggctcccgagtaactaaaactgtaggtgtgcgccaccacgcctagctaattttttttgtatttttagtagagatggggtttcaccatgttgcccaggctggtctcaaactcctgagctcaagtgatccactcgcctcagtcttccaaagtgctaggattacaggcatgagccactgtgcctagcctaatttatttcttaaggaaaaaaaatgtataaatgtgttaatattttaggaatagtgatcacgtgataatcaaaattgagagtgttcacaaattcagtatatttagaaaaatacagccctttgattatctttcatctcttcataaaaactgtctcgtattttaaggtcatctttattagtacattgatagtatggggagacaaactgaagagaacgagtcagagtttgggtatccatctgtattgttttcatttcttcgcttctttgcaagatgcctttggttcttcatgcaaacaggctatacatgtgcacatacttaaaatcaccttcaaaagtaatttttgttaaaatactagatctcagtctcctcaggaatgcagagtgagtcaagacaactaaaggtgaatgtaagaaaaaacccaaggagtttaacagaacaactaatcagactgaacatagttcagaacttttccttctaatattttgatagtttgacaacagtttttactgaatgtttacccttttcaaaattgtgtatgttgccagctttaggaaacaagcaggttgattcgggctgattgatactggtttaaacctacgcaaagataaccttgttcctcagttggctaatgcttgttattgaatagaaaaactagctataataaagattttaatctttattatattaataatatattaatattaaaaggatttaaatatcatgaggcaggctgggcatggtggttaacacctgtaatcccagcactttgggaggctgaggcgggtggatcacctgaggtcaggagttcaagaccaacctggccaacatggtgaaaccccgtctctactaaaaatacaaaaattagctgggcatggtggtgcactcctgtaatcccagctacttgggaggttgaggcaggacaatcacttgaacctgggaggcagaggttgcagtgagccaagatcgcaccactgcactccaccctgggcaacagagcgagactctgcctccagaaaaaaaaaaaaaagaaaaaaaaatcacgaggcaaagaacagtatactttcattttagtcaacagtgccaacttttcgtagttatttgagaactggtcacatacgtatattgtgtcaacaaaatagtattgccttaactttctggaaagacaagtcttaggataattgaaactcgaggggaaaattggcgttgttttcaaaggttaaaaaatcagattagaaattgtggccctggaccaactttaaatttcccctcaaattagaagaaaaagataatagagaattgttctattttcttacccctagtgttcataatgtgcagattacatacagtagaactgtattcagtttacctgagaagatagaattcatcaacccaattccatgattagggtatgtgtatggggttctggctgtctttaggtgggtgctagaactggtaactaagttgaagctaaattgctttttagttcattgatttagatagtacattcagctgttcattatattctgggaaggtgcccacatgaacttgaaaggagctattggccccttgtagatagggtagaagagagtctggactactttgaaaatctaagagatgtgtttggttagcaaaagaagatgaagctgcagtcagaggtacaaactggttcagttaaggaggaaaaataattgaatttgaaacaatatacgtaacacgtagaaactaaatagtctttaatgaatacctactagcttgaaatctcattagggaaaagagttttttcaatgtatgaagttattaaccaagagcagtgaaaagctgacataacatatgtcagtagagacttgtatttcccaaatctatcgaacattgaaaacttaaacatagtaatttattgaaggcactcccatagaatcctatctgttgtgtactcagattaaaggaggtagtgaaaatgaactcagatgaattaagtgattgaaatttttgtttatatttaatatctacacatttgttaatataagactaatggaacaaaagttagtgatcataatttaggcaacatgaaacagttggtaattggtaaacattgtttatatgaccaaatgtagatctaatattgtacattattgcatcagggtatgtcttgtgacttccagatttttctcaggtataaacacagttttctaaaggcattttatacatttgttacctaaaatgaacaactgtgtaactgtcagctatacctagaattttttatcagaagtattttagattttggattttggagtatttgtattatacttactgtttgagtgccactaatccaaaaatccaaaatgtttcagatttttggattaaggatgtttaacctgtatatagaaagagacttatttagacaaacttgaaagactcatgtactacttacacatagggttttgttttgttttgttctatgttttgagagaatctcgctctgtcacagcccaggctggagtgcagtggcatgatcttggctcactgcagcttccgcctcatgggttcaagtgattctagtgcctcagcctccggtgtagctgggattacagacatgtgctaccatgcctggctaatttttctatttttagtagagatgaggttttgccacgttgcccaggctggtctcaaactcctggcctcaagtgatcctcccatctcagcctcccaaagtgctgggattacaggtgtgagctatggcgctcagccttcagttggtttttaaatgttttgctgactaaaatattaagggattgcacttgtccattcataattgtaggaataataagttgctacacttttctagggatcttactcaactgttcacagaatacatagagaaatggcaaacttggtgagttatataaaaatctagcatgtctggctgagtgcggtagctcacacctgtaatcccagcactttgggaggccgaggcgggtggatcatgaggtcaggtgtttgagaccagcccagccaacatagtgaaaccccgtctctactaaaaatatgaaaaattagccgggcgtggtggcaggtgcctgtaatcccagctcatcggaaggctgaggcaagagaattgcagtgagctgagaggttgcagtgagctgagatcgcgccactgcactctagcccgggctacagtacaagagtccatctcaaaaaaaaaaaaaaaaaaatctagcatgtctattcctgatgactttttttttttttttttttttttttttgacacagagtcttgctctgtcacccaggctggagtgcagtgatgtgatctccactcactgggtttcatcatgttagccaggttggtctcgatctcctgaccttgtgatccacccgcctcagcctcccaaagtgctgggattacaggcgtgagccaccgtgcccggcctcctgatgacttagctgggctcacctctgtttcttcccttgaagccttgggatgtcttcctgttctatgagaaattccttgagacacactgggaatccctttcccttaaggaaaagcttttctgcaactttatgtgactcaatatgaattaacataatattaacaatggcaatgatagttgtgtcattggactagtggaattttaagatattaatatttaagatatattgtaatttcagagatgcgtggcttctttcacttggcaagtttgaaatgattcatttatgttttggggatttttcagccagaaaggacagcataccactctggagcaatagagaattttaaaagagcagtttggctaaagagtaggccaggttcttataggtcttgggaaatattttgagctttattgaacagtctaaggggaagtcactgtaaggttttgagcaaaggaagatttgaatctgattttttttttctttcttttaagcacactggcatgttatccaaactcagtatcaccagtaatggaacaaaatgacattgtgtctttgcattgtatcatatcaagaggaggcatgataacattaccaatgtaaatttcttgtcaaatgtttatctagaatctgatcatgatacaacaaagagatccagtgtgggacattctacaaaaagctggtctgatctttaaaaaaggtcaatgccataaaagactataaaaaggtgaggaggtgaatagttgaaggagacaatgtatgacaatgtgtgtactgtgtgtgtggtccttgatagattatggaattttttaaaaaccataaacaccttgtttttgacaattggggaaacttatatgtagataattatcaatgttaactttcttggatgtgataatgatattgtagttacataggagattgtccctgtttgtaggagatgcatgctgaaaaggttttgggggagtgaaaggtatacagtttaagtcgttcaggtggaaaaagtgtatgtagatggaaataaagcaaatacagcaaaatgttactgatcattgatatagatgaagagtggtgtttattgtaccaaactttcaacttttctttaggttaaaaaatttaaaaataaaaagggatagggtagaacaacagaactacagagtcttactttttgatttaacattttagtttaggttccaacttcattcagtgttatgtgagatgatggcctcttatgaaaaacctcagtaaaattgaccaacattcctttattttaattattaaaaattttttttaagagatagggtcttgctgcattgcccagactagtctccaattcctgggctcaagtaatcccccctccttagcctaaaaaattatgtgtgcttttaatctaaaatacccaaaggctttttttttttttttttaatccagtaattttgttggagtatgttttagggttggtcgttctgagttcatagactaattttgattcatgttctctcttgccttgtgtaattttaaaagtatcttttagctactatagaaatagtacattctagttttgagctgaggatgtctttcttgcttattctcatagagacatcattctgttctttattccctctattttttatttttatttttttgagacaggatctcactctgtcacccaggctggagtgcagtggcatgattatgactcactgtggcctcaacctcctgggctcctctcacctctgcctcccgagtagctaggaccacaggcacgtgcacccactcccagctaatttttttttttttttttgagatggagtttcactcttattcaggctggggtgcaatggtgtgatctcagctcgctgcaaccttcacctccaaggtttgagcaattctcctgcctcagcctcccaagtagctgggatcacaggcatgcaccaccacacccagataattttgtatttttagtagaaatggggttttaccacgttagccaggctggtctcgaactcctgacctcagatgcttcaccctctttggcctcccaaagtgctgggattacaggtgtgagccacggcacctggcctaatttttgtattttttgtagagacaggatttctttatgttacccaggctggtctcgaactcatgggctcaagcgatctgcctccctccactaccgcctcccaaagtgctggtattacaggctttagtcacagggacctggcctcccttttttttacttttagtaactttgtatgggatttaacttctatactttgtttcctttttatgtgaatttagttttcctcaacttttagaaggaagctagtcaagataacgtttctaacttcatacaacttcctcttctgttaaaaaattatggcacttgtttcctaagaattcctggctctgtccctgtgccccatgttagtctgttccttctccctttttcctgtcctgttagttttggtcatctcccagcagtggctcttcatagcaggccctctcctggaaaggatctctgactggttagtgtcaagggttcatgggggttaaactctcctggcccctttatgtcttaccttgggttccctgccacttgtgtactattggtgtgggcaaacctcctcctagcgcgctgcggttctctaattgggtgctgtgccttctgggtcgtacctcttgggtgttgggaattctcctgttttcaggtcctttaataaggctggattgcttcccacgtaggtgctgtagcactagggtttgtggctgtggtagtttgtcaccaccaacttgtattttggggttcttgtaaatgtctttgctatctagttgttcagtaattatgtgggatccaagaaaatcacaaaacatttccataaacatttccatctccacttttccagaatctgctagatcttcttaccctattcttaaagagtttgctgtatatggtttaattttttccttaatattttttcttgatatcttaaaatatatctatgaatattgcttattttattatgatgcactcagggcagtgagggatattcaccttaagtctttaggcatttgtctttttaatagctttatgtaaatagatatggtagatttttctatcttgtgatgctgaattttatttgtctctgcattgatgtgactaagtttcttttttctcattaggatggtttttctaatatctcgaatctaattatcaaactttacaactgtgtgtgaagtgtgagcaaataaatgccaggttttgagggagaggaactttgcttttactagtgggagcctttttgttttctcctgaattgtcaaagctgtgacagttgctgcataggcaaggtcatacccacagtagaaggaaatagggcaaggattcagtttcttcagtaatctcttgtgtcacagaattgaacatttattgctaaggaaacaggaaaattcttttaaaatacattttttgagtaaagattagtttacttaaataaatacaggcagtccttgctatgcaggataagtaaaacagctaaaaataataatgcaagctgaaaccatgcaaagcaattttaatagtcagtgggaaaattacaattgttttgtgatctttaaaaatttttgttaaatcactaaaaacttttgtcaattacaaaagtgtagggaaataaaaaaatagtaaaactactgtttactacagtataatttaaaatactaggaacattgagaattaaagtattttatttctttgtaaaaagcttatcaatagtagtttaaacagcacttctctgtgtcgtttctgtgccttggttgcttccaacattttatcctttgcagttttaatgtcatgaaatatctcctagagttgctttaatgtgaagtattttcctggagtcacttcctttgggacgttgccattctttccatcacaaccagtttcctcactgatgttggtaagttctgtggctgtatatctagaggctctcaaaccctgtcagccttgccacagtcagcattttcttctgtaactccatatattcaaatttcactccagcattatcacttttcatttctttgctgcattttcatctttgttggccagccccgtttggattatctgtatttgtaaaaagtcctttggggtttatcagtgtaagacaggcaacacactgcactctggctgtttgttgtccattgaccaatcaccaatagaatgaaagaagggaggtgattggtcactgatcctgatgttcatctgttatttacatggtggtttgtggactgaagagctggcaatgaagtttgtcctttatataattactcacagtaatgtatgataactgaaatttgagccatgttgttggggactggtaattaactaaaccttggtataaaccatggtaattgaaatttgtgcatattaggattatgcaaggcaggaactctgcctgtaatgtaaaaaagcatacttagatttggtaaaaatggtaaagataataatgggactgagtctgagaaatttatgcaataatgtagtgtttaaaaatattttttaaaaagttaagattaaggaattatagagaaaatccatgaaggggtgtgtgtatgtgtatacattaatactaagggtaaaggtctgaaaggacaaagttgtagtttgttctgtgatttcacttttctacggtattgaatattcatatgaccagaaccttcatttctatgacctgagtaatttcttctggcaccggattggctccctctcacaaatcctcctctgtagatgactgatttgtttgttactttttttttttttttttttgagatggagttttgctcttgttgcccaggctgaagtgcaatggcgtgatcttggctcacggcaacttccgcctcctgggttcaagtgattctcctgcctcagcctcccgagtagctgggattataggtgcccaccacaatgcctggctaattttgtgtttttagtagaggcagggtttttccatgttggtcaggctggtcttgaactcctgacctcaggtgatccacctgcctcggcctcccaaagtgctgcgattacagctgtgagccaccatgcctgaacgcttgttcgtttttgcagcagacggaatagtggtgttgtaggttaggcctgcatttattttttgcagataaatggagaagggaggaatggtggaaaagattacacaagtggctaaaggactgacttaaggtttttatctgcaaattttacaactagagggagaaaacctccctaaatatgtttattgtaaacatttaggacatattgaagagtataaagaaataaaaatataaaatcacttatagttccattacttagatgaactacttcatcactcttaatattttggtgtatggccagccatactcttccttttttatacatgcatacagacttttgcacttttatataagacacattgaagtggcattatactgtacatgcttcctataagtggatttccagggtacacacaaacttttaaagcgtttctttatgtaaaatttaaaatatacaaacaaacaaaaaagcaaacaaaaaaaacccccaggatagaaaccagacgagtacaatgaacttaatgtacctatcacccaacttcagtgatttcagtacacgggcagtcttgtttcatccatagccacctacttttgcattattttgaagcatcttccaggtaagtattttggtatatttcagttaaaaacttgacattttgccaaattaacctttcagaaaagtgttatccatgtatacctgacagcaatcagatttaaaaagtctttttatttttatttatttttgagacagaattttgctcttgttgcccaggctggagtgcaatggcatgatatcagctcactgcaacctccgcctccggggttcaagcgattctcctgcctcagcctccccagtagctgggattacagtgcccgccaccatgcccaactaattttttgtatttttagtagagacaggatttcaccatgttggccaggctggtcttgaactcgtgacctcaggtaatccacctgccttggcctcccaaagtgctgggattacaggcgtgagccaccgcgcccggcctaaaaggccttttaaaaatcttagtgttatgagttagatgcatatatatcattttcctcagataatacaaaaaaaatcctaacagtgaatttggccatgcttatactctagtgtcaaacttctagtttccccatcagtatatatccctcataaaaatgttgtgcctattgatagggtgaccgaataacttattgtccaaactgggacactttgagattgaaaggatgcactgttaataataatgcccatgtaataaacataaaccaggactatattttggcgcagctggattgtgtgctcatcctaccattagatcatgcatgtaagatatatatacacatgatcactatattacatagtcaataagtggtaagatttattaagtttaagtgtttaatatatgcccatgcatggatatatattaaaatcttccctttaaaaggggtattttgaattggtaactcagaaagtcctaagttttcattcctatgtgtttttggagctgacagtgatcattaatttttttttaagtactgtagctttaattttcataattaagactttgtatttgtattgatatttgcagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccggtagacttttcactaatcttttcatgaggagattgaacttagattgtggaatattttattattaattttcttgagcactgaatttttctacgaaaataagatatggaatggttttatgagaaatttcccatggctctgatttggggagaaaaaggaaaaatttaagctttcagtttaaaaagattaattttaattgtacagttaaaagaacttatcatttgagtattttatgttttataggatttgtgggtcagagttagatgtagctgttgtggccattcattcatttacttaaaagcatttcatcaaaggaaagtaggaagttggctagaatactccaaagagaagaaatctgtgtacaataagtgtttttgcttcctatcccaatagactagtttctaaagtatggagatttcttaaatctaatatatgggctaattttgacagcttgtacccttagaactagtcaaaataacagccagcttatgtagtttcttcctttaacaactatttttggttaatgtcatgctttctttttttttgaggcggagtctcacttggttacccaggctgaagtgcagcggcacgattttggctcactgcaacctccacctcccaggttcaggtgatgctcctgcctcagcctctcgagtagctggaagtacaggcggatgccaccacacctggctaatttttgtatttttagtacagaacgggtttcaccatgttgtccaggctggtctcgaactcctgacttcaggtgatccacctacctaggtctcccatagtgctgggattaccggcgtgagccaccgtgcccggccagtgtcatgctttttaatgcttttttttttattgttgttttttcttagattaagactgttacgtagaagcaagcaactgtagtttatgtccttaattggctcttaaactctaatattagatgtactatgcttctcccaaaatttaaaattttatttttcttaaaagaattgtctttccagtgtgaaagtggttaaaagaacttttaaagacttcacagacatgtgtgcattatcctgtgttttgttggttctgaagtagagtgaattagaaattataaaaggcgggcttaaatttaactctgctctggtgttaggatacagataacaaatgactcttttaaactatggaattttagagtaataagggacccttgagtttatctaattcagctgattttatttaccagcaagaactagttttttagagggatcaaaaaactctgtgataaatctgaatgcctctctgtcaaatcagagctccatcattcccctcacccaaaacaaacaaaaaatccccagcaaactaacagactaaacagatactagaataggatagctgaatacttggcaagagaaatctaatggtgtttcatgtcacttgatcataaacagtgtctaggttcagcttgtacctagaatttcccttatgtagtaggagaatagaaactatactgctgtggcttttattactgtaatcctttctgtagaaataactatttgaccaccccttttctagaacattttgtgacatgagagacatcttaacctacctatttttattttttttttattatttttttgagatggagtctcactctgtcgctcaggctggaatgcagtggtgcgatcttggctcactgcagcctctgcctcgcaggttcaacctggcagattctcctgcctcagcctccggagtagctgggattacaggcatgtgctgccatgcctggttaatttttttatttttaggagagatgaggtttcgccatgttggccagtctggtcttgaactcctgagctaaggtaatctgcccgtttcagcctcccaaagtgctgggattacaggcttgagccacccctcgcggcccacctatttttagaagcttgatctgcctgatacataaaattggtatttggaatgaattacggcttattgggccttgtgattgcaggttactttcagaatagcaggatagaaatggaaggctcaaagagtgattagcttttaaagatttgttgaaataagactttcttaattggtttaagtactacttgagttttatccttaactaagtccatgacttttttgtttttttaatagcactaagaatcttatatcctagagttctttagcagattaaggggtactgggcagtcccatggtggttatcctttgtgaaactaaatataatataatagaatctagaggtcttgattattcagtatgtgttttatagaattttagcttctgttttttttgtttttgtttttgttttttttttttgagacggagtctcgctctgtcacccaggctggagtgcagtggtgtgatctctgctcactgcaagctccgcctcccaggttcacaccattctcctgcctcagcctcctaagtggctgggactacaggtgcccaccaccatgcccggctaattttttgtatttttagtagagacagggttttgccatgttagccaggatggtctcgatctcctgacctcgtgatccacgcacctcggcctcccaaagtgctgggattacaggtgtgagccaccatgcctggcgttagcttctgtatttttaaggagttaggttatagatctacccttaggggtaaccccatccccctttagaattgttatcttaaatatcatttttatcatctgagtagcttgtcttccatctctcttttgcaggacacacactaacaaatgtttaccacatctcaggttgcccatacaaagttcaaaaggtgcttttgagctcattgaagttgctgtttttttaaaaaatgatctagcttgctgagtattttttttttctctcactgttttggtttttatttttttaaattttttgtagacatggggttttgccacattgcccaggctggtctcgagctcctgggctcaagcaatctgcccgtctctgtttcccaaagtgctgtgattacaggtttgagcatccatgcccagccttactgagatttttttttttttttttttttttataaatttgacttatgttgtattgttcttctggatgtattataaatctagcaatatactttgtatatttttatatgacagggaatcactatttaaaaagtgtgttgcagtccaaatttgtaagtaagtttttattagattttacaatgcctttttctttgaaatacagataagtcagatttatctgcaaactcaaagtgagttagagagtaccttaaattgaataaagggcctaagtataccttcattgtgtgagtgggcatgtgtggcaaactggagagcatgtgcagcttgaaggtgcaagccactttatgattccaattggttgtagttatgcaggagtgaaggcccagtgtttccagatttttttttccctgaagaaattccagaaatctgaatttttgtgaaattcttgatattaaaatgtttaagtttttttgagtgaatactcatggccagtgtagatgtattagtggccaggagaggaacataggcctcagtttgcagttttcccttattatagtagtttgactcccaagttaacccatgctctgcaaattataagatagctaaattatactactgacctgatttctgagagcagggcatgtgggggcagaagtgttactagctccctttcctgggctcagggaaaattgttggggatggtggatgctgtaaacaggcaaagttgggtaatgtatactttctattctgccgtcttttgttgtagagtattttgctctgagccatccagggccttcataataccttcagttgttgttctttgacctgctaggctctgagaagacctgtattttcaccatctctagaattcttacgtacttcttccattgataaggaaacaagtaaaacaaatccatgctaagtatcacagatagaaacattggtattatctatttggaagtttgtgcttattaacaagtaaatgctgaattgatagacttctaaacattgcagtaaagtacagtaaaaataattaaaccacgtaggatgacaattcgctgtgatataattagaatttgctacattctaccaaaaacaacgcaatttctggatctgtgttgtttccctcagtggtacaagggagagagggcatagaccttgtataaaaattaacagagattcttcactgattgttccttaaatcacagtgctattatcatctctggaggacctaattctgtgtatgctgaagatgctccctggtttgatccagcaatattcactattggcaagcctgttcttggaatttgctatggtatgcaggtatgtcagcaaatttgttttgaaagcttacttatattttattctgtttgtgagtcatactgtattagtattttctctctttaggatatttaggatacttagttggatgagataacttgtgcatgttacaactatgtgaattgccacactagtatggcagaactggcctgatagggaatctattttcaaagtagtaagtacactgtttcatgtaacaaaacactatccatttaaaaaaaccttggacatgcaaatttacataaaattttcagaaatagtacatagagctcctgtatacctttacccagtactccagttgttgacatttttgaaccatttgaaagttgcacacgtgatgccctgttacttatatttcctaaatattaggacactcttactgcataaccacagtacaactatccaggtcagaaaagttaacatttactcattgttagaatctaatccacagactccttcacatttcacagtttgtctcattaatatcccttataggccacagatcagtcaggactatgtgttgtttttagttgttgtttctttagactctttcagtctgaaatagttcctcagtgtttccttctctttcatgagcttgaaagtatttttaaaaagtacgtgttaattattttgtagaacatttcccaactttggtttctgtgatgattcctcattgttagattcaggttatgaacttttggcaggagtatcacagaattggtgctgtgcttctcagagcatcttatcaggaggcacacggtgtggatttgtggcatgacaggtgatgttaacttggattatttgggtaagatggtatctgtcgggtgtctccattgtaacattaattaataagtatatgtgccttggttttatatcaaaagtaagaataggccaggcgtggtggctcatgtctgtaatcttagcactttgggaggccgaggcgggtggatcacctgaagtcaggagttcgagaccagcctgaccaacatggggaaaccctgtctctattaaaaataacaaaagtttggccaggcgcagtggctcacgcctgtgatcccagcactttgggaggccgaggcgggtggatcacctgaggtcgggagttcgagaccagcctgaccaacatggagaaacccccgtctctactaaaaatacaaaattagctgggcgtggtggcgcatgactgtaatcccagctccttgggaggctgaggcaggagaatcacttaaacctgggaggcggaggttgcggtgagtggagatcatgccgttgcactccagcctcagtgacaagagcaaaactccttctcaaaaaaaaaaagtaagaataagtagggacttactgagatcttgagataagatactcttcttttcttttttttttttcaattactttgtttttagaggggttttaggttcacagcaaaattaagaaggtatagaaatatcttatatacctccaacctctacacatgcatagcttcttccattatcaacatcccacaccagagtgatacatttgatataactgatgaacctacatcaacacatcattattcccaaagtccttagtttagattagtgttcattcttgatttttgtacattctattgttttggacaaatgtataatgacatatatctaccattgtagtattatacattttcgactgcccaatcctttgtgctttacctgttcatcccccatatcctggcaaccactgatatttttttatcgtctttatagttttgcctttttcagcatgtcatgtaggtggaatcatacagtatgtagccttttcagattggcttctttcacttagtaatgtgcatttaaagttcttccatgtcttttcagtctgggtagctaatttctttttagcactgaataatattccattgtatggaggtatcacagttcattcactcattcagtaagtgacagtttacttattcatctactaacgtcttggtgacttccaagttttggtaattatgaataaaggtgctatgaacatccatgtacaggtttttgtgtggacataaatgttcagctttttcagtatattctaaggagagtaattactaagttgttaagagtatgtttagttttgtaagaaactgccaaaactgtgttccaaagtgggtgtacaattttgcattttacagtaaaagcctcttctttcctttcaaagttctttgaaaagtgtttgattatgagtttgacttggcaaaaagaaagatttttttccatctagtagtcttagaagagcctgcaccctgattgagttgaatattggatattggctggcttcttttttttttttgtcccaaggtgtaatatatttatataatttattgattttctttgtcagagtactcagtgttaatcatatagcacaacttatagttatattaaatggttgttagtatattgagaggctttgtaacatttcctaaggaagaatctcacaagatatatttttaaggcctacttatagtgaaatacgtctgaaaaatgctcctttaatttaagagataatggcttagtgtttccccattatgtcagtttcctgatataattataaggccaaattgttctgtcattcactaggatgttttatagccaaagccaggcctgctgatgttaaatgcataacaatttttgcctttattatcagctgaacttttgtagtaagataatgggatatgctgatcttggttatttgggcagaatttgtccttccataaaataatgatatagatgatgccgtctagctaacgtgtgtttgtaaaggactgccacttagtgactaggttgggtaattttaggacctaagtgtatacctttgccccccatgacattctgaaatttgagcaatttcagtgtcttatataccatcttttcccactaactggactctcctgtcagaggctttctaattgcttcctggtgattctttgctttagaagaaaaatgtctatactgctccctttatatctcttaactgatttacatcccccagcctaaaaaatagaatattggtagagcttttgaaactttgtatgtctccattcacattcttctcttcctatcagaggtgaccaactttcctgaattttgttattcattccctttcttttttttatggctttatgcatatgtttatattcctaaataatatattagttttgccgattgacctatatataagtgaagtcatactacctgtattattttcaactttggttttgagattcattcatgttagtacattttattgtaaattattcattttcactattgaatttgtttgaatatagcatgttacttttacattccagtgttcataatgttggctttctagtttctttctattatagacaatattgccatgaatatttttttacttgttttctggtgttatacatacacaaaattttctctagggtaactggccgtaggaatgctgggtcataatgtacattttcagcttcactaggtaaatgatattttttccctcagtttatgttcccacagcaatatataaaaaatcttctgctctatatccctgccaacccttgacatgattagattttttttttttgtattttcttatctgcaaaggtattaaatgggggtcacgttgtagtcttaaagttaattttccttgttattgtaagattcatacgtttatttgccatttgtgtttactatagacacttgttcatttttatattaaattgtctttgttattgtgttgtgggagcctttatatattctggatactaaacttttcccaactatatatattgcagataccttctggattgtgacttgtctcttcactctttatggtttcacttggcttctttatatactcccacaagattttgtcaaattatttttattgggcagaatttccttccctttctcccttcccaatctaaaacttataaaactttgacatataagaaagataagaggagatgatctgattaggtggtagacctggagtactatatggctttctttgaggcagttagaaccttggggtttatccaggaatccatactggccacatactttgctagggcccttgggctgtgaagagacctgaagacatggaggagagaacatagtctattttgataatcactttagtttgaatggactggagtaggaaatgagggggaaggtgaatccaaaaattagacaagggccaagtaaggaagtcttgtgtttaatataaggaacttggattttatcctgtagaccaggcatcagtaagctatggcctatagaccaaatctggcctaccacctgtttttgcatgacctgcaagcaaagaatgattttttacattgttaaatgattgggaaattgaataaaaattatattttgtgatgtgtgaaaaataaaattcaagtctgtgtccatgataaggttttattgcaacagtcacacccatttctttgtaagtattgtctatggatgcttttgagctgcagtggcaagagctaaatagttgctacagacacagtagggcctgcagaggccaatatttttctctggccctttaagaaaatttaccaacccttgctgtagatgctagagggctaatgaagaatttaatcatagactaacacaatcatctttatattgtagtagctaacattggtaggtctctagaatattgctggaagatgggcaagactagagtcaagggaaatgattagactgtagcaatgtttcttaaattgcatattagttaatgtgctacagaagagagttttgtttttgagtctttagtttgacaaatactgtgttaaacaagtgctagcaggtgtctttactgctggagtgagttcaaacctttattgtgggacagtttactgtgaatgcctaagaggagaatgtagagggcaccatttgctaatggttttgaagaatatgctactctgagttataagaatgaacatttatttaagtcatctgtcttattttctgtcaggggatgggtcaacctgcattacacattgttaaggcagatatcttctgatatctgttgtggaacagatgcactaagatgagtgggagtgtttatatcactgcagatctaatgtttgcaaaaatcttctgtatatttatctgatatgggaagtttggagcatgtaaatgataaataagaaaagaagattgattaacagtggaggtgctgaattgaagagaccatttgaaatcagtcgataagcgtatgggacttgaacagatgagcttaactgaaaggccagattttcttgcttatcccatctctatagcacagccttcggcaggctttcagactgttcctttggagccaaagactaaatagcttggaaaaatgtattgtctaattcttgttctggtacaaggttcttgttgtctgctgtatctttttctaaactcagaataccttttaaaatgcttttaaatcaaactcaggtgtaagtaattaagatatctctatttttaagcagatgaattcattaaagtacactaagtggaaaatctgccagtgtttgacagaaattaactgcaggtcaaattttgaatccaattttgttttataacaatgcctgttaataactgtatagttatatataacaataccaaatggtctacatttattaaactccttttattttggggatacaggtatatcaggtattctgaaaagaaataatataaattattaaatcagtataacaaaatgggtatttttcttttgatttctattaacattaatttttttctttgaacagatgatgaataaggtatttggaggtactgtgcacaaaaaaagtgtcagagaagatggagttttcaacattagtgtggataatacatgttcattattcaggtattacatttttagatgaataagaacaatagtaattaactaatttaaagttgatactattatttttaacaattggagattctataattcataaacaaaattaagggtatagtagtgaccacaagtgtaattgtcatatttgccttccagttgagtgtcaagacagtgtgggttggtggtgatgttaatagggaataaggaaggtatttaagaaatttgaaaacgcctgtgcagttgtggaaccctacttggaatcgtatattgtgataccaacatttgtattttcccttttcactctttgatctgtttttaaagattattatttttctttttcttttttttttttcgagacggagtctccctctgccacctgggctggagtgcagtggcaccatctcagctcactgcaacgtccgcctcctgggttcaagcgattcttctgcctcagcctcccgagtagctgggactacaggcatgaaccaccacgcccggctaatttttgtatttttagtagagacagggtgtcactatattggccagattagtctcaaactcctagacctcgtgatctgtccacctcggcctcccaaagtgctgggattacaggtgtgagccactgcaccctgccgaagattattatttttcaaaggaagattaataaaaaagccaaggttgctcaaaataattttttaaactgaagttactcattgtcaaaatgagtttgaaatccagtgcttgttcagcttcataatggagaggtgttgacacttacattcatccttatttcatgtgactcatcttgagaaacatttcaggaatcttgtatgtgatataccagaagaagctttaaacataaagatttggttaagatttgacatttttctgtctttctagttctaaaattctgggactctatcacaacctatactattcctaaacaacaatgtcaacaacaaaccccaaaatatctttttgacattaatgtactttatcttcttgctttatttttaatttacatttttattccttagtattatttattatttattttgtaatttaatttaattttttttttgagacggagtctcactctgtcgcacgcccaggctggagtgcagtggcaagatctcgactcactgcaacctccacctcccgggttcaagtgattctcccacctcagtctcccaagtaagtgggattacaggcaaaattttttgtgtttttagtagagacggagtttcaccatattggccaggctggtcttgaactcccgatctcaggtgatctgcctcggcctccgaaagtgctgggattacaggcatgagccaccgcgcctggccgttccttattattatttaatatcgagttcttagtcagattttccataacgtaaacagtatatttttatggttgatttgtttgaatcagggtccagagaaagtgtacacattacatttgattaatgttacttaagtctcttaagtaacacttacttaactaagtttcattaatttgtttggcactagaggtccacattggtactgggttgtaattgtttctaggactttcagataacagagttgggcagtacctagtcttttagaattgggaaacagaatcattagtgtatacttatttccagttaaaatgaaagattatagggtttttacctaactcttttgattttgtatctccctactcttaagctgaaaatgttgattactaattatttgttttaacctacagtatgcctgtatctatattgtacttacagttacaggataacagtttcagtactaagtcctattactacttacataagactaccgaatgaagtgttaaggtctttgaaatacctctgttcttaacataaatctcaacagatatataatgttgaaattattgttctgtaatctcttgaaattattcctgtgtgtctggttatactaccaacttcatatatttatttgttctagtttccttccaatttttatggattgccttttttaaggtctaaggttttttattggctttatttgtaatggacataatatttgaattctagcagtattccattgtcactttttttttttctgtttttctaatcatgtatggcaagcttgtgtttctaaaacaaaagaacccatgaatcatgtttttaattaagatatttgtgtgttttattttttgtatgtttaggggccttcagaaggaagaagttgttttgcttacacatggagatagtgtagacaaagtagctgatggattcaaggttgtggcacgttctggaaacatagtagcaggtgaaaattctaaaaattttgcagagttcatttaaaaaactttatctgaagagtaagcatatgcttctgtatgaggtactctttgatttttcctttttcttctgatttttcttctcttttttttaaagataataatgaatgtaggattaactgttatgaagggaatttaataataggaggattatccagaagtctctcacttactggtttactggtttgctttgaaatacgttgaaaaatgttcatcctaatataagcttttcaaacataaaacactatacttttgtaactcaggaaaaatttgagaactcgctgtcttcatactatactatattcagagttacttgtcttttattcctttcttaggtgtacatagcccatagcacccaaataagtactcaagacatttccctgaaccagggttggcaaactgtgacttgtgggtcaaatctagtcttttgcctttttttaatgtccaggagctaagaatgatttttacattattaaagggttataataaaatacagggactgtgtatgttgcacagagcccaaactatttactctctagtcctttgcagaaagtttgctgacccatgctcttaaaccattttgttctctaattttttgaggaaggggaattgactttctggctgtttggggttttgacttgcttacctgaataatgtaaatggtcactaatattcctggaagttagtaaaagaaaaaggtgggtttatcactaaagttctctttgagataccacacctaaataataagttgaaaaaaagatttgtcatggacatgctgaatttagtaatctgcctgctgttacttaacagacattagcataatgtatgctaatatgttagcataggaatgcccaagaatggttttatactaaaagttttttacttcataaaaaaagatcaacagtggtagataagcttgtgtatttttattcatccaacaaacattcgagtacctattatgtgtcatgcacagttctaggtgtcaaggatttagcaatgaataaaataggccaggtgcggtggctctcacctataattccagcaccttgggagactggaaagtggatagcttgaggccaggagttcaatccagcctgggcaccatagtgagaccccatctctacataaaaataattttaaaaaaattagccaggtgtggtgatgcacatttgcagtcctagctactcaggaggctgaggtgggagaatcatttggccctaagagatcatgactgcggtgagctgtggttgtgcccctacactccatcctgggcaacagagcaagaccctctctcctaagaagaaaacaaaacccaaaaccaatatagcaaaaatgcttgtttaacactggaaaaagggaaagtaaacaataaagaaatacagaatatgtcagaatcagatagtgtttacattgaaaaaatgggggaagagggtattctggaatatgtgtgattagggttgttgcaattttataggctattcagggaaggcattcctataagatgacattggacatgaagaaaataagtgctaacctttttggatatttggggaaagaggaaacagcagtacagagatcctgggtggggaccatatttgaggagcagcaggaatccatgtggttggagcagagtaagcatggtggggagagtgaaagaaggtgaaattagagaggtagttggatgccagaacacaggacctttgggccactgcaatactttggctttactcatagtgaggtggggttttaagtgaaggagagatgtgatctaatttaaggattaagctgtgatgaggagaaaagatacagggtgaaagagaagcaagaagacaagctaggaatttattgtagtaatcaggagagagacagcgttgtcaggatcaggatagtagtgatagatgcaggaggaagataaaggggagggtacctggagaatctcccaccagcctgcctactgggagaacagggtggggccacaggaagttctcaccctttgcaggagggaggagcctggcctttcctgttcctgtgtggtgacctcggattcaatctgtgagatgggggcctgttaacaggaagccttctcactttgctgagagtttttttccctttttctcaataaattccattcccccttacccttcaaagtgtctgcgtgcctaacttttcctggtcatgtgaaaagaacccggttttttctacagcagtagaagaggaagttgttaggaccagggtggcagagatagaagttgtcaggactagggtgatagaggtagacattgttaggagtgattggattccactgttttgaaggcagagacagaggatttgctgttagattgaatatggagtggggaagaaaaagtagaatcaagttttagctcccaagtttttttgcctgaggaaccaaaaggaagatgtttctatttacctgattggaaagacctcaggagtttgagtttgcatattaaattcaagatggtttattaaacatcaaaacaaaggtgctgagtaggcagttgtatatatgagcctggactttagaggagaaaactgggctggaggtataaatttgggggtttaccagcatacagacagaattttaaggtgatgagagtatgagatctcttagaatatttagaaaagagatttaagggctgaggactgagtaacttccatgtgtagaggtgggcaagatgaagaggaaccagcaaagagattcagaaggaatagacagtaaaataagtgaaccaagagagtggtatgctgagagccaaataaagtgtgaagtactgtggtatagtagaatgagtatgagtttgggagcctgtcaggcctgatttagttacttaattacctgagagttcatacaagtttcttgatatctcagagccataaaataggagtaacacatgcacatgtaaaatacctagcctaacatctattgccccataggtaatatttgccagaaacacatttgtcaagtagttgaatatatttttgtggttaatagtagtcaagaaagaaacagtatattctgacaagtctaatatatgagattcttttaatataagaacttggtagctgtacaatgcatttgaaagccatgtgcaactgagaaccaaaattgaattatcaatgcactagatagacaaggcaactgaagtaacttgggtggagaggtgagaatactgtgaaacaatctctatgtgggacttaatgtacgtcctatacctcattaattgctgtgtcaagaaagacctttataaagaaaggttatagcaatgtagtttttgtctttgttatgtatttcctattcctatagctaaaaatctactgagacataccagttttaacatttatagaggaagaaggctgggtgcagtggcgcacacctgtaatcccagcactttgggaggccgaggcaggaggattacttgagcccaggagttcaacaggcaacaagataaaaccccatctcttcaaaatatttaaaaattagctgagtgtggtggcatgcacctgttgttccagctactcaggaggctgaggtggaaggatcacttgagcccaggagatcgagactatagtgagctatgattacacctctgcactccagcctgggtgacagagcagtaaataccctgtctaaaaaataaaataaaataggccgggcgcagtggctcacgcctgtaatcccagcactttgggaggctgagatgggcggattacaaggtcaggagatcaagaccagcctggccaatatggtgaaaccctgtctctactaaaaatataaaagaaataagccgagcgtggtggcacacacctgttgttccagctactcgggaggctgaggcagaagaatagtttggacatggaaggcagaggtgacaagtgagccaagatcgcaccgctgcactccagcctgggcaacagagcgagactccgtctcaaaacaaaacaaaacaaaaaacaaacaaacaaataaaattggctgggagcagtggctcatgcctgtaatcctagcactttgggaggctgaggcaggtggatcacttgaggccaggagtttgaggccaccaggccaacatagtgaaaccctatctctactagaaatacaaaaaatcagctgggcgtggtggcacacgcctgtaatgccagctacttgggagcctgaggcatgagaattgcttgaacccaggaggcagaggttgcagtgagccgagatcatgccactgcactccagcctgagcgacagagcaagactctgtctcaaaaaaaaaaaaaaaaaaaaaatgaaaccatagaggcagagattgtgagaaattaattgtggttattgcttgagtcttttcagcatgaaaaaattttaatttgtgactattttctctataaaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggtaagcaaattattatctggaagtctacaaatttatatcaataatattggaatccaggagttagagtcctcaacacagcccttaaatgttctacagttttagagtgcttttccagttaccatacatatctttggtataaatagcacttttagataaagatttaagccaatagtgtttattttctttttgcttgttttgctcattttgatttttcattttaccccgtaggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaaggtattgaagaacctcagaaaagttaacttacatgttaggacttgtttaatcaaatctagtcttatggtttaaatgagcacaattacagttttctcagtatgctcaaggttgaaaatgttttttatttttacaattacctctggtgtaagagaggtctcagtataaatttttaaactattgattctgctaatttaatacatagattgataaattaacattttctagctactgttcagttctcttctagtcattcacttttaaaattatcttttcctggccaggcgcggtggctcacgcctataatcccagcacttagggagatcaaggtgggtggatcacctgaggtcaggagttttgagatcagcctggccaacatgatgaaaccccatctctactaaaaatacaaaaaattagccagtcttggtggtgggcgcctgtgatcccagctactcgagaggctgaggcaggagaatcacttgaacctgggaggtggaggctgcagtaagcagagatcatgccactgcactccagcctgggcaacaagagcgaaactccatctcaaaaaaaaaaaaaaaagaaattatcttttcccactctatttaatgatatttatgtacgaggctacccaagccctcctcaggtatgggtatacagattattttgcaaacagaaaagcttattgtgggagaggtaaagattctatactttttttttaaagggccactagtaaacttcttagtccttaataacatttacttttgtagataccttttatactttttaaaaacaaggtgcaattgatagttataatgaaatgaggtcagtagtttaatgataaaagttattgtacatattatggaattaattggaattgataccaaaaggctgaataaaatgaagacttgtaggtaagtatgatgtgaacatgagtctatttttttgaaacttctctaaaataacagtaaaagcataaaacagtgtaataccttaaggatgtgggatagaggagatgacagaagacagatggtttcaataaagtgttggaaagtggaaagcagatgggtaaaggtggattttctctgtttaagctaggggggtctctcccaacatcctgggaaggtccccaatggtatcttcacatggtgataggtttttgtgaaatttgcaagatattttgataatttgtagttgtttattttctttcaactctgacttgttttctgttaggtggtgctggaatagctgtgggcattttgaaatcaggctaagacaaagatgagctggggatgtgcttagtatgggtttagtggtatatatgtgatttgcaattatttctgtgtatagttaagtacttgttagccatcccagtataacttaagatttttagtatcttatttgttattctggttcttgaaggagtccttcaaattgtaaaacttggatctgtccctggtaactgacatagcagaatggaggaattcacaaccttggggtggggtgggaaggaagccaataaaaagcaagctgatttgtgctgtagacttctggggaggctcaggaatttgaagcattgggttctttttgggacattggtctctgggttagcctaaaacagggattagttaaaaatctgagaagcagatccttttccttagcacaggagcaaactgtgctctccttccccatcagaacactgtggatgtattctctagaggggctaaacgagaggttctgggcttgagcctactaataccaggcatagttgagggtggaggtaagactctacattaagaacaggattaagtaaaattctctatgctgaatggtgattccctcttcctaccacttcctctgtttaactgccagaatgccaataggcaggagagtagatatgtcttctctgggtagttgaccaggtacaggaaagacctacaaattcactggcttttccacaatgaaatagccagctgccttgtcatcttacggtgaaggcctccagtagctaagttttattagcaaatagagatcttagtttttagtttcttgtcattaaataaaaagccaaggattgttaaatgtatgttcataaatattagttttacaagacactagggtgtgattccaacagctttgactccgtttaggagccggtgcttttgacttctttggggctaagcttcttgctgtggcttctgcttgttgctctggtgaagcactgaagagagggaaaacaatcagcataaattttttttttttttttgagacagagtcttgttctgttgcccagggcagaatgcagtggcacaacctcggctcactgcaacctctgcctcccaggtttaagcaattctcttgcctcagcctctgagtagctgggattgcagacatgtgccactacgccccactaatttttgtgtttttagtagagatgtggttttgccattttggccaggctggtctcacactgctgacctcaagtgatccacccaacttggcctcccaaagtgctggtattacaggtgtgagccaccgtgccggccctaatcagcataatttgtgatgtcatggccctagatctaaatgccaggagattctcacagaaacaaaatttaatgagtgcctgtatctgaattctgttactcaggatttattgatagttctttttcttttcttattttttttttggggatggagtctctctctgtcacccaggctggagtgcagtggcacaatctctgctcactgcaagctccgcctcccgggttcacaccattctcctgcctcggcttcccaagtagctgggactacaggcacccgtcaccacacccagctaattttttgtatttttagtagtgatgggatttcaccatgttagccaggatggtcttgatctcctgacctcgtgatccacctgtctcggcctcccaaagtgctgggattataggcatgagccaccgggcccggccaataattcttgaatattgatagtttattgaaatttgtaggcagatttaggggagatcaaaggactgctcttcagactgggaaagaaatagcttttctttctgtattttgacttgttatttttgattaaaaaacatgttataccaatttaaaacgcttctcccctttcctccagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaaggtacctttgtttttaatatcctcaacatgtactatttttgatgtgaatcttagtatttgtttttccttgtcactatatcaaataaccaaattagctaattttaatcctttttcttatgtggctgagagttttattgtatattgtcattatattgaccagtagaaactgttttatgtttttttgttgttgtttggttttttttttgtttttttgagacagagtcttgctgtgtcaccaggctgggctggagtgcagttgcacgatctcggctcgctgcaacctctgccttctgggttcaagtgattctcctgcctcagcctcctaagtagctgggactacaggggtgcaccatcatgcccagctaatttttgtacttttagtagagacgggggtttcaccatgttggccaggttggtccggatctcctgacctcatgatccgcccgcctcagcctcccgaacttctgggattacaggtgtgagccactatgcccagccaactgttttatgttttaataaacatgtttgcctacattgccaggctattattttaagaatagatgtctttaagagtagatgtattcagcttatcatagactttaattcattgattatctcaatggctaatttcaagctcttgaatggaatgttcacatacctttgtttttgtttttttttttttttggaggcggagttttgttcttgtcactcaggctggagtacaatggagcgatcttggctcacggcaactttcacctgctgggttcaagcgattctcctgcctcagcctcccgagtagctgggattacaggcatgcaccaccatgcccagctaatttttttctttttttgagatggagtctcactctgccgcccaggctggagtgtagtggtgcaatcttggctcactgcaaactttgcctccagggttcaagcgattctcctgcctcaacttcctgagtagctgggattacaggcgtgtgccaccatgcccggctagtttttgtatttttagtagagacggggtttcaccatgttagtcaggctggtctcaaactcctgaccttgtgatctgcctgccttgcctcccaaagtgctgggattacaggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatgttgctgcatgtatcagaactttattcctatttattgccagataatattccatcttatgggtataatgcattgtatttatcctttgatcagctgatgggcttttgggttatttccactttttggctgttataagtaatgccgccatgaatactggtcataagtttttgtggatatgtgtttttatttcttttggtatatgcctgggagtagaattgctaggtcttaaggtttaacattttgatgaattgccaaactattatttaaaatgatgatacaattttacattcgcactagcaatctatgagattcaaatttttccacatcctcaccaagacttgttgttatctcttttcttattgtaaaaaacacataacataaagcttaccatcttaactctgatttttttttttttttgagacagagtctcactctattgcccaagctggagagcagtcatgcgacctcggctcactgcaacctctgcctcccggttcaagagattctgctgcctcagcctctcaagtagctgggattacaggcatgcgccacgaggcccggctaattttgtatttttagtagagatggggtttcactatgttggccaggctggtcttcaactcctgacctcaggtgatccgcctgcctctgcctcccaaagtgctgggattacaggtgtgagccactgcatccagcctcatcttaactatttttaagtatatagttcagtagtgttaggtgtattcacattgttgtaaaacagatcttcagaacttttcatcttgcaaaacaaactctatacccgttaaaaaacaactctcccttttttctggcccccaccctctggtaaccaccattctgctttctgtttctatgtttcactactttaaatacctcatataggtggaatcatacagtattgcctttttgtgacttgcttatttcacttagcataatgtccttaaggttcattcatgttgtagcatgtgacagaatttccttcttttttaagactgaaaaatgggccaggcacagtggctcatgcctagcgctttgggaggctgaggcgggtggatcacctggggtcgggagtttgagaccagcctggtcaacatgatgaaaccccgtctttactaagaatacaaaaattagccaggcgtgatggcgggcatctataatgccagctccttgggaggctgaggcaggagaatggcttgaaccctggaggcggaggttgcaatgagccaagactgccattgcactctagcctgggcaacaagagtgaaactctgtctcaaaaaaacaaacaaacaaacaaaacagactgagtaatgtactactatatgtatataacacattttgcctatccatttttgtttatcttttggatatatgcccagaattgggattgctggatcatatggtagttctctttttaatttttttgaggaacttattgtccatagcaattgcaccattttacaatctaaccaaaagtacataatgactccaatttttccaaatgcttacaatttgttattttctatttttttatggttgtgttatctgacttttaaaaattttagtcatctggctcagcacagtggctcatgcctataatcccagcactttgggaggctgaggcaggtggatcacttgaagccaggaatttgagaccagcctggccaacatggtgaaaccctgtatctactaaaaatacaaaaaaattagccaggtttggtggtgcatgcctgtagtcccagctactctggaggctgaggcaggagaattgcttgaacctgggaggcagaggttgcagtgagccaagattatgccactgcactcccgcctgagcgacagagcgagactctgtcttaaaaaaaagtaaataaaaatgttagtcatcctagtgtatatgaagtggtatatctcattttgatttgcatttccctaatagctaatgatgttgagcattttttcatgttcttgcttattggccatttgtgtatcttggagaaatgtctattcgtatcctttgctcctttttttaaaaaataattttaagttcgaggatataagtgtaggtttgttacataggtaaacttgtgtcataggggtttgttatacagattatttcatcacccaggtattaggcctagtacccattagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttaaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcctggcacaatgtaactaattcctgaacaaataatacttcatttgctgtcatatagaaaaaaattagaggtgatacttgtttaaagttaggactgcaagtcttaacctgtttttgttactagttcttgagaggttgggcaagtctgtacatcaggttctagctcactgtaatagtgattaggggatgatttgggagaatgacctaattgaattgaaaagcataataatagccaacatttcttaagtactttctatgtgctaggcactctgctaaatacattttattgtcttatttaatcttcacagtggaaactactattatcctgttttacagatgaagaaacttagggacagcgactaatttgccaaaagttatgcagattgaaaggagtggagccagaatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatggtctgtggaccggtgtggtggctcatgcctgtaaccctgagtctactaaaaatagaaaaattagccaggtgtggtggcatgtgcctgtaattctagctactcgggaggctgaggcaggagaatcgcttgaacccgggaggcagaggttgcagtgagacaagattacaccacagcactccaacctgggcaacagagcatgactccatcttaaaaaaaaaaaaaaagaaaaaaaaaaaagaaaagaatgatctgtgaatgtaatggagggaagccaagtgttctatgtccttggtcattatttcatctagactcacttgatgttttaaaaatctattttgtatgttgagttttctattatgtaagacttcattggcaaaaatggttttactgctttaaaaactatcttaagtatgctgtttattctaaaggtaaagaatggactagggaattaattggacatagctgaggttttgcctataactaggcatctcaagtgatgccttttctgttgtagtaaagcagcaggatccagttttccatagatctatgcacaccttgtgtttttatcaacttttaagtatttggtaaaatagaggttgggtacagtggctcatgcctgtaattccagcactttgggaggcctaggcaggcagatcacttgaggtcaggagttccagaccagcctggccaacgcggtgaaacccgatctctactaaaaatacaaaaaattagctgggcatggtggtgcatgcctgtactaggtacactggtggctgctaggggagggtaaggcaggagaatctcttgaacctgggaggtggaagttgcagtgagctgagatcgtgccactgccctccagcctgggtgacagaatgagagtctgtcaaaataaaatagaaataccagttcacattttttggtattaaaaactcacattatttattagattatgtgtatattttaacagtataataccattcctaaaattagattgatagttgaagctggatgataagtaaggtagttaattatactgtcctctttatgtatatgttggaaaattcccttattaaaaactttggatgagcacatatgttataaactaaaaatatttactggataattttgtgatacttaatacatggactgtaaaaataggataggccaagtgcagtcagtggctcatgcctgtaatttcagcatttccagaagccgagcttctggagttcaagaccagcctgaacagcatagtgaaacccctatctttactgaaaaaattagccaggcatggctgccggtgcttgtaatccaagctatttaggaggctgaggtgggaagactgcttgagctcaggaatttgaggctgcagtgagcaataattgcaccactgcactctagccttggtgacagagcaagactctatctcttaaaaaaagggagataggaatgatagggagagaattaaacatactgtcttatttgagcctcacaatggaaactatgatagtattaccctgttttatagatgaagaaacttagggacagagattaatatgccaaaaagttatgcagactaaaacgtatgcataatttaaatgttgcagcattctaaatgttacaacatttttagaatgttgaagcattctaaaaaatgctgagttgaatgggaaactaatagctacatttggatacttatgatgggcagatggattttaattttggaaaggttttatgttttgaaactagtggcatttttatattagatttttatattagaaatataacattaatgttaaatactattattactcctacctttaggtcctggcctggcaatcagagtaatatgtgctgaagaaccttatatttgtaaggactttcctgaaaccaacaatattttgaaaatagtagctgatttttctgcaagtgttaaaaaggtaatatttgatacagctaatcattacaagaaattgaacggattcttattatataccagcatttataatgaattttttagggttttattatttgaaaatttggtgtaatataacctttgaaatgactgtggagaaaatattccacagatattcttatatgcatatttttctttccagccaaacaagactggatatcctgagtctctaaaaatgtcagataaagtattttaaagcactcttttatgtgtatttcaagatagtaagggaaatcctttgagtcaggaatttattgggagcatcatttcaagaaaccaaagctgtctgctcctctgaggacagctactaatcctttgtggtctaggatttgggtttttacaatttcattcatgtacaggtgtctgagtatgagactgggtccaagaagggccagagattggatcagatatcttcacactatgcaaccctttagctccaaattgaagatgaatggaaaaattccccagtctactttattctacagatttggggttttaatttatgtaatgtgtgtggtctgaaaattgcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaaactgtcagaacaagaccctcaagactttactggaattaacaagcaatatgtaaagtaaatagaaataagctattcataataagaataatgtataagagactactaaaaataactgggcagatttgaaaataatctaagttctgggaatgaaaataataactgaaaaacagctgaaagagagaattaatgaactaaaagaaagttgtttagagattatccagaaattaggacaaatcatcataaagaaaatatgggtagaaaaggttaagatggaaggataaggcaagtgctaacatatgtccagaaggaaataatagaaaaaaatgtattaattcctccacactggtaaaagacatgatggctcagattcaggaaatgtaacacatctcaagcagaataaagggaaagaatttgacacctagtaagcacatcttagagaaattaaagactgccaaagacagagcagctgcggagaacagatcaattacctacccaggaaattatactgaaacagtaaaggcaagacttcaaaataccaagagaaaataattaactgtagtgaacagctaaactgtcttttaaaaacaagggcaaaataaagttatttcgagattaaatagaatttactaccaacagtcccttactgaagaaactaaaggcaatgattttcaaccctggctgtatgttagaatcatctggggaagcttttgaagtatactattcttgacatatagccctagaatttaattggtctgagatgggacctgggcattccaagtaatttgtgcagttaaggttgagaaccattgtttttttttttgtttgtttgttttttgagatggagttttgctcttgttgcccaggctggagtgcaatggcacgatcttggctcactgcaacctccgcctcccaggtttaagcgattctcctgcctcagcctcccgagtagctgggattacaggcatgtgccatcacgcttggctaattttgtatttttagttgagacggggtttctccatgttggtcaggctagtctcaaactcccgacctcaggtgatcacccgcctcggcctcccaaagtgctgggattacaggcgtgagccactgggcccggctgagaaccattgttttaaagaactgacttgaggagaagcagcaggatgccaggagaaagtcatgagatacaagaaggaatgctaagcaaggaaaatggtaaatgactaaaactgaaacaaacatggactgtataaaatgataaaaatgattataaaatcgagagtagaggtaaaaatgatatctacttgttcttgtttattagaaaatgtgtaacaatgtttagctgaagtaacatgtaagccacaaagggattgatttgagctaaggaattcaaagatgtctgtgttatttgccagaaggacagaagattgattatcttttaagtatccttgttaacacttaaggacaactactgcaagaatagaaatagaggatttaacttcaaaaccggtaaagaggaaataaatgagctgggagaaatcaccagttcaaaagacagcaagaaaggagtaagagtaaaaaatgggttaaatagataattacagaaaaagattgtagaatgaaattcaactatattgataacctataattaattaaaaggactataacattcctagttaagacatagacagtcaaactagattgaaaactaaaatctgcttagtatagaatagtagacatgaaaggtatagtctattcacaacaggcattactaatacctagggatagtaggagtgaaaattaaagaatggaaaaacatataccaggtaaataaaaaaaaagaaatggctaaagctatattaatttcagacaaaactgactttatggcaaaaagcattaagataatatttgactcagataaggtgcatcacttgctggtgacagggtactaaagcctgaatgtatgtaaatataatctgcatttcttatcctaagacttcttcatagtcctagccctcaggtgtgaatttctggcatagtgcatagcacacacaactcaaggagataccaaatacaatccactgctaaaaaccagtaaaatacataagatagtagtagataataaaagagtgaataccttatttcttaaaactgaaaaaatgcctctttggtttttctcagccacataccctattacagagagtcaaagcctgcacaacagaagaggatcaggagaagctgatgcaaattaccagtctgcattcactgaatgccttcttgctgccaattaaaactgtaggtgtgcaggtgagttgtgtgaattcattcaccagtgatatacttttttttttttttcttttcttgagacggagtctcactgtgttgcccaggctggagcgcagtggcgtgatctcagctcattgcaacctccgcctcctgggttcaagcactctttctactaatcttgaaataaggattacttaggaaaatgaaatatgtgagtatatataccaagtttagagaaataaggtaattttttatagaatgtttagggagtgaatagttaatggaactaaatagtcaggctgagattttgtagttttggaacatctatgaactctaaccaaaggtaaatattgaaagcaaccctttcctatagggttggcatgcttacttctgccttgtagggcagggatcaagaggtcatttatcctaggtgtgaaatatactgtggttttagaagtctttaactgcaggaaggcctccagatgagtaagttacaccatttaggtgttgttctcagcttgtgtattccctgtactagggaacacattctactgatgttgtgtttattctgcctttctagttgtaaaagaacatgagaataatatagttctcaattataaaatgctacttgcaaaatgactaataactaataagatagtatgttaatttctcctcttttttctggagacagggtcttgccctgtcgcccaggctggagtgcagtgatgtgatcatggcgtactgtagccctgaattcctgggttcaagcgaccctactacctcagcttcccaagtagctgggactacaggcaagcaccatcatgcctggctaatttttaaatttttttgtagagatagggtctccctgtgttgctcaggctggctttgaaattctggcctcaagtgatccttcactttggcctcccaaagtgttaggattggaagcatgagacactgtacccggccttctttatatgatcctcaaatgagtttttggggagcaaaagtgtgggagggtagggaagagaaaggttattttcttctatttcaagtttgtggttaaatggagacactagaagaggtgtcagtagttcaactcgaaaatggtataagtgccagttattgggttaatgtgtttataatgtcctcttacagtaaaattatgtgtagaatatacatatgtaactaacctgcacattgtgcacatgtaccctaaaacttaaagtataataataaaaaaataaaaaataaaaaaaaagaaattctgtttcagagattattcttctaaaacctaataagcattttttctaaatatatgaatctgtcagtttaaattcccctttgctctgaattcatgcagttctgcctgtaaataaaacaagataaaaattgattgttgccaggcgcagtggttcatgcctgtaatcccagcactttgggaggctgaggcaggcggatcacctgaggttggaagttcaagagcagcctgaccaacatgcagaaaccccatctctactaattagccgggtgtggtggtgcatgcctgtaatcccagctagtcgggaggctgaggcaggagaattgcttgaacccaggaggcggaggttgcggtgggccaagattgcgccattgcactccagcctgggcaacaagagtgaaactccttcttaaaaaaaaaaaaaaattgattgttatttttaaagtaaactaaaatattttatttcatgaaagtgatagagccagctattgggttaaggaactcttgccttctttttaaaggccaaatgttgtaagctgcttatgttgttttaaaatcactattgaaataaccttacttggagttactgatactttctttcagtggtttatggattatctcattcatacataaatttattttgaaatttgcaatgatacttacaggcagtattaccctaatatataaaaatagaattgtggacaggttatttaattcttaaaagtttctgagttttaagtagatttgttatagagaacttcaacgtctgtgtgctaactgctgctacaaagggagttgaaatagttccccactcttctttttagagaagtgttacaaaaaatagatacttgagataatctgatgaatgagtgatttctttcttgaaaatgaaacttattcaggctctactacttttcccaccaaaataaaattttcttttgttattggataactgactttagtctcttaccctttgaagcttagacccttgcaagcccagataaaaatgatggttcatagttagtataacaatgcattttattttctaaataccaaagtaaaccgtatttgtaaaaaatgaaaatacattaaaaaaaattctttgtatttctactctccagttaagttttgtatgtgtctttccagaaacactttaaaaagaaaataaaagaggggatttggggtacacattgtcaacttttttcttttaactgaacatcatgaacttacctttctgtgcctttccaagtagatggttcttaactgttccctcatattctatgcataccatcatttatttaactattcttctaaccaatgggcatttaaactgttctgttttttattattataggcatcccatcagttatccatgtatttatgtaggatcattttatgtgcatgtgcattttacactttttttttttttttttttttttttgagatggagtcttgctctgtcacccaggctggagcacagtggcttgatctcagctcatggcaacctccacctaccaggttcaaacgattctcctgttgcagcctcctgtgtagctggggttacaggcacacgccgccatacctggataattttttgtattttagtagagacggggtttcaccacgttgcccaggttggtctcgaactcctgagctcaggcaatccacccgcctcggcctcccaaaagtgctaggattacaggcatgagctaccacgcccagcccattttacacttttatagatgctatcacattagcattcacatatgttgaattttcacattcttagtacctgccactttgggcattaggtacttctctaatctgttactttttaaaattgcttttcataaaaaaagcaaattacttggattaaacaggacacaggaaaagagaataaattatcagttttatttacttattttaaaattaactttttttttttattatactttaagttttagggtacatgtgcacattgtgcaggttagttacatatgtatacatgtgccatgctggtgcaccgcacccactaactcgtcatttagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccttacaaaggacatgaactcatcattttttatggctgcatagtattccatggtgtatatgtgccacattttcttaatccagtctgtcattgttggacatttgggttggttccaagtctttgctattgtgaataatgccgcaataaacatatgtgtgcatgtgtctttatagcagcatgatttatagtcgtttgggtatatacccagtaatgggatggctgggtcaaatggtatttctagctctagatccctgaggaatcgccacactgatttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtattgatgggacatatctcaaaataataagagctatctatgacaaacccacagccaatatcatattgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaagttgtccctgtttgcagacaacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactaaagttcatatggaaccaaaaaagagcccgcatcgccaagtcaatcctaagccaaaagaacaaagctggaggcatcacactacctgacttcaaactatactacaacgctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatggaagaaaattttcgcaacctacttatctgacaaagggctaatatccagaatctacagtgaactcaaacaaatttacaagaacaaaacaaacaaccccataaaattaacttttaagctgatacttaaacacgttgataagtaaatgtttatgaattgtttttgtctcccacttaagaattctttatccactcaaaaaacacaggcagatcttgtctgccaaattataatttttcataattttattttatttttttgagatggggtcttactctgttgcccaggctagagtacagtggcatgatcactgctcacgatagcctcgacctcgttgggctcaggtgatcctcctatctcagcttcctgagtagcagggactacaggtgcatgccaccacactgcccagctaatttttgtatattttgtagagacagggtgttgccatgttgtccaggctggtctcaaacttctgggctcaactgacccacccacctcggcctcccaaagtgctaggattataggtgtgagcttctgtacctggccttgtctgccaaattaaatatgctggttatccacagttgtgcaggtaatgggaatgttgaatactttttttttttttgagacagagtttcactctgtcacccaggctggagtgcagtgatacgatctctcagctcactgcaacctccacctcccaggatcaagcagttctcctgcctcagcctcccgagtagctgggactacaggttcatgccaccatgcctggctaatttttgtatttttagtagagatggggtttcatcatgttggccaggctggtcttgaactcatgacctcaggtgatctgcccacctcggcctcccaaagtgctgggattacaggcatgaaccactgtgcccagcctaaattcttgatattaccatgatactttatgtatgtcttagctgattcaggtaggatttaatatgggattttaatttggaatttatttataccattaaagaagcatttagtatatactttcattcaaaatttccaaaaatccattaataatgtcaccatgcataagatatttttcaatgcatcttttcttttttttttaaaaaaaaaaaaaagctttgtcaagttaaactggtgtatcttttgactattaaaaattattgattatctttttattttcagggtgactgtcgttcctacagttacgtgtgtggaatctccagtaaagatgaacctgactgggaatcacttatttttctggctaggcttatacctcgcatgtgtcacaacgttaacaggtgtgtttcacaggagctagggtgggggcttgtgtaatggaaggatgtatttcttaagggctttcaattaatggaagaccaaaaggctcaaatgtagatataggtaggtcatgtagataagagtaaatggctgtgtttgtaattcaaatatgcacataggttgcagttaagtagatatttaatattatcttgtgttttgactcttcatcacaatgtagtcatctgttaaaaattatttaaaggagaaagatttttattttagtgtaaaatattaaaggcagctgtaaaacatcttctaaattagtggtttatattagctgttggttttatggtaacatgttttattccagaaggattgaaaaaagtatgtccaggttacagaattacaaataaagtaacacacacacacacacacacacacacacacacacacacccctacaaaacaaacaacccccactccaaacaaaaatggagacttggttaatttagtagtaaccccaaggaaaaaaatcaaagaaaagaaataggcatgtgccagatagcattaaaatagttacatttaaatatataatttacatttagattaatttccctttaatttgcatattaacttcttacattggatatatcaacagctgatttataatctatttctaatcctcaatttcatcgtaccatatatagttcaaaaattcacttattttgtactagattgctaattaaatgttcttacttcacagttattctctctgttcagttttcttcatgggtgttaggcagttaacaaccaaaaagaattacttgaggtttcattttactcaaattgctgcagaaatcagaagcttaccttttaatgttaagctagcagagtctgtatagttcgagataaggagttacagggaagccatgtttttaccgatgggaacatgctcattcaaaggcttactcaaatgaactgaaaaccgtcaaatacagaagcatctttaaaatgctgaaaaatagaattattactatcttcaataatgggggccaggcatggtggctcacgcctgtaatcccaccactttgagaggccaaggcgagtggatcacttgagcccaggagtttgagaccagcctgggcaacatggtgaaactccatctctacaaaaaatacaaaaattagccaggcatggtggtgtgtgcctgtagtcccagctactcgggaggctgaggcagaagaatggtgtgaacccgggagacagagcttgcagtgagctgagattgcaccactgcactcaagcctgggcgacagagcgagacttcatctcaaaaaaaggaaaaagaaaaaaaaaagaatcttggtgaactttagatttatttgctggggtctttttgatgaattggagtttaaaaatattcttccctgtttgccggtttttttcctaatttggataagggaatctttgtacagggagggactgttccagttttactgtcatatatagtgtgggtaaatacctgtcccagtacactctagtgattacttttgtttgtaagaaatgagaaggtgaaaagagcaggttcatggcattctcttaactttctcctgtaaagatcttttatgaactttaggaactgtattgtttagaaaaattataacttactgtctatacgtgggacaaaaaccttgcttctgttgtagtatgtttggaaggagacaataaagtagttggtgataccggtggttttgtgctaatatggttttctattgtgtattttacctaagtacatattaagaaaagaagaaaaaacattaaactttaccatgatagtttccggggagatttattttctttgctaaaaacaggactaacgaaaagtgaatagggagaactagctaagtggcactcatatctctaccctgattccctcttgttttctgggtgaagattgtgaaacagatcccttcaaaccagtggccagctacacttcaagttgttaaaattgtctgattctaatttcctcaagttatgttccaaactgtactctcattaactcaagatatttgtggtgtatcttcatgtctttcaaacagacatttatataaaacactaatgaatcatttttttggaaggaagtagtaggatactaagtcctatttcaatggcctttttaatgaagtgcaaatgagaatctctctagaatgattgtttctcaagtagagaaaaaaagatgagtttactaattttgggaaattcactgtagtttcctcttggagatttccagtgcatgttagcatagtatattaatagtttctgaagtcttgtcataaagacacctatttttaaattttaattgtgtatttgtttcctaggactacccataacaaatcaccacaaactaggaggcttaaaacaacagacatttattctctcacagtttaggaggccagaagtctgaattcagtgttggcagggtcatattctctctgaagactctaggggaggatccttccttgcttcttcctactatcgagtggtggcagcatagtccagtctgtctttgtgttcacatgaccctcattcccctgtgggtatctgtgtatccaaatttcccagcacttggaaggataccagtcattggattagagcccatcctaatccagtattacttcattttaacttgattacatttgcaaagaccctttttctccccagagattctgggtgggcatgaagttttggggatactcttcgacccagtacattaagtgaaaagagagttgtaataatcacttatatctttgcacattctgagatacagaatattccagagaacacactttgaggaaaacacgtagaacacagaccttcctataatcttatatcttgtcctatccatctggggagttgaagtgggcaggagaagggcctgaaactaagtgggaaatggaaagaatgttactgttctaagtgccttgcttctcatactaaaatgtaatttctacatttgaaatgtaattgctgtattatttttacctctttgtttccagagttgtttatatatttggcccaccagttaaagaacctcctacagatgttactcccactttcttgacaacaggggtgctcagtactttacgccaagctgattttgaggcccataacattctcagggagtctggtaagttgctcatgtttttgattactaccctctgaaactagtttttggaagcttgatattaagagtaggaggatgtggcttttgctttttagatgcttttgtttttattatttaaatctttgaatgttctatgatgttgcttttttttcttgagacggagtctgtcttgctctgtcgcccaggctggagtgcagtggcacaatcttggttcacttcagcctctgcctcctgttacaagtgattctcctgcctcagcctcccgagtagctgggattacaggcacccgccaccacacctggctagttttttgtatttttagtagagatagggttttgccattttggccagctgatctcgaactcctaacctcatgtgatcaggtcaggagtcaggtcaggccagccttggcctcccagagtgttgggattacaggcgtgagccactgcacctggcctataatgttgcttctaaataaaatatattcccctttgtggccatttgtggacatgcacagagcagcagaaaatttgaatttccagacttagatgttcccagctgagtttgaacaaggtgacgctatgccttcttgttttcagctctcataatgtgaacaagtctttttcatggtctccttgatgctatatcttttgcatttttatgtcttttgttggtgattttgctgtttaaaatggatctcaactatagtgttgaagtgctgtctgggttcctaagcacaggaatgctgtgatgtaccttacagagaaaatctgtgtgttagataaacttcattcaggcatgagttaaagagctactgattgtcagttcagtgttaatgaatctataataaatattaaatacagtgtcttaaatcagaaacacataaaacaaggttatatattaatcagttgatgaaaatattacaaccagaggcttgcaggaacctaaccctccatttcccctgggagaaatggttcagtattcgctaattcgttgtttgcagtgtagaatataactatactgcaaattataatagagaataatgagactggactgtttctgtttacagcacatcagtgaaacatcactgatgtgatcaaattctgttttttgcatttgtgattaagtccatttaaaatgctctgcgagtagctgaaatcaatgcatgatgacagtcttaactacgctgtgtgtgtatatgtgatttcagatattgcctgggaggatttaattgaactgagttagagtgcttttctatggtgtggtgattggttctacatatacctttctctagggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtaatttatatatttttttctaatgcacgttctcagtacctcttacattttataatatggtgaatggaataggctatgccagtgctgtatttcttatgttggttttctgttcataagataggcttttttttttaaattttcacatatttgattaatacactggggcagaaaaaggctttaaattatatatgctctccaattgtgtgattactgtataaaaagtaattgattataattttatctaatcctgccaatttctactttacaaacagtattccccaaataaaaaagaaaactctaggagtgaagaagagtttgttagaaataaggatgcaatttgatagctttatggccagacacccaagaattgcctaaatgttctccctactaccaattccaactcaatttttgatccttctttgtcttcaccagaacattccaaaggagctacttgcataatagcaagtgaaaatcaaagtgagactctattagttgggccactgcctccagtgcactaacacgaagctgtcgtgatagctaggtagatgggttggttcggaacgtggcttagagtcatttttctcttaggctcaaatttgtcaaatttgacaagtgagcaggctatcctctcctgtatacttgataatgattattacagtgtactctgtgccaccttggtggcccttagagttgtatgtttaagctgcagataatttgcagagcattggctgaaacacataaaatcacatgcttggatgccacagcaatgtcaaatcgctatatgttcttaagcacttgtggctcagtcacaaacacaacttgcagactagcacctgtttgtggatcacactttgagtagtactgagtttaagtcactaatattttaaaccttaataacttacacctatccctgcagaggggaataggttcattatataagattaatcagaaaccatcccatatacatggaggacaatagtgaaaatagtcaaattttaatttcaaattacaaatgtaagccctctaggactgctggacatgcagtggatgctgacttttctctataattttttttaataggtggtattaaagatggtcactgagattaagaagattcctggtatttctcgaattatgtatgacttaacatcaaagcccccaggaactactgagtgggagtaataaacttcttgttctattaaagtaccgtgtgcagtttaaa

SEQ ID NO: 38005 - DNA, 59258 bp, Homo sapiens; identical to SEQ ID NO: 36289

SEQ ID NO: 38006 - DNA, 105407 bp, Homo sapiens
gacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgagggtaagcgggagtggagagcggaggccgcgggggaggggatgggagaggaggtggggaaaccgcaacgtcgccggccgccgcctgctcgtgcctctggggccggttggcggagccctgagccccggcccgcggacgaacgggcgccgagggcgcgggggaggggagcgggccggcggagggcacgcgggcggcgcgggggcggcgggcctgggccgcggcgagccggctcctgagtgctgccagtggtccgcacacctggcgcggggggtcggggcgccctccaggaggggcacatggggacccgacatcccggttcgcagtgagggccgatgtgggaagcaacgtttgatcttgcaccttcaccggggtgtacgtgtctgtggctattcacaagtctgcatgctactcacttggtggaggactgttttctgaaagctgaagttgcgtttaggaatctctcctcttcttatggctgatgctaccgtttagtcaggtctgtcacgagaaaaggccccttctcccacccttgcctcctaacatcttcgaggaacctaatgtttggggatccctgccttcaataatcggccttaaacctcgatattttcttagtgttttagtaagaaatctgcaaagtctatgttgtgaggtttgtgcaccccttttactcttgaggaaaaatatttttttcttctcagtcttaaaacaagatcataactttattgttgatacccttgtatagcagaggtctggaatagggctgtgatgggggtagaacagaagagactttttccccccagactgataacctttaaagtcctaactaagtgtgacgaatgagatggatttgtgtgtatcgctgaattactggcgacataaatgagatgtttacggacagaaaccctgattttttttttttttaaatgtatcaaggtagagatgagtgtaaacttgaaattacatttactgcaactcgtttgtgtaacacttatgatattaggatttctttttcaaataaggaagaggaatccggtaaaaggttcagttttgtatatttattgttttccgcaagagatgggatgggggaaggatgttggctggttacctgcttagtggacgtgagcaaaagaacgtatcctctgctctaaacggagattgttggagtttgcacagtgcctgccatattccctcctgctgtttcaaaaataattattaagttcccagtaaacacatattaatacatgttatgccccatactagtttatgcagagaaccataagtgtaggtaaagggtgttcatacttgataagtttaagggttttagtggctcagagccccagctgtagagcttttaacacctgtggagcttttcaaacaacgaaccctgaacctcacctctgtaaattcatgcgttagatttaggatgggttgagaagactgaactctgaagttatatttatttttacctgccatttttaatttttgtgtagtaacagatgtatacaagttttctaagttcttttttttttttttgttaatgaaaactttccaggatttttattagactcttgtgaatgttgttggccaaagcttaatgtaaagcgaagaatttactcgctcttatagagcagagtaaaagcagtcagtgctcagattggagtgcaaccagcaactggaaagtgatagaaaccaaagaagcttttttttctcttcctttctgccttcctctctgttttggtttgtggatcagcttcatcctcttttcctgtaaatcagctgtctttacttcttgcatttttagaagatggcccctctcccacaattcatatgacgtgcccaacagagactaactggggagaattttcagaggagtgaggggtgcaggctgggcacatgcagtaagcatcatctgcttttctttgccttaactgctctgtgcagacccatgttaccctacacttgaagatgaactgtaccccgcccttacatcccattacagacagtaatgatgatgatggtatatacccattttaatatagtggttattccatgcctggttctggtctaagcattttttctatacttatttaattctcacaattttttcaagaaattgaagcacagagaggttaacctgacctaaatcacacagcttgagatttgaaaagctaagatttttaatcttagacatgtagcttttagagtctgggcttttcagagcccgggctacactactttgttctggtaccttggggtctaggtggagcttctagccatcatcctgcgattgctcctaaattaaatgattggtaacatccttcttgtgtgacattataataaaggaagaaaaacagactaaaaaacggaatagaaagaaagaaaaggggaagaaataatcttggattctcaaaatgatggtccttggatcagaatatattgtggtggtcagagtgatgctcaagtaaattataggaccaggaaaaattttgggcattagtttgttggctaacttcttggcagtagagaaattggtcagccgatctggatgccacatatttggctgctgatatgccacagagaggatttccattacccttcaaggctactcattttggacaagtataaccagagcagttcatatcctggctagtgctgcatctatactggagatagggaattttgggaaaggtaatcctcagtgtggtttggtgaccctggtgcctttgcttttcagacttgtgtgtcgggggtggagttgggggggggagggttggttattcgattaggcaactgttaagggggtcgcctgactatttcagttttggagactgctgcgtgagccagtaccagagatcttggctggtcatagcagaatatggcagctctataccttgttgcctttcagtccgggtgaccagaataccagcccacctctcttccagttcttctgggagagagaatctgattggctgagtttaggtctctacttctgttctaatcatccatagccgggggcttagagtcaaagcacacaaacctgatcagcagattatcctgatggattgaaggaaaggaagtggggaagttctctgaaaagggaaaatgtggcctgtgtgctcaaagatggttacaataatgtgttatatattagaagctttcaaggtgccagagaagaaattactcaatttaccagttgcttatttatggcatctgtgttgttaggagctgaaggagtgattagtttgtgaatgaacagattttgaattaactagttgtgaattaatgtgggacaagatcataagatttgatggcctgaacttctgtcactgctgccttgcttcctcctccaaaaatggtctggagggcagggcttggtagctcacacctgtaattccagcgctttgagaggcaagaggatcgcttgaagccaggatttctgggttacagctagctctgatcttgacactgcactccagcctgagcgacagagggagaccctgtctcaaactagtctgtagaagagctaagcacagggatggaggagagcaggagttgagtttctggaatcacttacctcttctttaaccagagcagctttttctttacccttccagttgcatatttccaatattgtggtctgctggtggcagtcattcacaaaaaggtccctgctacactttaacctggttaatctactttccctacttctcatcactcaatggggaggagggggatctattgtagtgactttttttttttttttaaggatctcccttctgtattcttcatccccttcttttcatgcattgagaatttattctgtgtgtgtctcagaatgagagagaatgtgcctgtgagaatctggttgtgcatttggcctgagagagccagcgatgataactttatcaatagatactgggtaaaccagaacatttaccaaactgggtaaatttgttgtgtcataattcgaagatcagatttgggtctttcatgctaagaagcctaagtaattctgtaacagaaggtcttctgtctagaaggcttaagtgtttggtttccttacacctaccaggagtcaccatcctgataacttcaagtgctgttaggatgcagcaggagaatgggaagttaatgggggatttgaggttagaggtcctcatcacgctcctctccccatttattgggcagggatacagactaatagctatgatagatataacagaatcttccatatgattcaaagctattatgggatgcaactaaaatttccaaggcttcacctgagctcatgtctatgaaagcacgttcgaaacaaaatatatttaacttaaagtgaaataggctgggcgcagtggctcaaggctgtaatctcagcattttgggagcctggggcgggtggatcacctgatgtcacattttttattctctcatttccatttctcatattttttaaatgaaagcaatatttgtgcagacagtactgaaaaaattcaaaatagtgaaagtcttcccttttccattaaatcccactcccattatgcttttaaccatttttgtttgtttgtttttagggttttattgttgttccaaaagtctaaaaatataccatgcctttctctctatattttttcaactcaaaaaaaatatttcttaactttttgctagataagaaatttaggtcattttccacctgtcctagactttgatttctatcagttacattttggttcctaattttgctgttatttttaactttttattataaatttctgtttattgacctatcacttttagacagtatatttggcccttcatgtctgtgaatgacttatctttggtttcaaccaaccttggatcaaaaatattcaggaaaaaaggttggttacatctgtactgaacatgtacagacttttttccttgtcagtatttcctaaacagtatagtataacaaccatttcatagcatttgccatatattaggtattgtaaactagaaatgatgtaaagtacgtaggaggatgtgtatagcttatatgcaaatactatgccatttcatgtaagagacttgagcattcttggattttggtatctgcaggggaccctggtaccagccccctacggatactgagagacaactatatttcctcacttcctggtctttcagaaaaagatataacaccgatccctttccttttgggatttaaaagccaaaccttgcctttgtttttccctcctcccttcctagcctttgttttcttttttccttttttttttgagacaggattttgctcttgttgcccaggctggagagcaatggcgccatcttggctcactgcaacctccgcctcctgggttcaagcgattctcctgcctcagcctcgcgattagctgggattacaggcacctgcaaccatgcctggctaatttttgtatttgtaatagagacagggtttcaccatgttggtcaggctggtcttgaactcctgacctccggtgatccactccccctcccttggcctcccaaagtggtgggattacaggcatgagccgctgagcccggccccagcctttgtttttggttagtactgttacattggcaagatttattgcatttatataatgttttataactcttctaaagttttctgtgcttctgcaggaaaatctagaaattgagtactaatagccactcttttaaatatgtatgttgacatgagtattagttactatagaaccaagtactgtggagccatagagaaacttcacttctgttaaacctgtgatccttaaaaaggaaatataacaaagtcagccgggcacagtggctcacgtctgtaagcccagcactttgagaggcccaggcaggcggatcgcctcaggtcaggagttagagaccagcctggctaacatggtgaaaccccgtctctactaaaaatgcaaaaattagcccgacgtggtggtgggcacctgtaatcccagctactcgggaggctgaggcaggagaattgcttgaacccgggaggtggaggttgcagtgagccaagatcatgtcattgcactccaggctgggtgacaaagcaaggcttcgtctcaggaaaaaaaaaaaaaaaagaaatataacaaagtcctggttgaatgaggaaagctcattgaagttatttttaaaatttaatattataatgggttctcatgttgtagccattcagcttgtcttggtagactttccggagtcttggcctgccttttctaatttgggaagcttagtagacctgttacccagctgtcatcctgggattacttcacattgttctcctgggttagatctattgttatttggatcccatgtttttctcttttagataccttttttattttacaggaatacagccttcaatagttgtttctggaaggatatgctggtgataaactttctgagttctcgaatgttgaaaatggcttgtctttgttcctgattgaaagtttacatgtggaattataaattcctcagaattttgaaaactttgctgtgggaatctaaaatacttggtgtgctaatcagaggtccattgcagatctgatggttattctcctgtagaagattgtaatctacaattgtagtctacgatctacgggatttgtttacattctgaaaggtttctttgattttgtctttgaacttttctataaaatttatttcagtagttatctttaatttataagagttcttctatcatctttcatttttctttctttttaaatagcaacctgtccttgatttatggggaaataccttgaatttctctgatgctaatttctctagagttcttgagacacttccctgaattggtgactctaacagtgggtttgtatttaggtattccatactaatttttgtattttaaatatttaagttatttgataagtacaaaagattataacaggtaaggcgtatgtaaacaaacatacatataattaccaaccagtttactaattcattagtgtaactttagcaggatgcactttcctgatcacatccactgcaaccatgtccaccttcaccaatgacagtagccattgtactgaattttggattcatcattcctggtctgtctttatacttttaacatatatacatatgtaaaatttatttatttatttatttattttttgagacggagttttgctcttcttgcccaggctggagtgcagtggcgcgatcttgactcaccgcaacctcctcctcccaggttcaagcaattttactgcctcagcctcccgagtagccgggattacaggtgtgcaccatgcccggctaatttttttgtattattagttttcaccatgttggccaggctggtcttgaactcctgacttcaggtgatccacccgccttggcctcccaaagtgctgggatcacaggtgtgagctactgtgtctggccatccatatttcttaaatccaaatgtttgaaaatgaagagaaaaaaactgtaaagtttcaccaaacttgtcttgcagaaaaaccctgacctgcactgatattgtaatctttgttgatctcacttagtgtgaatatttgtatgtttcactgtagagattctaggaatagaattgctggtatttaagaagaatgtgtgcatattcaccaatattggataatgtcagattatcttccaaaaaaggtggtgtcagtcttcgttctctccagcaatgcagaagttttcattactcagctttcttgctaacatctacttttgtcacacttcaaaaggttttatcggttgggcatggtagctcacgcctgtaatcctagcactttgggaggccatggtgggtggatggcttgagaccaggagtttgagaccagcctgggtaaaatggtgaaaccccatctctaccaaaacaaaacaaaattagctgggcatagtggcccacacctgtagtcccagctacttggcaggctgagatgggaggatcacctgaagctaggaagtgagctgtgatcatgccattgcacgccagcttgggcaacagagtgagaccctgtttcaaaaaaaaaagtttttacccacgagtataaaataccaccttttagttttcatttgctttgctaatgagtttgagcatcttttactatactgattagccattcttcccttttctcacattcctattcatgtcttttgcccatgtttgtactagttttttaaaaaaattatttcatactgatttttaatagtttcacagttggatgcatgtggtgcaaatttctcctttcaattgggctcacttttaaatcatttttatttttattttttgagatggagtctcactctgtagccctggctggagtgcagtggcgtgatctcagtttactgcaccctccacccccaaggttcaagagattctcctgtctcagacttctgagtagctgggattacaggtacccgccaccatgcctggctaatatttgtatttttaatagagacggggtttcaccatgttggtcaagctggtctcgaactcctgacctcaggtgatctgcccaccttggtctcccaaagtgctgggattataggcatgagcaactgcatccagccttatgcgttttttgatgagtagaagttcttaatttttatgtgattgcatttatcaggcttttctttatggatagtgcttttgaatcttgttgaagaaatttttcaacagagttctcgaagatattttccattattgtaaaagtataagacgtagtttttttgttttttgtttttgttttttttttaccttttctcatttaaggttttaatccacctggagttgattttgtatacagtgtgaagtggtgaccaagatgcatggtttttcctcaaagaataataaattgttccatcacctttcatgcaaatttttttcttcactggtttggatgccatcactcatctgtgctttggttctggactctgggccgttagtctgtttttacagaaattgttaaaaagttacagtaactaaaacaagatgatgctgctgctagcataaacaaacttcttgcctggtgaggtggctcaaggctgtaatcccatcactttgggaggccatggtgggagcatcacttgagccaggagttcaagaccagcctgggcaacatggtgagaccccatctctgtgtaagataatattttttataataaaaaaccaaacttcttttgatatatagcatacacataggaagtacacagataatgaaattatagctggatgaattttctcaaaataataatcgtgcaggtcaagaaagagaacattaccagcactctaaatattcccctccccagtggctaacctcacctcattcttccaaaagcgacctactatcctaactttaacagattagtattgcctgtttttgaactttatataaatggaacctgtgtagtatatatacagttgccccttggtgtacctgggggattggttctaggatccaccctcccaacaggaaaatcatgtgtactcaagtcctgaagttggccctgcagaacccatgtataggaaaagttggccctctgtatatgtgggtttcacgtcctgcaaataccatatttttgatctgcatttggttgaaaaaaaaatatgcgtataagtggacctgcacagttcaaaccagttgacaagatacagttgacctttgactaacacaggtttttgttattggatatgttattgttattcaatattcaactatatgttattgttattcaaaggtcaactgtattctgtttctgtatatgtattctgttgtttctgcctttttttctgtttcgtttgccagattcatccttattgttgtctgtagttgtagttggttcattcccttttgctagtgatatagtagagttccagttgctccatatccttgtctacccttttaattttagacactctggtgaatgtgtagtggttttaatttgcatctccctaataagtaatgatgtcaagctcctttgaatgtgcttattggccatttgggtttcttttgtaaagtggcttgccaagtcttttactcatttttatattgggacatctgtcttttccatactgattcgtaggagttcattatacatcttggaaaccatctcttgctggttatgttttgcacataccttctcttgtttcccctgagtctattcagagttctgctggacttttaacctctccattgcccttttccattggcagatatctccggggaaggcatcaagagactcagctttgcaggctctccttcttttcagagtcttggtgtctcaggtccttactgcctttgtagtgcctcctgcattcacacagatttttgttttttaatattatattcagttgttaagttctcacagggagggttggtatgaaacagtctagtcagtcattgagggagacagaagtagcacaagtcctcctggcttgtaattgttcaaggaacttcttgattgtttgcttctccatgtaattttagaatcatattttcatgttatacacctccccccccccccacacacacacatacatcttgttggtattttgatgggaaatgcactgaatctgtaaattagcttggagagaattacattttgctgctaagttttcttaaccacaatcattgtaatctccatttcttttaggttttttacaacatctttcaataaagttttgttattttcagttaaagtattgcaaatattttgttagatttatttctaacaaattatttttatagcaaatcataaatattaactttttataattatactttgctggtgcacagaagtacagtttgactttgtataataaccttgctatactcctaattgtgattaattatctttagatttcttttggatttttctatgcagacagtcctatctgtgaataatgacctctttgtttcctcctttccaattcttatgctttttttttttctttctttttcttgtcttaatgtgctggctaggatctccagtacaatgttgaatagaagctgtgatgggggcatcctgatcttgttcctgattttaaagggaatgctttcaaagtttcacagttaagtatgatgcttgctgtaggtttattatagataatcttttcaggttaaggatgttccctttcttagtttgctaatttaaaaaatcatgaatgaattttatcagaagctttttctgcatcttttgagaaaattatttctcttttgtaatctgttaacatgctgagttatattaatttttttcccaatatttaaacaaactttgtgttgcaagtataaattcaaccctgatctatctgttcctttttttcactggactcagtttggagatatttaatttaggatttttgtctctcataatgagtaaaactagcctatagttaaaaaatataccttttctcttctggaagagtttatgtaacattagaaaggtctgtttcttaaatatttagtagaacttgcttataaaattattactattgttttctttgaggaatgcttcaattgctttggttgtaggactgttcatattttcaagtttcaaacctgttttagtagttcatacttttatagaaagttgttcatttcatccacattcttgaatttgtagcatttagttgttaatctcttctttgcagttacttgtagttaatatccccttgtctttttttaaaatgccttctttttttcttgataatttttggctaaaagtttgccaatttttaaagatttttcagagaatcaagtttttgatattgtttatgctctttagtgtatccttcctgtttcattaatttttgctcttcttttcttttcttacatttcctttgtagttctgttctttttttctaatttcttaagctgggtgcctgtcattaattttcagcattttaacatagttatttaagatcataaaatgtctgcgtattgcctccttgttttgatgtgtgtgatatttccgttatttttacttgtatttttctattttccgttgtgaattctttaacttatgagctatttaaaaatttaatttccaaacagagttcctctagttgatttggctgttgatttgtaattgcattttggttaggcagcctgtttgagtgtgatgccaattggtgtgtataatgccaactctttgaaatatgtttagactattaaaaatgtggtccattttaataatttttatttgtacatgaagagactatgtattgcctggtttttggtgcagttttatatatgttcattatgtagccttgttaattatgttgttcaaatctcatatctttattttttattaagagagcagagttaatcttttactagaattttgtttcgtttttcatttttctttgtagttctatcgatttttaaaccatattttaacattattactagcacatgaaagaactgtaatcctgtaatcttagcaccttgggaggctgaggtgggaggatcacttgagcccaagagtttgagaccagcctgggtaccatagtgagacccccatctctgttttttttttttttttgagacggatggagtcttgctgtgtcacccaggctggagggcagtggcgcgatctcggctcactgcaacctccacctcgtgggttcaagtgattctcctgtttcagcctcctgagtagctgggactacaggtgcctgccaccatgcctggctaatttttgtatttttagtagagatggtgtttcaccatgttggccaggctggtcttgaactcctgatctcaggtgatctgcccacctgggcctctcaaagtgctgggattacaggcctgagccaccgcacccggccttctaggttatttttctttttttgtcagttttgcctaatttaaaaaatttctcctcaccgttacatttttgtgtccttttatttcagttttatctctttcaaatataataccattgaattttaagaaaattaaaaatctagtctgatagtcttactccttgtagttttaattaaacttttaatgaagataattgtcagttcacttgcatttctaggaaataatacagagacattctgtatactctctctagttttttttcagagttaacatcttaaagaccatagtacagtatcacaaccaggatattgacatgaacacaatcaagatatagaccattttatcaccacaaggatccctctctccaaagtattgttattttatagtcacacttgttcctgtctcatccagttccctcactctctggggcccgctcatctttttcatttctatgatttttgtcttttcaaaaatattacataaatagaatcacacagtggataaccttttgggtctggctttttcattcagcataattctggaaattcatccaagttgttgtatataaacagctcatccctttttattgctgaatagttttccacgatatgaattcactatagtttgtttaaccattcacctgttgagggacatctgggttgtttacagttttttgataattatgaataaaaatgctataaagatttgtgcataggtttttttggtaaacttacgcacacatctttctcggagataaatgcccaggagtgtagttgctgggttgtgtggtcattgtatgtatagtttttaaagaacttgctaaactgttttccagagtggctgtaccattttacatccctaccagcaatgtatggagtgatccagtttctcagcatcctcgccagcatttggtgttatcagtgtttttcattttagccattctggtaggtatctagtgatatctcagtgaggtttttatttgcatttccccaatggctaatgatgctgaacatatttttatgtgcttatttgccatctgtatatcccaatccatgacatgtctctttgtgtcttttgtcctttttctaattgaattctttttcttttcctgttgagttttgagagttctaagtatatcctagatagtagtcctttgtcagatatgtgtttgcaaatgttaatattttctttgagtctgttgattgtctttttttccttttaaaggggtcttttgcgtagcacaggttttagtttgtgtgaagtccagtgtgtcatatttccttttatggatcttgcttttagtgtcaaatctaagaactctgcctagtcttagatcccaaatattttcctgcttattaaaaaaaagttttacagttttatttttacatttgactctgtgatccatttggagttatttttgtataaggtatgagacttaagtggaagttcatttttctgtctatgggtgtccagttgatccagcaccatatattgaaaggctgtctttcttccactgagttaattttacacctttatcaaaaattatttgggtatgtatgtatatgtctgtttctgggttctgtattctctttgcttgatctatgtgtctacccttccactaataccatgcagtctgtcagtcctagctaagttgtaaaatgggatagattgattcctctccctctgttctttttaaaaattgttttggctgttctattaatatttcttttgccttttcatatacattttagaataatctcatctatatctacaaaaatcttgttggaatttggataggaattatgttaaacctatatatcggtttggggaaagttgacatctttactatgttgagttttccaatccgtgaagaatttatttgtttaggttttcttttctcttttttttttgagacagagttttacttttgttgcccaggctggagtgcaatggcacgatctcggctcgctgcaacctgtgcctcccgggttcaagcaattctcctacctcaacctcccgagtagctgggattacaggcatgtgccaccatgcatggctaattttttttgcatctttagtagagacggggtttctccattttggtgagactggtttcgaactcccggcctcaggtgatctgcccacctcagcctcccaaagtgctgagattacaggcgtgagccatcgtgcccggcctttagattttcttagattttttttttttttttcagtgttttgtagctttcagcatataagtcctgtacgtgtttgttacatttttacatatgtattttaattttctttggagtgttataaatggtgatgtttttaacttgttttcacatgttcatttttagtgtataaagatgtggttggtttttgtgtgttgattttatatcctgggaccttgctgaactcacaagttctaggagttgttttgtagatttgttgagattttctatgtgaacaatcattccatctacaaatatagttttattttttcctttcaactcttactgcttttatttccatttcttgtcttattctgctagctagaacttttagtactgtgttgaatgaggggtgatagtaggcatctttgcctcagtcccaatattagagggaaagcaatctttccgccctgagtataatattggcttaattttatttttttggtagacctgtttatcaaattgaggaagctctcctctattcttgtttttgagggtttttaaatcatgaacaggtgttgaatttgtgaaatgcgtttttcgcattgattgatttgatcatatgatttggttttttgtaactgttaatatgatgtattctatagatctcaaaacaaatacagagataagacacagtgaaaatgctgagcagcagtggcatataatgaaccagtcttgcatactggaataaactccacttggtcatggtgcataatgaccatggtgtttaattctttttatatattgctgaattttattgactaatattttgttaagggttttaacgtctatattcatgacgaatattggtttgtagtttaatttttttttggagacagttttgctcttgttgcccaggctggagtgcaatggcatgatcctggctcaccacaacgtccgcctcccaggttcaagcgattctcctgcctcagcctcctgagtagctgggagtacaggcatgtgccatggctaattttgtatttttcttagagatggggttctccatgttggtcaggctggcctcgaactcctgaccgcaggtgatccgcccgccttggcctcccaaagtgctgagattacaggtgtgagccaccgcacccagcctgtagtttaattttttgtgttgtctttgttttgttttggtatcatggtaatattagtttcataaaatgaatttggaaatattctctcatcttctgttttctggaagaaattatattgaattgttgttagttcttccttatttttattttttaatattatttgagacagagtttcgttcttatcacccaggctggagtacaatggcacgacgtcggctcaccgcaacctccgcctctagggttcaggtgattcttctgcctcagcctcctgagcagctgggattataggcgcctgccaccgggcccagctaatttttgtatttttaggagagatggggtttcaccatcttggccaggctggtcttgaacgcctgacctcgtgattcacccgcctcggtctcccaaaatgctgagattacaggtgtgagccactgtgcccagcctctattttgtatttttttcagatgaggtcttactctgtcacccaggctgggaatattggcatgattatagctcactgcagcctcaaactcctgggcccagggtatcctcctgcctcagcctcctaagtaatcaagactacagttgagcaccaccaagccgtggtaattaaaaacaattttttttttttggtagaacctgggtctcactttgtttcccaggctggtcttgaactcctggcccaagtgatcttcctgcctcagcctcccaaatagctgggattaaaaggttggagccactgttccttgcctatattatctttttttttttttaaagatggagtctcactctgtcacctaggctggagtgcagtggcgtgatctctgcttactgcaacctctgcctcctgggtttaagcgattctcctgtctcagcctcccgagtagctgggataacaggctcccacaccacacccagctaattttttattttctgtagagactgtgttttaccatgttggccaggctggtcatgaactcctaacctcaagtgatttgcccgcctcggcctcccaaagtgctgggatttcaggcgtgagccaccatgcccagccaatttttgtatttttagtagagacgatgttggaccatgttgaccagactgatctcaaacttctggcttcaagtgatctgcccacttggcctcccaaaatgcacccttgcaccctactaccaatttatatgccttcattgctcagcattttcattctgtcttatttttatatttttcctgatgctgtcaggatgagatctgtgttttcttaacctcacaaatttgatagttacttcatatagtaaaggtttgtttagttgactacctccctccccacatttgttttctgtgaaaaacgaacatcattctgtgattttaatactcattctgggcccagcatggtggcttatgcacttttagaggccaaggcaggagcatcacttgagcccaggagtttgagaccagcctgcaaaacataatgaaatctcatctttactaaaattaaaaagattagcaggcatggtggtgtgtgcttgtagtcccagttatgctggaggctgaggcaggaagatcacttgagctcaggaggttgaggctgcagtgagcagtgtttgcaccactgcactctgggcagctgagccaagaccctgtctcaaatagcaacaaataactcattcctctagattactctggttcggcagtggtgagctttttgcctttcactttcattgagtgtgttaggcctgcctttgtcttcaggacttttgcatttgctatggaatgccttggaatgcttttcctcaggtatccatagagtgctttcctcctgcttcagttacttattcagttactatttcagtgaggcctttcccctttaaaatggcaaatcctctacttcttcactttttgtgtcccttcctcctttgtttttgttcattttattcatcatgacctgccatattatatgttttatttaattctttattaaggttttggtctgttaagctctccaactcattaaccagtcgttggaatttttttatatttataacttggaaacaattgataccttttcagtgttgagtatttttatctagtaacatgcatgatacagtctgtttaatttattcaaagcttttttttttttttgagatggagtctcactctgtcacccaggctggagagcagtggtgcaatctcggctaactgcaacctccgcctcccagattcaagcaattttcctgcctcagcctcccaagtagctgggattacaggcaccctcccatcacgcccggctaatatttgtatttttagtagagacgggatttcaccgtgtcgtccatgctggtctctaacttctgacctcaggtgatccacctgcctcagccccccaaagtgttgagattagaggcgtgagccactgcacccggcctcaaagcttcttttattctatagttttttaatgtacctcttgcaaaattttaaaatttattcttttgcattttatgtttttgtgttacttcggtttttttaatactctttttcagccatttgaaaatgtatttgatatacggaaaattcaatgttttgccttaatattattggtttaaatttttcagtggattgtcttatatttctaatagagagagtcttgtcatttgtaaatagtaaatgttacttttaaaaaatttatattgccttgctgggcatggtggctcatgcctgtaatcccagcactttgggaaaccgaggtgggtggatcacttgaggccggagttcaagaccaacctggccaacatggcaaccctgtctctactaaaatacaaaatttagccaggtgtggtggtgtgtgccagtaatcccaagtatttgggaggctgaggcaaagaatcccagaggcagaggttgcagtgagccaagatggtgccactgcactccagcctgggtgacagagtgagattctctctctcaaaaaaaaaaaattatattgccttggtgtagtagctcacacctgtaattccagcactttgggaggtcaaggtggaaggatcacttggacccagaagtttaagaccaacccggacaacacagggagactctgtctgtatgaaaagtaaaaattaactgggctggcctcccagctactctggaggccgaggtgggaggatcacttgagcctgggaggttgaggctgcagagagccaagatcgtgttgccacactccagcttgggcaataaaacgagatcctgtctcaaaaaaaaaaaacccaaaaattatattgccttgtattatctagaatttttagaatactgtcaaatgacagaacatagtatacattttagaagtcttagctttgtgatttagtgtttcatttttagtatattagctattgctttctgacagataccagttatcatgttaacagaatttctttcttttcttgtttattgagagatttcatcaggaatgaatagaattttatcaaatgcccttctagcatttagccattaatcatatggcttttctactcaaaccaaaaatctgtttgcattttctctatcagttgtcagaataatgatgaatttttcccttaacatcctttaaaggagatcagtgatttttaaagtattattatgaataaaatgaaacattactatatttaatcggtttgaatccaatgcagttattattctttttgatgctcaaattttctcatcttaggctactaggagcccattctggatgttttctttgcccttctgacaaggccccgtgatctttgatagcttctctgttttctggtgcgataaaatgttataggcttatcttgtgcatttcctgccccagacctgcagtcagccatttatttccccaaggagtctgggttccttttatgggaaatagtatttatgccataaccgcttttttacctcaccttcaaacagactaacagtttttgtttaatgaaatctagaatacctttagatttacagaaaacttgggaaggtggtagagtccccacatgcccacacccagtttcccctgttcaagcaaacttttgagttattgaaacactcttaaatttacaatgatagaaaattcttcgtgtccccagtacacagcttcagaagttaatcaactccagtcttttgtcatatatgtccccacctacttcccccaaattatttgaaaggaaactccatatattgtataattttatacataaatactcaatcttatgactgtaaggatagaaataatcttaaccaagcaatttacttaatttatgttaaaccattcttatattggtagattacactgtattgggtgcattgaggacttttatgtctacactcacaggaaacattgatgtgttaatattggtttgtaaattgtgttacacaaagacttcttatggtccatgttgataaatgagaaagaatgtatggtatactaggcccgccatttcataggcttttgcctaaaagtttggttggatagggtggacttctccctgctgaagtttgaaaaccaataatttgcatgttttttgaatttcatgttttgtgttcagcatttttctatatttgtcttctaacacgtatgtattttactccctggcttttattctcttgaacagtttaaggaacagaattccatcctttccttgaaagcttggtggaatttattcatgaagctgtcttgtttgggtagatgtttttggatgtggagggagggcaagacaatatacctcttcttgaatcagatggagtaatttgtatttttctaggaaaccacttttatctgtatttaagttattagaatatatagttgcatgcactattttctttgtttaaagaaatttgtttagttttttttttttcatttataagaccatacgtttgtttactttcccttttgtggatctgacttcactgcattttgctttctaattaattttttttttttttttttttgcttttttctttttatcctgtaatgcttccccagcccttttggtttattttattattacttttttgcttccttaattgactactttattttaaatctctgttgtataataatagaagcatttagggagatgttttccctgaatttggaatgtagcattttttttattgtttctcttaatagttgattttcaatttgatttctttaacctaggagttattgtaatcattatcttgtaagggagaaacccattagtctctcaaataaaagtggatttaattatagggattacatgatttcaccaggaatacaggaccaggaactggggcctccaatgacctttgaaaagagtaagcagtatctttctggcttgccacatagttcctcttatgtatggcattagcttggtcactcttttttgagggattatgttaatctggcagtttttctttattcctacttataaatgaagatgtagatgattattattcttttttgagatggagtctcactctgtcacccaggctggagtgcagtagtgtgatctccgctcaccgcaaccaccacttcccgggttcaagcatttctcctgcctcagcctccctagtagctggaattacaggtgcgagacaccacacccggctaatttttgtatttttagtagagacagggttttgcctttttggcctggctgttcttcaactcctgacctcagatgatccgcccgctttggcctcccgaagtgctggggttacaggtgtgagccaccgtgtccgtcctgaggtagattattttaatattgtagctggagtaggcaatattaataatgcagtttgtcagttgccctcagcagcttctcgtcttctcctgtattatatacatcatagcagatggggaatctacagagttcttattgacctttaccatgatttctaaccttattagcacttccccaaattctaggccgttattgcagcttctgtctcatgttttagaattgaagagcaatctcagggaaatatttttattcactggtgattacatgtaactgtcatgtatacctgtttgatgaggtattttttttttttttttccgagatggagtttccctctcgttgcctaggctggagtgcaatggtatggtctcgactcactgcatcctccgcctcccggtttcaagcgattctcctgcctcatcctcctgagtagctgggattacaggcacctgccaccatgcctggctaatttttttgtatttttagtagagacggggtttcaccgtgttggtcaggctggtctcaaactcctgacctcaagtgatccacccacctcagcctcccaaagtgctgggattacaggtatgagccaccgcgcccagcctaatgaggtattttctacctaatgaggtagcaccttcagcttgccttcatctttgtatgtagtgtttcaattatataatatcccagctttaaaatttttaataattttgtgtttattttcatttgataaaggaacaaggttgacttaaaactctggtcttaatttatgttagtttttgtttagaatttagattacgtatctttttacacaattaattatgccaacacatttctctgtagggaaattcgtctgtaggaataacagttttaactgaagtgggctgacttgggagcctttgagagttagcgcagtggagtggaaaaaccgcttggaaaaaattagactaaagataccaacatcagaggttggtggagaaaaacaactgaaatccattcttggtagtgttcatagcaggctaaccttaacccccatgtgggctctggtgaccctctctactcaccacacccactcactgtgggggaagggcctgaaacttggtgaaagactaagttaagaaaaaataggtattactcctagaggaagtgggatctggtaagatttgccaaacaacatatttgtagaattttacttagtaagctgctttgagattattttatcagtaagtgctaaataaaggaaagggatttttgatttttgctttttgagatggggtctcactctgtcgcccaggttggagtgcagtggctcagtcttggctcactgcaacttccacctcctgggttgaagaaattctcctgcctcagcctcccgagtagcagggactacaggtgtgtaccaccaagcctggctaatttttgtaattttagtagagacggggtttcaccatgttggtcaggctggtcttgaactcctgacctcaaatgatccacccgccttgcctcccagagtgctgagattataagcgtgagccactgtgcctggccaaggagagggatttttttggggggtgtttgttattttaaaatagaaattgatgaccagagggatgaaatgactttcccagggtccaaagtcttggtgcttgggcttgaaccacaactgctgattgctggcttgaagtttttcacagggccctgttgacttaattacctttggctatgtgtccagcaatactttatctttgcagcattttgtaatgcaaagactgtcccatctgctgttcagaattctgtgattccgcattcatagtctaagctcttatctctttcttactttttgtttgtctatttacaacagcccatagagccagttgcattaacatcctttgccaaataatgttatcactggaaatatgagatatgagacctcctagaaattcctctgagagtcaagcttaggtaggatgactttgtgctttgttttgtcatttctgtaaaatagcttcccttaaaatgaagaatatctgacaataagtataaggagtgaagcaaagtagtgaattctgagttagaaaaaatcagttatgttttatctgtgtgattgccttttttagtattagtgttccacaatcaattgaagtatttactaagattgagggaaagatgcatcgtattacttgcttgggtaaacccttcccaagaagctgttgtcttctgtttaatgcatgagatgttgagtaagctgtgactggtttgttatgagataggccaaaagttttcttgttttccttctttgttgtctgcactgtagaggtaacacacattgtggtatgtgttctattagagtatgatttagagctaccacagtgtggtagctagtggccacatgtggctcttaagcacttgaaatgtggttagtccaaatttagatgtattgtaagtgtaaaatatacaccagatattgaagacttagtataaaaaaaatcccactgacactttaaaaaatgattatttttaaattacaaaaattgattgcatgttgagatgaaaagatagttttgatatattgggttaaataactatgttaatgtaaattatcattattattattattatttttgagacagtcttaatattgcctaggctggaatatggtggtgtgatcacagttcactgtagcctcaaattcctgggctcaagtgatcctctcgcctcagtctcctgagtggcttggaccacaggcacacacaccaccatggctggctaatttttaaatttttgtggagacggggtgttagtatgttgtccagtgtggtctcgaactcctgggctcaagtgatcctcttgtgttggcctccaaaagcactgggattataggtgtgagccactgttcctggcctaaattagtttttttaatgtgactactaggaggtttaatgtgtgtcttctattaatttgtgttggacagcactgaattagagtataaaatggcttgccaggattacaatttaatattctctcacttgtacattatgaaatatagagacatatatagtacacaaagtacagttatgacagtgtatatggattactttggcatatttaaatctgtttgcattttagtaaactagcaagtatttataccaacaagtatttaaaaaccatatagggttttaaacagttgcttctgggccgtccctgagacttaaaaagtacagagcaactgccccacatttccactatactgatgagacaagcaggttgaaaaggaatcccaagtgactgtggagtgtgtagcacgggctgggttgggggagtgatgaggatgggatgggacaccaaaccacaggtagttctcctgggtaggtttctgacagggctttggtcagctccaggtgttcttcctctttcttgctagatgatgcatgtgtggtatctgacccaagtgtgatttgcctctgagttcagaattgactggaaatcactaagtaggtggattcctgaggctgcaaggggttaaaaatattcattaagttttgctgaaaaaatagaaggtgtgatgtgaagctgcaactgcttataacctttgttttacgcccaagcacaagccagtagagtagtgtggaggaaatgttgccctttaagattgatgactgctcatttccttgctcttcaaaggtctttttctcatttggatacccagctgggaatttcagttgttttagaagtttgactgctaaataagatgtatgtgattttttagctttaatattttaaaatatctttattatgttgtttgtttgttaatgtttgaattggggtaaaaaattcattgcattttggatcacagttctgacttgatttttatggatttactactcagcatcaaaagttacacatctaacattgtgaaaatctgattttttgtttggttaattggcgataattctgtaacaaacattacattgtatattgggaggggttggttttgaaaaggagtatattcattggtgatagattttatagtcataaagcaaataactgtttgcattagagcataatcagataatgaagtggttagtagaaaccaatagactatagattaccaaaattaagatcttgtacaacaaaatataattaacaccgtaacttgaatgtaatttttacgggattgtcttatgaatggtaatgattctaagtggtatgtgaaatgctgttactagcacatgccaattgatagaatgctggaaaaatcacattttacattatattttagataggatttttgtatgcttgagggtgacttggcttatgtttttttttctttccttttagaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttaggtaagtgtttgagaattcagtttcttctgaacaagatagtaaatgaaatgagagaccttcaactattgattaatgatgtgctgttaatatagtgaaattgaggcatcaatgccgaatgtttgaatatacggataaaaattcggcaaccatgactgaaatctaatagaagctttatttcatatcatttgatctttcttcttctccaattcttttattgtaaaatacacataatataaaatgtatcatcttgatcattttaaagtgtacagttgagtggtgttaagtatgttggtaatgttgtgcagccatcactgccatccatctccagaactcttttcatcttctgaagctgaaactctgtacccattaaacaatagccttcctctcctcctctcccactagcccctggcagttaccattctacttccactgtctatgattttgactattccaagtacctcatgtcgttggaatcatacagtatttgtcttgtgactggcttatttcactaaatgtaatgtcctcaaggttctagcatgctgtagtttatgttagaatttctttccttttaaaggctaaataatacaatagtatacatttttaaagaaaaatagtaatcttttgctcactccactactcatccctcaatctcactttcaagaggcaacaaccttaattattttagctgtttcttctggttttacttctatatttctgtgttataggataccacattttgcttatccattggacacttgggttgctcccacattttagctattgcgaataattctgtggacacgggtatacacgtatctctttgagaccctgcttttcaattcttctggctgtatacccacaagtggaattgctggatcacatagtcattctgtttttagtattttgaggcatcaccatactgttttccgtggcagctgcattttacattcccttcaacagtgcacaagggttccagtttctccacatccttaacaacacttttattttccttttttttttatagtggccattataatgggtgtcaggtggtatcttattgtagctttgatttgcatgtctgtaatgatggtgatattgtgcattttcatgtgctttttggccatttatgtatctttcaagaaatgtatagccaagtctcttgcccatttttgaattggtttgttttattgttgttgagttttaggagttctctgtatattctggatataatcccttatcagatatatgaatgtgcaaatattttctcccactctgtggtttgccttttttactctgttgatagtgtcttttgatgtacaacttaacattttttcatgaaattccaatttgtttattttttgttgttgttgcctatgcctttggtgtcatatccaagaaatcattgctaaacttcatgctgtgaaggttttgccctgtgttttcctttaagaattttatagttttaggtcttacatttaagcctgatctcttttgagttaattttcgtatatggtattaggtgagtgtccagctttgttcttttgtttgtggatatccagtttttccccaccatttgttgaaaagcctgtcctttccctcactgaatgatcttagcacccttgtcaaaaagtatttgaccatgtatgtgaggttttatttccaggttctctgttccaaggtctccaaccctcaggccgtggactagcaccagtccacagcctgttagaaaccaggtcgcacagcgggaggtgagcagcaggaggtgagcagcaggaattcgagcattacagcctgagctccacctcctgtcagatcagcagtggcattagattctcataggtgcaggaaccctactgtgaactgtgcatgtaagggatctagattgcatgctccttacgagaatctaatgcctgatgatctgaggtggaacagtttcatccagaaaccattcccctggcctgtgggaaaattgtctgccatgaaactggtcctggccaaaaaggttgtgactgttgatttattccattggtctagatgtctgtctttatgccagtatcacagttttgattaccgtagctatgtaatatgtcttggaatcaggaagagtgaattctccagctttaattattttgtaagattgttttggctatttggggcccttgagattccacgtgaattttagaatgagtttttctatttctgataaaaaaaaaaaattgggattttgagaggaattgtagtgaatctgtaaatttgtttgggtagtattgatatcttagcaatattaagtctttcttttcccacataggctgatggggaaaaaaaaaattaagtcttccagtacatgaacatgagctgtgtttctatttatttatgtgttctttaatatctttcagcaatgttttatagttgttattgtacaggttttcattttcgtggttaattttgaaatattttttctttttgatactattgtaaaaactacataatttccttttcatcatatttattattagtttataaaaatgcaattgatttttgcgtgttgactttgtattctgctactttactgaattcatttattctaacaggttttttgtgtgaaatctttaaggtttactgtatataagagcctaccatctgtgaacaggaataattttacttctttcttttctgtttgtatgccttttatttctttttcttgcttagttgctctggctagaacttactcaagcattcttatggtgtagaaatcagattgcttccgtgtgaatgggaatagatacaaatcttatttattgatcctgattttgtattttgatacttttcatatttttataaagggacttactttccatttaatgtagcttttaaactgattttctaagaaataaaccttttatatttaattttatttctaaagtggcacagggagtttgacatgcagttttttagcttttatttaatgcccatcaattgcttacaatgtgactaacaaatttttgcattgctgtgttataattcttactgcctaatgaagttatttacaaatatatttgaatttctttatgaaataaattgggaagtaacatttcatagttgatgtggaagattgctttcttttctttcttgggaaaaccctttttattttcagtcatgtgaaaacacttaaacatatcagtgtgcttttttacctgtcttacaggattgtactgcagcctgtcttggttaaatcggaaggttttgaggggtagagctagttagtggggttagtatggcctgactagtggcaggcaatgtggctatttttttttttttttcaattttttgctttttgctttatttatgttttagcaaaactggtgatccaagcaagtggagtattgcattttatctctttattacgttcactttgaaataaggattgagtgtttgttcatgttttattatttgtttgtacaaagtcctatgagtagaattattggatcaagtaaaaagaacgttttagactcttgataacatattgccaaattattttagtgccagtttaaattccacaagcaaagtgagagaatgcttgtcatatctcattactttttgcctttactgggtgctattgaaaacagatctctgtgatttttagatgaaaacttgtatcttgcttaaatttttatttttaaaattagtaacaggagcaagtattttattttattcgattttatttgtttttttttggaggggggggacagagtcttgttctgtcgcccaggatggagggcggtggcgctgtctcggctcactgcggcctccacttccccgggttcaagcagttctcctctctcagcctcccgagtagctgaggctacaggcatgtgccaccacaccgggctaattttgtatttttagtagagatggggtttcgttacgttggccaggctggtcttgaacttctgacctgaggtgatccacccgccttggcctcccaaagtgctgggattacaggtgtgatccactgcacctggccaacaagagcaagtattttaaatgcttattacccggttgtctgtcttttatgattttactttcatctttagccttgtttttaaagagttgatttatctggttaacgtatttccctaatttgttttctaattcctcctttatcatggcatttggacagtatcatgcacaatgtcgtggttcatttatatattctgtcccagcagttattataaatttattacttaaaaaaattttttttccttatctatgttgaaggactagcaaatttattactttctattattctgagaaagattcagactagtgatatggcttgggtagccctgcttcatgaggcccctcaggaatgtggctaagcacaggacagagaggataagagggtctgtagggtagtggttacagtggaatgtgttttagagacatggacagaagactgggggggactaagtgaagatgctgtagtaggcttttgctcagtggtactccaagagggagacatgggagaggccttgtccttttctctttccttaccttcctgcttttttcacaaatagaactagaaattttcttactttgctctgttcatcacagagtttctcttttattaacctcagtaaagttaaatagtatgctctttataaatttactaaaataaaacttttcatatttggtgttcaaaactatctcatttggcttagataaaataatgccagagatattttgtttagaagagtaactaaactccctgcattttggtcgtagcttcagttagaatgccagaaatacacgtatcctcatggcttatacactttctacccttgaactaaaaacaatgtttttcaggaatcctacctatcactgttttttttttttgagacggagtctcgctctgtcacccaggctggagtgcagtggcgcgaaaaacagacatgaggtcaaaaatgtcattccagaacctcttgggattttgaaaccagtagctgtatgtcaaaaaaccataatgagtatatgctcttttttttctttttttttttttgagatggagtcttgcactgtcaccagggctggagtgcagtcacatgatcttggctagctgcaacctccgcctcccaagttcaagcaattctccttgcctcagcctcccaagtaactgggattacaggcacccgccaccacgcccagctaattttttttgtatttttaatagagacggggtttcactatgttggccaggttcgtctcgaactcctgacctcgtggtctgcccacttcagcctcccagactgctgggattactggcatgacccactgcctgtggcccataatgagtatattctatttaagaagatacattagtatattgttttgcagcttggggttatttctattcaaaagggttgatataaaattttttttatcacttgaagtgaaaaattgtggtatcttgaaaacatgagtgtatacaataatactaaataaagtgctctgtagctaaggttctactgttaacaaaatggataatcccctaatctaaaaacaaactagcaaaaatctccattttctttccttaaataaccatcctgatgtgctctcacaggcagtcttgatttcctcttcaattttttaagtttttttttttttgagacagatttgctcttgtagcccaggctagagtgcaatggcacggtctcagctcaccgcaacctctgcctcctgggttcaagcgattctcctgcctcagcctcccgagtagctgggattacaggcatgtgccaccacgcccggctaatttattatatttttagtagagacagggtttcttcatgttggtcaggctggtctcaaactcctgacctcaagtgatctgcctgccttggcctcacaaagtgctgggattacaggcgtgagccacggcacctggcaagataatttttaaaaaacatgaggccaggtgcggtggctcacatctgtaatcccaacacttttgggaggccgaggtgggcggatcacgaggtcaggagatggagactatcctggctaacatggtgaaaccccgactctactaaaaacacaaaaaattagccggcgtggtggcgggcacctgtagtcccagctactcgggaggctgaggcaggagaatggcgtgaatctgggaggcggagcttgcagtgagcctagatcgagccactgcactctggcctgggtgacagagtgagactctgtctcaaaaaaaaataaaaaataaataaataaaacatgagatcctttgggaattttctgttttaaaaatttgtctgtattctatctgtataaaggaatatgtatataaaacatgttaagttataaagattcaagggaatgaacacctgtgaagctgctactttctgaaaaaggaacattaccatatctttaaagccctctcttttctgagttaaatcactatcctggatttgtgtttctcttgtttgcttatttcatcatatatgtgtatttgtaaaaaaaagtttagttagcttgcttctgaaatttatataaggtattccttttgtttttgttctttttataaggtcttgctctttcattcaggctggagtacagtggcatcactgcaccctctacctctcaggttcaagtgatcctcccacctcaggccttccaagttgctgggacccacaggtgtataccaccacacctgactgattttaatttatttattatttattgagagagggtcacttaattgcccaggttagagtgtacaatcttggctcacttcagcctcaacctcctgggctgaagcaatcctcctacctaggcttcctgagtagctgtgactacaggcatgcaccaccatgcttggctaatttttttgtatttttttgtagatatgagattttgctatgttgcccaggctggtcttgaactcctggggtcaagagagctgcctgcctcagcttcccaaagtgctgggattaaaatgcatgagccattctgccaggctttgattttttttatttgtggagaggaggtctctctatgttgtccaggctggtcttgaactcctgaggtcaagctatccttctgccccggccccccaaagtgctgggattacaggcatgagccactgcgcttggcactatataattatattcttatatgtattcttctgtgactctttgttcgctgtttatatgcatcataaatgttgatatgtctggctggctggtgttatgtgaaataccttcaaagttttatgaacctttgattccttaatttcttcattgttcttttcagattacaaaagtagttaatatttggaatcaaaaatcataagaaagggacagtccttcgtaatctcattcattgctcagctagagtcatatcaagtttattttttctccgcttgtgttatgttaatgctttttctcttctctctttttgtttttttttttttcttttgagacggagtctccctctgtcgcccaggctgcagtgcagtggtgtgatcttggctcactgcaacctctgcttcccgggttcaagcgattttttttttcctgccgcagcctccccaatagctgggattctaggcacccgccaccaggcctggctaatttttgtatttttagtagagacagggtttcaccatgttgtccaggctggtctcttaaaaccttttccaactgcagagtgtctggttgagggagtgggggcactattctgtttgtaatatctgtgaatagtgttccctagagttttgcaccgtgacaatctttcttaacagtatttcctggaaatttattacagcagatttattgcagtagttctattatcttatagatgtaccgtaacttacccagtacttttttgatgtacatcttcaatgggctttcactgtttattcattcagaagtatttttgtgtatagcatgtatcaggcactattcttgcagttttacagacattgcagctatgaacaacttttgcatatatttctgaatacttgtacacatatatatgaaggataaatgcccggatgtgaagttgttgggtcaaaatatgaatattttatattttgatattcacctttagagggaaattcgacagtagcttccacagcattgcaccaatttgtagtccatttgtgtgtgtggaggtactgttttccctatacactcatcagcattgtattgttggtcttttaatttttgctaatctgaaaggtgaaaaattaataagaatcaatctctttttatccttaaattcttgaacattaggacacactcattaagcttttggatatgattaaacagtattcaaatgatatgcacattaatgttaaagccattaaaatataatattctaatttactgtatatattatttttattaactcagttaataagtatataataaggacttaatttggatatggctatgtagtcttcccccaccgccaccgagacaaagtcttgttctgtcacccaggctggaatgcagtggcgggatcttggctcactgcaacctctgcctcctgggttcaagtgattctcctgcctcagcctcccgagtagctgggattacaggcatgtgtcaccatgcccagctaatttttgtattcttagtagagacagggtttcaccatgtcggccaggctggtctggaactcttgacctcgtgatctgcctgccttggcctcccaaagtgctgggattacaggcgtgagccaccgtgcccggtgtctgtgtattcttaattgtggagaagccagaagtatgagatgggctttaaggtgtttgttacacagttagggaggtaatgttcacattcgaaataagtagcaagtagataggtgtttgcatgatgaagcactgtcagttgtacatctaaaggtcagttactgcattggcctaatgaatggagaattcagtcaaggcttcttgtagtgagacttgagggagctttgaaggatgaatgcgcctactttggattggcagagtttgtaggagaagaaatgccaagaaaggggagaactgtgagtggtcacagaaatagaaaataaaatggtttattttagaaataaatagaataaaatacaattgcatctatatagcaatattcagttttttacaaatacagttttcacttatcactgctttaaattataatcccattacatacaccaaagtttttctaatttaatcagatttatttaatcagaataaaatagaaaataaaatggtacacacccacaggtagagtaagccctttgaactgagtaagccctggagggggcttgaagaaatgtaggtttgctaggaaagagcctggggtcgttcagagataggacgttggtgagcattttgagcagaggaagggggttgaaagtaataaggtggactaactccacactggtgggagactggcaggagttggggctgctgtttcatttgaagaaggttataataggctttcagtagggtggtggtagtgaaaatggagaggaagcatcactggtgattattaataaaatgataatttctgtatagataaatcacctacaaataactcagttttgctatgttctatttaaatctgattaaattagaaaaactttgctgtatataatgggattataatttaaagcagtgttcagtgaaaactgtatttgtaaacaattggatattgctatatagatgcagttgtaaagtgtttcttgaaagcattgtgtgtgcctgttagttccaacatgtcaagacacaggttatcaaaaatgagctagtttgctaatatagaagagagcctgtattgactttatgtatttcttctgttacaactgtatgagaatgttctttttgtgtgtgtatttttatttctacatgtttgagggtcagcccctatttatttttgaagaaatttaaattttttgtcccaatttttaaaaattattttttacttttttagtagacgggggtctcactgtgttgcccaggctggagtgcagtggttattcacaggcatgatcattgtgcactgcatccttgaactcttggcctcaagtgaacctcctgcctcagcctcctgagtagctgggactataggtatgtgtcactgtaagtgtgtgtcactgtaccttgccctgcccagttgttttgttttgttttgttttttttgagacagggtctctctgtctctcacccaggcagggtatagttgtgagatcacagctcactgcagcctaaccttctgtgcttaagtgatcctcctaagtagctgggaccacaggtgtgcaccaccatgcccagctaatttttacattttttttgtagagaccaggtcttgccatcttccctaggctggtcaggaactcctgggctcaagggatcctcccgtctcggccttccaaagtgctgggattataggcatgaaccactgtccccatccccaattttttttttttttttttttactgtggtaaaatacatactgtctgaccattttaaaatccagtggcatgaagtatattaatattgttggaaccatcgctgccatctatctccagagaacccttttcatcttgcaaaactgaaactctatatgcatttaacagtaattcactattccctcttcccccagctcctggcaaccaccatcttgctttctaagattctgactactctagatttctcatataagtagaatcatacttatatgtcttattatttgacttacgtgtcatattatctgtcttcttgtgattggcttatttcactaaacgtaatgtcctcaaggtttgtccatgttataacatgtcagattttttttcctttttaaggcatagtaatattctattgtatgtatacatggtgttttattcatttattctccaatggacacttggattgcttccacattttagctattgtgaatgatgctgctatgactgtgagtatacaaacatctcttcaagattctgttttttaattcttatgagtatacacccagaagtgaaattgcgggatcgtatggtaattctatttttaattatttgaggaaccactaaactgttttccacagcagctgcaccattttacattccccaccagcagtgcacaggggttccagtttctccctgtcctcatctgcacttactattattactatttttttttatagtgaccatcctgatgggtgtgaggtggcattgcattatagttttgatttgcatttctttaatgattagtgatgttgagcatgttttcatgtgcatatttgccatttgtatgtacttggagaaatgtctatccaagtcctttgtccatttttgaattgagttgtttttagctgttgagttttagaagtcctgctcctaccctactcccttttattttagtgcagcattgcagtgggagaagacattctttagttggtgatgatacagtagctggtaggtgatgagaaccggatagctcaggatcttagaaaatgcagagtaattaaactgattcattcattgttactttatgaattattttactgttagattggctagactgagccattttaatccacaaaactccctaaaaaacctcttggtttatcttttccctatgttagccatagtatgagcccctgttaaccttggcagtaaccgctaggaagcattcttgtttttgtttttgttttttatagacggagtcttgctctggttgcccaggctggagtgcagtggtgtgatctccgctcactgcaaactctgcctcccgggttctagtgattctgctaccgcagtctcctgagtagctgggcttacaggcatgggccaccatatctggctaattttgtatttttattagagacggggtttcgccatgttggccaggctggtctcgaactcctgacctcaggtgatccgcccaccttggcctcccaaagtgctgggattacaggagtgacccactgcacctagcctaggaagcatttttactgaaatataaaccagtttattaaaaggtgtcaatatagtgcttgcagggggtgatggtgggggatgacttggcaggttttatattaagtatatttaacatttaggcacattaaaatattaatttttgacctaaatgtcttatcaagataaagtcaatgttacaaagtaggtgacaaaatatatctgttgaactgcttgttttttcctgaaattttggtatcttaaaaagcatagacttttgatgaggacttccacaagtgaaaatatattacatgtatagtatcttactgttttcagaatgctttcacatgttcctgcatttagtccacaaaaccatcttaaaaaggcaggtgagaaaagtgttacttccatttgaaatgaggtgtagagagacttgtaaatttcctaaataacttggatagtaaccagtagggctaaggctaggatataggactgttatattctggtctagttaagtttaaaaatttataaagaggaaaaagggatccatagatttagagctgtcataactattataccagtagcctactcatttagtaattataaatgaatctgaatacttggaattgataagattatgccaaaattcatgaaattgtggcattatttcatttactgttgctgtataatatagtcttccaaaacatagtggtgtaaagcaggtattttattatgcttgttagaaacaagagctcggagtcataaggaaaatgagtactcaaacgaaggatttctcagcaaggcaaatttacttctgcaaaagggtgctgcttgcacttttggccactgcgagagcacaccaaacaaagtagggaaggggtttttatccctaacgcggttattccctggttctgtgtcgtgtccccattggctggagtcagactgcacaatctacactgacccaactggctactgtttaaaattgaatatgaataattaggtaggaagggggaggctgtttgttacggtacaagacgtgtttgggcatgtcagggcgcggcaaaggcaggaagggtagttttgatgggaagagctgtttcggcgggaggggcagtttacagaatgggtggtcaggagtgaagaggacgctttccaaataaggaagagatgtgacttacagattgggactcgcaggagaagttgtttacagagcaggtagcttagaagaagagacaaggaagttgatctcgagaacaaagaacaaggaagttacaaattaaacctttgaagaggaacttagccatatctgacagttcccttcttttgatttttataattcttcctcttcaaacgtttttaacatttcttgactctgttattctgcctggttttctaaaagtaggagcttatctgaataaggtggtggggagattgaaaaaggttttaataagagctgtttcaataagcctttgtgctaggcttctggcacagggtatgatataacatcctacaagaataagcacacctgttacaaaggcaagagaagtaaggattgaggacataagtcctttccatttgccaaaccatttttccattaaattagtgaaggaggccgggcactgtggctcacgcctgtaatcccagtactttgggaggctgaggcaggtggatcatgaggtcaggagatcgagaccatcctggctaacacggtgaaaccccatctctactaaaaatacaaaaaaaaatttagctgggcttggtggcagtcacctgtagtcccagctactcgggaggctgaggcgggagaatggtgtgaacccgggaggcagagcttgcagtgagttgagatagcgccactgcactccagcctgggtgacagagcaagactccatctcaaaaaaaaaaaaaaaaattagtaaagggatcatttattcctgaatttttagctagttcattggataaagcagtaagaccttgtaatgcttttgttgttatggttccatcgggagcagtattattaggtataaaagtacaacattgagttccaatgatgacacaaactccacctttctctgctagtatcatgtctaatgctattctattttctgaagccatttggctggtaggtcctaattgtttagctgttcctttactagcatctctaatatagttaacaaatcgttgctggttgtaatagatgtaatttatccaatctacatttttatttacagttaaccaccagaatagtatggactcaaaccctgcactatctgattttgcaccttaaattcatctggcactcctctcgggactccagtggcatctatataaacgtgagggtcaaaggacccatgagggctatctcttgttatacaatcctttgtctttatcctttttggttgatgaaattctagggtgaaagggatggccaattggatcagagcacaagtgctgctctagttacttggcagagtgtccagtgatggtccgccacaataccaccatacatccacttgcggatggatcagggcagactgataggtcagctctcggaatggcttaaactcactgcatccctttaggtctccaagaaatgctaagttgtccccttgttgtgagagacatgaggtaaaattgacgtggccctcagggcctgacccatagggtgccgaacttcagggaatagccaagagagagcttggcataattcattaccctaggctgtggggcgttggaagagagctaccatacagttcatgcctggtcggctggaggaccatctgagtggaaaggggacagtctgggcctctggcctgcggtgcgcacaagcataacaatctcttttgtttagagtgcggatggaatatttaatccgtttcagccaggcatttgcatctttgtatcctgtctctagagctatagtctgccttaattctttcacctccacagccgttaccttagttgggtggttctggagatgggaggagaatgctgggcatgatatgtttggggaaagtgttggatcccatatattccccggactctgggtctggatttctttattgttttcaaccgactcagagagaagattcttatggggtcccgtcctataacatctgctcctaacccataccattcgaatatggagggttcttgggccattgtttggggattatctataattagcaacaaggggataaggggttacattgcagtgacttacaatttgatggggtgggaccacgtaagttggagtttctgtttcagtccttgcaacttgtttgaagaagggggcctggctgtccatcctccatattgggtggtccaccaaacatctgtccagtcaccacagggactttttaaggctccatgcttatactttgttgactcactacagtacggacatagatacttatctacatttgatagctgcctttgagttcgttcatctccatatgagatgactgaacaagcgtcaaactgaagggttaagggatggttagtttgagtcacatagatgacaaggtgaccttctgttggaaagaaaagggaaaataatattaagccctttttagaggtaatttggtgggggtgggccctggggtgacggctcatttttctctggctgtggaagccactcctttcactcgcgtgtggtctgtccatccccttttggccgtgcagatagtggtttctgtagttagaagcactagatagggtccttcccaagctggttcgcgttttccttctttccagcttttgatgagaacgtgatccctaggctgatgctgacatgctgggaactccaagggtggtgtctctgctaaaaggcctttagttctgagggaagagaaagtggaagacagactaagtatgtaactcctgagaaattgatctttagtttcaaacgtaggaatgtcagcagtggagtgtaaataaggcaacccgtatagcatttcataaggagataagccaatatctttccgaggggtagttcagaccctcagtaaggcaatgggaaggcatttggtccatggtagtcgagtctctaaagttaatttggtgtggtggctttttagggtttagttcattctttctactcttcctgatgaaggtgagtgccagggggtatggtattcccatcttatttctaatagctgggctagctttttaatgacgtgcagcgaagtgggttctattatctgaatcaatattttctagtgatccaaacctaggtatgatatttttgattaatgccttaactacattactggtggctgcacttgaaaagggaataacttctacccagtgaggaaggtgatccagtattacttgtagatactttaggcgacctattgggggcatttcagtgtaatctatttggatgctttggaatggccctattccagggttcttcctccgatgggtggttttcttaggattcgcttattagtttttttgcatattaaacaattatctgtaacttgttttgctagagtataaattcctctacatctggagactccaagaactgcatcacacagagcttgaggtccccagtgggtttcttgatgcaactgagataaaacctccctcatgagacatttggatagcatttctctttgatctggtaacacccatttcccttctgagttttccttggctcctatttttattaacttctccttttcagcgggggagaagatgggaatggcggtagggggagaaaggcaaggagggaggtgaaaaacgggcgtttcagaggaaacggcagcttgtttggctatttggtctgaaggttattccctcggctttcaaaagaaggatttttctggtgtcctgggacatgaacaatagctatttcttctagcaactgaaggttatctaatacctgggtgattaattctttgtggacaaggtcttggcctttgctattaatgagaccttgttcagtccaaatttttccaaaggtatgggctaccccaaagacatatttagaatcagtataaatattcccttcttggttttgtaaatgttttaaagcctgatttaatgcatgttaaacatgcattaacatgtttgggccaaccaattattgggcaatcttcctgactctacttctgcaagagcttctccatcaaccaccgaatacccattactcctttttcccccaattaccctagaggggccatctatgaatagatgtcctgttttgaaaagggtctctcttaaatcagccttgacctttgtgtgataatcaattaaatctaaacatttacgcccagggccttttagatttgggttccctgtcaggaaacctgctgggttaagtgaattatcagtggttaatgttaagttacctctttctagtaagatagcatcatactttaaaatccttgagtcggtgagccatcttcctgccttttaagattgttctaacctgatggggtgtggtcaccaccaagtttcccccaaaggttagcttcctgcttttgttagttaacaaggcggtagccgtgataaattgaacacatttgggccacccacaggttactgggtcaaaaacttttgatacaaaggccacaggttgtcagtggcccccatgttcttgagtaagcacccctaaagctacccccttgtttgcgttaatgaaaaggtgaaatggtttttctagggaaggaagggctaagacaggggcagtgatgagtaggtgttttagctcctcaacctggtggatttcatcagaagtccataggagaaagtcaggcttttcctgggtgagcttcaggtataagggtttcatctctagggcatattaatcaatccatagtcagcaatacccaactaatcccaaaagttttctgagttctttcttggttttaggcaaaggtaaggacacgattcctttgacccgttcgggccttatccttggcttgcctttacttattaagtgtcctaaatacttaaccttgggttccacagatcggagctttccttttgaaactcgtaaccccttctcttgtaaatggttaagaaggtgtgtggagaagacagccacctgttctatagcttcaccagatataagcaggtcatccacgtattggagcaagcatatgtgttttgggggtacaaatttgttctagaatctgttctaggatttgaccaaagaggttaggtgaatctctaaactcttggggcaagactatctattggtattgttgctttcgctcagaatgaggatcttcccattcaaaaacaaatatgtccctgctgtcctcagccaaggggcatgcctagaaggtgtcttttaagtctatcactgtaaaccattgatggtcatatggtattttgctgaggatagtgtaagggttgggaacaacagggtgggtagtctggactgtttagttaatagctctggggccttgcactagtcagcatgacccgtctaatttctttacaggctatattggagtattataaggggacatacagtgttcaaggcgcttatcttgaatgagaccttcgactacaggttttaggcctatcctgccctctaggggaatgggatattgctttcttcttactatttcccctgggggttttaacttcatatgtattggagcaacttgaagtcttcctcgatttccttctctcgcccatacatcaggatgaatatatttttcatttgcagtggtaagtagatttaatgaggtgagaaatccgtttggactgacatgtaggcctatacctagttttagcattaaatgtcttcctaataggttagttcctgcctcagggattaacagaaattgaaagtgggctgatcaatttttatatttgacctctgtgtcttctaagattcttgctttaaacctttctcctttcacccccaagacaaaaagttcttctgaggagcaagggacattaggtaaagggaaacaaacaggaacgagctgctcttgaatctgttaaaagggttataacttcatgtttgggtcccacctctaagtttatcaagggctcttggtagaattcaagataaaaagaatagagcccctgactcccttaaatggaatgacttctttctccttctcccattcaggacattctctcttaaaatgactgctcctccacatttgaagcatgtattttgtcctccctccctccctgttctgaggttacctggtcttgtctctctatgtcctttatatggtttagcatgtgaggacttaaatcctttgtaagctttggccccctgtagcccttgtttaggggtgtggggtctgtaggtaatggagagtagtatcagtgggccttgtcttttggaacccctgttggaaggtgggtaacgtaatttttcccttttgtttctgcttttcttcatctcttctcacatatactttttgagcttctcttaaaagctcttcaatagtccagtctttccaattctctatcttttgtaatttcttagcaatatctggccaactgttcataacaaaatgtaacttgagtattccctgcccaagagggtcttctaagtctaggcctgcatattgtctcatttgctctttcagcctctctaggaattccataggtccttcatcctttctttgttgtatatggaatgctcaggaaatatcttgggtctgaggtactgattcctgaattccttttattaccatttccctgagatctttcatattctcttggtgagctgcattgttattgacccatcgagggtcttgggctggaaatttttggtcggctgcaggaatgttttggccaggaggatgttcacgttcccagactaccatagcaaccctttggatcatgcttctttcttcccctgaaaagaggatgcccaggatggtcattaactctgcccaagtatacagctgtggccctaagaattgatcaatttgatctgctaccccacatgggtcatctaataatgactcgagttcctttttttttttttttttttttttttttttgagacggagtcttgctctgttgcccaggctggagtgcagtggcacgatcatggctcacggcaagctccacctcctgggttcacgccattcttctgcctcagcctcccaagtagctgggactacaggcgcccgtcaccacgtctggctaatttttttgtatttttagtagagacggggtttcaccatgttagccaggatggtctcaatctcctgacgttgtgatccacctgcctcggcctcccagagtgctgggattacaggcttgagccactgcacccggtcttgagttccttttttaaatttcgaacttctgagctagtgaagggggagcatttacaaagccgattccttctcctccaaggggcacttccctcaaggggaaaagagttggggctgattccttagaggtggaggggaaaaggagttctgaatatcctttttacactgttctgtctcacactagagccttcctggaggaggcatagactcagacgtgtggttagggagggcacggggcattggggcaggcattgactcagggttatatggaggaggaattgagtgaagggggtcctgtgcacctgcttggggtgggggatttggcggaggtgggtggtctggtgggtctcatacattggtggattgttttggggtagaggtcttactttcctcagaggaactgatttctggcttacttcctatagcttttagggggtaaagaaggatgggtccctgctgccaatacagggcataatctatttcctcctgggagatgggactcttgtcattgacatactctattagaagttgacaaattcaatcctcatttgactgaaactttggccagaaaactgagggtgtgaggatgagctctgtggtccaaatgaaacaacaatattttgtcatttgttgttttttattatgtttagtcctttcactgtccctccagtatgttaacatgagacctaagggactaccagagggaatgttgttatcatcactagctttatatctttcatttcctgtcttacgtggggtgtttcccatcctggaggtttgatgtgaggctcaatgccacatgttagagatttcttgccttctcttctctagaggtttgctgaggctcagtccctccttatattagagatttcttgccttcccttctctagaggcttgctgaggctcaatcccttgtattagagatttcttgctttctcttctctagaggtttgctgaggctcagtccctcctcatattagagatttcttgccttcccttctctagaggtttgctgaggctcagtccctcctcgtattagatatttcttgccttcccttctctagaggcttaacccccctctactggaggtcttttttactctccttttgctttgtccttctctggctgcttccctcacgggaatttaagtccctcttagcatcggtgtgtcggtataagccccacaacaggaatctgccataagccatatgaggtgaccacagaactgcagatccagactccacgcttgctttgtgcttaattgtacatctcattcacacacattcaagctccaagttgtcccaaccaccaaggaaatactttgtcacccccacgacttttcttaccttggtttgtgtacagagttacctggttgccatggtgtgtgaggatccttttcacctgcgttgctgagagtccaggtttattcatcatgctgggggaggtcttgatccctcatccctgaggccaccacagtgaggcagggggacgcatctcctcatgagagatgatcagggacctcttcctggatgagaaaggcaatcgcggatgagcccccaagttgttagaaacaagagcttggagtcacaaggaaaacaagcacccaaatgccaaatgaaggatttctcagcaaagcaaatttacttctgcagaagggtgctggtcacacttctggccgctgcgagagcacaccaaacaaaggaggggaaggggtttttatccctaacacggttaatctctggttctgtgtcctttccccattggctggagtcagacggcacaatctacactgacctgattggctaccatttaaaattgaatatggctaattaggcggaaagggagaggctgtctgttacagtacaaggcatgtttgggcatgtcagggtgcggcaaaggcgggaagggtagtttcggcagggagagctgtctcagcaagagggggagcttacagaatgggtagccaggagtaaagaggactctttccaaataaggaagagatgtgagttacagattgggactggcagaagtagttgtttacagagcagatagcttaggagaagggacaaggaagttgagcttaagagcaaagaacagggaagtcagaaattaaacctttgaagaggaacttactgtgtctgacatgctcatggattccttaggtcaggaatttggaagggcagtgtgtgggtggcttgtttcttatcccaagatctctggggtcttagctgagaagacatatgcttgaggtgcacttggccagaagctcagatcacttggaggcatcttccctgatatgtttggcagctatgccacctgatgacttggacttagcttggctgttggctggaatacccatatgtggcttcttcatgtggtctaatttgggcttctttatagcatgagagctaggttccaagaatgagtgtccccacagagcaaggaagatgtgtgtggtatttttatggttcagccttggagctgtatagcatcacttaaactgtacactgttggttgatgctattacaaaaggccattcagattcaaagggaggttgataaagaccccactactcagttggaagaatgtcaagtttacataaaaaggaggacatgatgggagataatgtggttatatttggaaaatagaatctacattatgaagggttgttgaaaaaggaaaggtttgaataaagccatatttaattcatgcccttgagccatgatcttttttcatttcatttgctcttaacttaaaggcattcatggaatctctgcagaattggttttctgattcccaaattgtagacaatggggagaaaataaactgcaaaacctgcatactttgcatcctgcattctttctcatggttatgttaaaataaccatttagctaacaaattcactttatggaaagtttggtatgcttttggctgctgttctgtcataaaattgacttatctaagaactgtcaatgttaatacaaattagatttttattagcatatgcacaattttttgttgctgtaagttcctggagtctggttatagtatatagcaatgacacagatccatttttctatagatactgggtggttatttgagattataatctggattgaaaatttgacagcaaatataggtaaagtcaaagatatgtcagaaaaataaaaggcacaccgagaatatgtctgttatgacacagactactaacattaagctgccagttctataaattgtacatatatattgcgtatgtgcaacatgtaagtacaatttgatataaaagtacatgttgaacatacatgtacaacatgactatggaaccattctcttttcaaatgttaaggttcatgggttttggaaacttttcagggtaggttgtctccagtcattcagacagagcctcaaatactggcatttatattcgtgaattcacagagggtcttgtgcccaactttacaggtgtagatacctgctgcttgtggcacgctaagagtggattggtctttagggagatttaggtttatcagggtctttagggagatttcaggtttatcagaaaaaagcaggaaacacaactgttggggagataatttcctttatctaccccctccattctttttgctgttctcatatttcctccctgtgttagaaatcctgcctttcaatgccatcactttagctgtcaacagtcttttgaaggaaattacaagaagaaaatacagcatactgttttacatttatgcttatttactgtatgattttcattcccagagatccagttttgaatttatgttttaaaataatcctggtgattttgttttacatttcttgtaatgcatgtctgctgtcagcaaattcttatatcttctgtttatctgaaaagttattcttccactctgcttttgaagggtattgaattttcagttgagtttgttctttcaccactttaaagataccttctggcctatattgcttcggatgagaagttggccttgatttgcattgttcccttgtttcttttttctctcgttgctttcaagattaatcaaacataatcaatagtatgactatgatgtgactaggtagttttctttgtattattttacatggagtttgatttgtaaatccttttttcccctccatcaaaggtagaattattgattcattatttctgcaagtagttttcttttttaatgtctcattttgcactctcttcttttagttctccatttgtacttactttagaccttttgaggtttctggctgaagagactggatgctcatgtcattaattaattaagattaaaatgcagcatgtttacttgtaatctcaaaatacacgttattacatttggcagttaagaggtcattggtgaccttagccacagatagtgaaaagtggagtccgaacaagaaaaaaagggttgaggagtgaataggaactggagaaatggagaggcttacttatgtttctgtgtttgatgctccataattatgtttataatccaaagttttattttactttttggccttcatcttaaacggcatctccctcttccctcctttttaaagcgttctgaaaaaatatgaaccattttgtgacatttctaggagaataattgctataataaactgtgcttatagaaaagaatattttagctagggaattaatatttttctgacttgatgtgacttgtggttgaaccgctctgacattggatatccaactggcatcttttttatcttcatgtagcaggaaaactggacagtgttatatacaaggaccatttgccttttttttttttttttttgaagactatcgctgtagtgcactggtgtgatctcagcgcactgcaacctccacctcccaggttcaagcgattcttctgcctcagcctctggagtagctgggattacaggcacgtgccaccatgactggctaatttttgtgtttttagtagagatggggtttcaccatgttggccaggctggtcttgaacacttgacctcaagtaatccacctgcctcggcctcccagagtgctgggattacacgtgtgagccactgtgcccggcctcattttgcctttacttgggtgatgttgcaattgttaggaagcaaaagacttgaggcctctatatatattaacttttttgtttgttttaatggacactagaacattattgaataattcattattaacctattgcaggtttttgtgaagtcataaatacatttcaggtaataatatacataagggtgacttcattaagcaatattttttaactgggaagactttcatatgcaaattaggtatcttcaaaacttaaaagttttgacattcaaaattttcttatatgagtgttttgtgtaattaaatacagagcaccaaaagcaaaatacaacaaagaaaaataaacaaaaaacatttaattcttgaatacagttctcctggggagcattttgacttcctttcattagataatattatagttaagaatgaaatgtaatattgaagcgttttgttatatttttactgtgcattagtatttttttttttttttgagatggagttcactcttgttgcccaggctggagtgcaatggtgcaatcttggctcactgcaacctccaccttctgggttcaagtgattctcctgcctccgcctcccatgtagctggcattacaggcatgcaccaccatgcccagctaattttatatttttagtagagatggggtttctccatgttggtcaggctggtctcgaacttgcgacctcaggtgatccacccaccttggcttcccaaagtgttgggattacaggtgtgagccactgcacccagcctgcattagtattttagaataaagaatggttacgtacttaacgttaaagaaacccctttgtagtgactttactcatgattccaagatgaatgcagtttagtacttcctgattttggagtattttaaccataacgtttcagaatttggcaggtactttataaaaaatgcctggttattgcaggtggttgtagtgttggatttgttattgaaatattatctttctttttttttttcttcccagttcaaagcagtattcagcgatttcaagagaagttttttatttttgctttgacacctcaacaagttagagagatatgcatatccaggtaagaggaatatttggaatatatttctcatgaatattggtttattcacctgtagggctgccataacaaaatttcacagactggacagtgtaaacaacagacttttgtttttcaaaatgctggaggcttctgtccaagatcaaggttttggcaggtttgatttctcctgaagcctttctccttggcttgcacgtctcagatggccttttctctgtgctagtgcatccgtggtgtctttcttttctggtaaagacactgtcatattggattggggacctaccctgtggctttatttaaccttaatttcctccttaaaggccttgtctccaaatacagtcacattgggggttaggacttcaacgtataaattttggggatacacaattcagtccataacagttgacctgtttctctcatgaaagggtagtatactttgactaaagtcagccaaatatttagtaaatactgtgtgttagaataaaatttttaacctttgaataaaacctcaatgtcttttagattactttttgttatatttggcaataattttttaaatgaaaaatttattcccaggttgggcatggtggctcatgcctgtaatcctagcactttgggaggtggcagtatcacttgagcccaggagttcagaccagcctgggcaacatggtgaaaccctgtctctacaagaaatacagaaattagtgtcacctactcaggaggctgaggtgggagaatcacttgagcctgggaggtcgaggctgcagtgagctgttgtgatcatgctgcagcactcgagactgggcaacaaagcgagaccccatctgaaaaaatatatatattgggtaaagcaatataaaaagaatttatagtagcccaaagacagggtgaccataagctttatcattccaaactggggcatttttgagagtgaaagtaaacattactaataattattctgagataagaacataaactgaggtagttatgggtaaagtgagctgtatagtcatcctgaccaaaaaattaccagatatatgaaaacaattatgaaaagtattggtagacccatttgtaaagagcagatgaactaagagatgtaagaagaaagaaaaggaaatctgtagcatttaattttccaattaaaaatatttttaaaaaggctgggcgtggtggctcatgcttgtaatcccagcactttgggaggctctggtgggtggattacttgagttcaggagttcgagaccagcctggccaacatggcgaaacccatctctactaaaaatacaacaaattagccgagcatggtggcgggcgcctgtaatccctgctactcggaaagctgaggcaggagaatcacattaacccaggaggcagaggttgcagtgagccgagatcgcaccactgcactccagcctgggcaacaagagtgaaactctatctcaaaagaatatatacatatatgtgtatatatatgtgtgtgtgtatatatatgtgtgtatatatatgtgtatatatgtgtatatatatgtatgtatatatgtatacacacacctttagtgttaacaaaacattatttatatgactctttaaagttgcattcttaaaagattcagcatgataaaactaaggcttctgggaggttaatgatttttggggggctgtaatgttaaaagcagagcaaggaattgagtaaattagaggtgtttacttccttttcagatattaattagaacactctttgagatgatagtaagagtttttcaaaaataagattgttgcagttaagtaagtttgggaaattctgtacttaattacataattttttttttgagacagagtctcgctctgtcatccaggctggagtgagtgcagtagcatgatcttggctcactgcaacctccacctcccggtttcaggcgattctcctgcctcagcctcttgagtagctgtgactacaggcaggtgccgccatacctggctaatttttgtgtttttagtagagacggggtttcaccacgttggccagggttgtcttgaactcctggcctcaagtgatccacctgttcggcctcccaaagtgctgggattacaggcgtgagccaccatgcccggcataaaaactttatattttgtagtaatttttatttagataaaaattatagaaataatacatatattctttatccctgtttcctttaatattaaatcttatatcaccatagtacaatgatcaaaaccatgaaatcaacattggtacagtactattaactacagactttattcagatttcaccagttttttggtcaataaacgtcttctgttcctagatacaatcccaaatcacatttaattgttgagtcatcctactctgcttcaatctgttacagtttcttagtttttgtttgtttgttttttgtctttcacagcgtgacactttgaagagtactgatcaggtgttttgtagactctttctgatttgggggtacggctgatgttttaccatgattagatggaggttgtgcatttttggcaagaatacctcaagttatgtgcccttctcagggtaccatatcaggcaacataatattgatatcttatttttggtgatgttaaccttgatcacttggctgatactagctgccaggtatctgcactgtaaagttactgtttgttcctttgttgataaatattttgcaaagataactttgcaactaggcacctagtattctgtttttcctcaaacttttgcagattaattcagtgttcactcgtgaatcttggctttagtggttactttagcaaaaacattcttgtgttctgttgtccttaatcttttttacattgagattattttatttttacaaggaggagctgtctccttttcttttctttctttcattcattcattttgtttgtttattttttgagacaaagtctcactccgtcgcccaggttggagtgcagtggcacaatctcggctcactgtaacctctgcctcccaggttcaagcgattcttcaccatgcctggctaatttttgtatttttagtagagaaagggtttcaccatgttggtcaggctggtcttgaactcttgacctcaggtgatccgcctgcctcggcctcccaaagtgttgggattacaggtgtgagccaccacacccggccttttattttattttatttttgagagaaggtcttgctctgttgcccaggctggagtgcagtggtggtgatcatggcttgttgcagccttgaccacctggggtcaaatgatcctcccatctcagccccacaagaagctaggactacaggtgtacaacaccacacctggctaatttttatgttttttatagagatggggtctcacagtattgcctcggctagtctcagacacctgtgctcaagtgatcttccctcctttgtcccccaaactattgggtttacaggtatggctttacagatgtgagccagcattcccagcccgtttattcgtttataacagtgtggactcatgggtgctctatgagttatattccagtgttacagtaattgatatgctcaaattgttctatctttggctattagaagttctttcaggttggctcctatgcccttttgatatacctctctccctgaaacccactttgagcgctctttaatttcttgcaacaaaaatgctgaaggcttatcttgtattttctctgctgcaactgtggaattgatcagttctccagggagccctggtttctctcattaggctttattttgtaacactactttccaaaaaaagtgatctatttgatctagcatattgtacattctggattcggatgattgcttcttgtgtcatttaactacttctctccccatgtttctcaaactttgctgcatattagcatcagctggggagatttaggaaattctcatactcaggttttatcccacatcagttaaattagaatctcaggattgaacccaaacatgagtggtttttaaagtttcccaggtttctggtatgcagccaacttgagaaccacagctgtgtttctagctccctcccctttgcctgtagtggtagtaagatctagactagacgcttgaatacattcttgtccaggtttttttgttctttctgttacatcttgtgaagattgaacattggattcagttctctttttggctttagcgctgctccttccatttggtactagtatatttttaaccatgctctcagttcctcacactgacttcttgtacccattttaagggatcaatctgggattctcttcttgctactctatgataatattcattaatgtgctttgttatttttatatgggtggctgcaaaattaccaacacctccctctagacacctttttcagtgcctctcctttgacctacaagggcatcaagcacaacacatctaaaattgagcttgccttccatcaaacctgcttatcttttgttcttttattcattcatttagcacacatttattaactgtctactatggaccagacaatattccaggcaccaaagatgcgaagttgaaaaacagactggcctcaaggagatttttgcttagtatatttccttctgcattactcgtttccttaatggcattggaatctgccttgacagaggcctctttgtgataggccactcttcatttaccacatcctgtctgtttgctgcacttcattgattctttttttttttttttttttttttttgagacggagtctcgctctgtcacccaggctggagtgcagtggcgtgatcttggctcactgcaagctctgactcccgagttcacgccattctcctgccgcagcctcctgagtagctgggactacaggcacccaccaccacgcctggctaattttttgtatttttagtagatacagggtttcaccatgttagccaggatggtctcgatctcctgacctcatgatccacccgcttcggcctcccaaagtgctgggattatgggcgtgagctaccgcgtctggcccttcattgattcttttatgtcattctgaatatttaaaactcagcaaggcaactctacctttgagggagctagtatggtctttagagtaatactaagtataaagtgaattctgaaccaaccacttaggtccgtatgcccctagacaggtgactaaacctcactttctcagcatgcaaaattggaataatgatcaccacctcactgggtggtttgggagattgatgctataacttgctctgcctcttcttgtcctggtgagtagcatggccatctcttcagttgcagcattccaaaacctggataccctcctagaaactccccttcccttatcctgccttctcacatctagtcattcatcaagtcttaccattttttatgtgtgaatatcactcagtggtatttatgtttaatagctttcaggccctcatttgaaattactattattttttgagccagggtcttgctctgtcacccaggctgaaagtacagtgccgcaatcaaggctcactgcagcctttaatgtccgggctcaattgatcctcccaccttagccttctgactagctgggactataggcatgtgccaccatgcctggctgatttttctattttttgcatagatggggtcttgctgtgttgcccagcctggtcctgaactccacctacctcagccttcctaaatgttgggattacaggcgtgagccactgcgcccagcttcaagcccttgttttttgcctcttcaattgtaatggtctcctaattatgagatctttccattagaaagctcctacatatgatctttctaaagcccattcagttttttctctttgatgctttaaacacactctaatggtacctcataaagtccacactccattgcctggcagttgttttcaacatcttgctctgcttttttttttttttaatcttatctcctgttactcttttctaacaacctgtactctgactaggctttcccatttgtgtttcctaggttaactatggtgttcacatctttgcacctttgccgccttttttctctgtactctgcctggcaaacttcttgagtcatgtttcaagggccagttcaattcatacgtcccctgtgatgcctttccagatttgctttaatgtgtcatttgtctctcactgtgccatgtacttattttctgttaaggcatcattgcatttatttcactgcttgcatttgcaaccttcttaatgaaagcagcattcttctactcatttttatcacctcacaacccattacagtacctagcatatggtaaatgcttcttttgtatctgatggaccagtatgtaaaacttcctagaacagtgattggcagaaatgaatgtcagaagatgccttggtcattactcataatgtttgtgaagatatttagcacattgtatttcccagtttttgttaatttcccttgccagaataaagtgtaactccttagtgagctgttcaaaaccctttatgcccccatccatctttctaggctcatgtcttgtcttttctctttcttcacatcgtgtttcccatctaacaagtttctgatctgtatctctgtcctttctttttttctgggaattactgcactagatacccacagttactcatgttcctagtggagccactaagcagaagtaggcagaaccactgctgtaaaaaccctgttttctagttagattggactaattgtgataatgaccttgaactttcaagacaaaaattttccctttttctgtagcacttactttttataatgtactgtaccacttaccatattttattttaggtgttgtatttctgttacctacttagcatataaatcctttgaagcaaatactgtgttgtatttgtctttgaagctccagcacccagaatatgaaatgtgtcttgatatgaatgagtggagtgatatgggttgctcagaagaggtcagtattgtcaaggatatggggatgttttgaatagccatttgagaaggctgctcttggtaaggagaacagtgggagcagtggaaacagtcacagcagccagctgctcccatgtgttgagcacatcttatatttaggcacttgacatgtgttgttaacatgtttaattgtcacagcaacttgatgaggttggtgcagtaattttccatctttaacagatgtagaaactgaggcacagaatggttaagtgatttgcacaatgttgtgcagcttgggactgtagaacttaaggtggttgtcactgctgtgctttactgccttccagtggagctcgaggattgggaacggtgagtagactggcccagttagagcaccatgggggctcagtgtactccagtcttctcaagaaaggactacactctagtgatcttctctctgacagagtccaagatttatgacaatggctaagggcaatactttttaaaactgtaatgtgtatacatgtcacctgaggatcttgttaacatgcagattctaattctataggtctaggatggggcctgagagtctgcatttccaacaagctcctaaggaataagtgctgcttccccgtagactccatgttgcgtggcaagagtttggagggttcagtatgaaatatattttacatgggaccattagattctcatctagaaattataagaggttctgtatctttaattggatacataattatgaagttgcatggtatggagatgctgagactctaggcactaattctttatcctgggtctatattagaatccccctagtagctataaaaactaatgcttaggctgtacttgagatcaataagaatatccagtgaataggtctttatagtaaaagaaaagtctttggccaggtgcagtgtctcatgcctgtaatgagacactttgggaggccaaggcggacggatcacgaggtcaggagatcaagaccatcctggctaacacggtgaaaccctatctctgataaaaataaaattagccgggcgtggtggcgggcgcctgtagtcccagctactcgggaggctgaggcaggagaatggcgtgaacccgggaggcggagcttgcagtgagccaagatcgcgccactgcactccagcctgggcgacagggcaagactctgtctcaaaaaaaaaaaaaaaaaaaaaaaaaacaaaagaaaaagaaaaaagtcttcaagtgattagaatgctctaagcaaatagatttgctgattaaaactctttccgaacttaggctgcttccttgcatgttaccaagtttgatgtctattgaaataaattttgcatcatcaaagttcctgtgcattgaaggtaccttaaaattgccataaagacgtggctagaagttaagcaagtcaggtttatcatcattacagtgatttcattaaggcttatattattggtagtatattgatcacctttcagggaataagaaaaatacaaataatgcttttcctttttttcctcctggggagactgttctgagaattctcattgtacttttttaacccattttctttctctttccaacagggattttttgccaggtggtaggagagattatacagtccaagttcagttgaggtgagtttgaaattttctgttaccttagttttatacttgcttactatgtgcatgtagttctgaattttaaaacatataagaatgtttgagcacactatttaagaatacttttttcttttattaatgcagactttgcctggcagagacaagttgccctcaagaagataactatccaaatagtctatgtataaaagtaaatgggaagctatttcctttgcctgtaagttgctttttattcaccagatttgcatataagtttaatataaacactgacaaggcctagaaacagtgcaacagtgacagctgaataccagtgaacagttttagcatccagattaaatactattttccactagggtaacccatggcttcttggataaataataaatggcttatttcaggtctgaaggagatggaaaacataagcctggaattttttttttttttttttttttttttttaaagagacaaggtcctactgtgttccccaggcttgatttgaatttataggctcaagcaatcctcctacctcagcctcctgagtagtggggaatacagttgtgcaccactgtacctggctagagcctggagcatcttacttaagaaatcaaggatgctgtgaaacactcttgggatcatatcaaacagcatagttgaaggggaggacttgggcactttcatgtataggacagcatgtgtgggatgtctgcattagctgggcctggcctgtggatggcatggggaaaagcagaggctgctgagagtggctaactacagagatcaaaaattcccagcttgggccttgatgatgcattcacttgtggtgggtgggtgcaataatagttggttgacaacacatttaagcagtgagagagtatatgggcttcagcacctaggatgtatacaatgtaaatgcatgcagcctgtctctggcctaatagatggcttttgactcttcaaatcctgatagtcaagtcttaataaaataaaataataaatgtagaactggactatgtattggtttccattttggatacattactaaattggtaccattctgtaagaaggccagcaaagccataatcaaaaaaatagtacaacatggcacgtttgtcaagcactacaaagttggaggtgtatttactgtaactgaatcactaagagagcagtgactccctgactaggcccagttgtcatttcaccagagctgacactcttcgcaactattgaggaaatggggaagctgtgtaatatccctgctgaacacgagactgggctctggactaatatatgagcagtactcacgagtagccaagcaagtcagacaatatgatctaggactctgggctctccagagccaagtgctaagaattgggccccaaagtgaagaaattccatgactgagactgaccctggtcttgtggacagagggatctgacttctcttggttgtcaggagtctcatttgtcgcatacacagcctgtggacttagagacctgagaaatacttgttttgtgaacctttaaagggcttgagcaacactgcatcactgacgtgactctttttgaaagatgcatctgagactgaaatccattgagacagtcctgggagtgaaggggaattgcagaggctgagtaggtatggtcaggggggattgcttacatggcccatacatgtttccccgggtgggacatttagtttgtcaggtttccggctactagcaacaagattctcaggagctatcctttttttcccactcccctcccatccccacccaagatagagtcttgctgtgtcacccaggctggagtgcagtggtgtgatctcggctcactgcaacctctgcctcctgggttcaggcagttctccagcctcagccttctgagtagctgggattacaggtgcctgccaccacacctggctggtttttgtaattttagtagggacagggtttcaccatgtgggcaggctggtctcgaactcctgacctcgtgatccacctgccttggcctcccaaagtgctgggattacaggcgtgagccaccacgcctggcctatcttttatttggctagtttgcacaaagatctgaaccaagggaagaagcagccctacttggagctgaaagataccaatgggtaactgcatgtgtgacaaagaaagcctggcaaaacagattaatacacaaccctgtgcacctgtcccatggccttttcataaccatttttctttgccctagatgtgctaagatttcattttttcctttttttttttatttaaaaaaaaaaaaaggctctcaggtctgttgcccaggctggagtgcattagtgtagtctcggctcactctgcagtcttagcctcctagaggctcaagcgattctcccatctcactctccttagtagctgggactacaggcatgcaccgctatggctggctcatttttgtattttttgtagagacagggcttcgccgtgttgcccaggctggtcttgaactcctgggctcaagtgatccacctatgttggcctcccaaggtgttgggattacaggtgtgagccactgcgtctggctgctaagatttctttgacctttgactctcattgctatttgcccctcccattatctgtgatgaaagataagactatggagggcttcttggtgtctgtggactcaccttgaaggcttatcctgtatcatcgtgtgactgtgccagtgatgggagctgcatctgaaatgtgtgaggttgtgcctaaactctgtggcattgctatggaaaatatggtggctacagatgtgtaaacatagacgttaccagaatttccaaatggaccagtcagtgtcacattttgggatgataccttcctgtaggaggtctacagtaccactgaggatggcttggagtttgttactcttccagttcttttgagggagaagaatttaggcagttgagtacttcctctggggcattgttacttagttactgctgatttctgtcccaaagcacccactaacccctgattacttgtattagactatttgtgaacatattgactactacataaagcagcctttgtctgatgagtctggcatccctggagccaggggcctgcagcagctccatgggcagttgtgaaggaggagaagaaatagagcattgagagaaaggcaaagacatattttcaaaaatagaaggcaatggggaggatttgcctgacccttatagggccatcccaaagaaaatcaaatgcctgcctttcccaaagagtctttttaccctagctccgtaaagtcctatagaacagctgacagaaattcacatgcgcatctgatggaaaacatcttaaaccaccacttgatccacagttgctattgattgggataatgaaatgtggagtctttttaaatataaaacaagattctgcagtttttaagaattacgtgagtatgctgcagcctcagaagaagaaagctgctgtggccctataggagttatagtgagctcttgccaccatggagagcctcagggactttgttccagttttaagaagcatcaacaagccacaaaagaaatttgataggtggtccttgcccgtgatcctggtgtattgaaccatgaatcctggagggaaaagcttgacacagtcatgaattgcccattagagctctgaatatggtggcatttgtctgtgtcctggaagaagtccttatgtgtatgatcttactgtaatacccagtctttatggacccatggcagttgaccactatacttcatgtacaaagtaaacataggaatgggaaatggtattactttgaaaatggcaacgtgtccctagactgttaaggatcaaatagtgatgcaagcagcatatgtgctttttaacctacatcaagatgctgagttttacaaaacaccttcatgcattcattttccaggttcccttggtgcaaggaagacagcagctcatagtagggcttgtgggatggtgacatgcagtgtggacagacaagaacctgctgcagagaccatctcccatctttgactccaagggctgccagtgtacagactgacagccagatgagaacattccatgtttttaatgggcagaagaaagaaaaaggccctctttgtttagggagttattttaagaagctggattatttttcttctaaacaatttgtgagaaatatctataaatcttgtgtagctctaaggttgaagaaaggaagaagggttgacaagaatatttcttttaaagatcccaaagagtagagaggatatgtgctgtaattcagctggcagcaatctccaagtagttcctttggtgcagccagaagacttagcagtactggcccccttctccttataaattgtatttctgagttcatggatttatgttccctgatgttgtgtgttagttaccctgatggcctgtctcatagtaaatcaggactgacataaactcaacatttcttcttttaaaacacataattgtgtgcacactcaccccaatttgaagaggcacctccttacctgagaagggataattttgacatctgaaagaataatgattatagtagactcaaaactatcaaatatgtaagtgtgcttataataattatactaaagccactggaggttgcactaactcactgctgctccgaagattgatgaaggaagagaatcatttatttcaaggtgaccagctgttgatgtggtcaagctctttatggaaacatttcggctaatacaatcaaaagggtaatagaattagaaaatcattattccacaattcataatcatataatgggtctaggtagctatcatcaatggatgccgaagcttgacggggaacttcatggtagaggaatcaggctgacatcccctgaactcctgatcaatcttgacaccactgaaaacagggcaaaccaccttctgtgccttatgatgtagcaccatatgaagtatgcaacattttctgtgaagttttttgtttctaaaatttttaccccaagtttaatcaagcttatacaactaatgactggctttaaaaatatatgggaggtagagcaacaaaccttatacttcgaggaagcaatatacctaatctagaatgcgaagtcattcttcaggtcaaaagtcctggtttctccagtagaacaacagcattggggaaaaagtgtgtgtgtttggagatggcaggggttatgtttatagaataaaggagacttcagagacctaactaagtgcggtgtggggctctagttttgaattctgattcaagctgtaaaaggacatctatactaaactacatctggagaaaatagaaaatgtatctgagatttgctttaaaataatctagagtgggagttgggtagagtaggtaaagattgttcatgggtaagtacattactgaactggtagatatatacatattatacttttttctctatttttgtatatgtttaaaattttcaacaataaaaggataacaggaaaagaaattttgaggcacctgggagatctgaatcgaaagacaaggtgttaggtgattttttaaaattgtgattatttttgtggggttgtaatgctgtgggtttttaaagtcttattagagatgcatgttaaatatctgggttaaatggcatgtctagaatttgagtttaaataaggacaaaaagaaatgtgtatttttgtggtgtgtgtgttttagggcagactggctttggggccaaaagcatttgaaacaagaatggcaacatgttgataattattgaacctggttggtgggtccctgctatttgttcctttcttgtgtatgtttgaaatttccgtaatttaaagttaaaaagtaaatctttgttagaagtattcaagtagtagtggtaattagaaaatttggaggaaaatgttaaagtacaataattgtggacaacttttgtcacagttgcaagtagggtagggtgtcatcagagcatgaaacataaaaaattctttgagtgtgtcacagtactaccacaaagtgttccgctggtgctgtccagtggcctttgcttagaaagctcgcatatttgccccactggttccctgtcacatgaacttgactttatttttgctttaaatatggaaaattgttagaaatatgtgtgaaggctaaactttatattttataaaattccaactattaatatattatcaataaccaggaaattgatggttgggtaggggtggtgctgatggttacaggtagaatacaagttatcagataactcagaattaccagtaaagtcacactactcaaatgggatacagaatagattgaaaacactttatgctgagtgagactaaaatgattctgagtttgctgacacttcattcttacatgagtgttactctccctgcttctgttgcccttttctactgtgtcagacagtgttatgtcttaaattctaatttccagagtgcacattttagttcatgagttatttctatccttctgacagaccctgtaacattatttttatttggttaacctaccagtggacataccagcagacagaattatcttccaggcccaaaacaggcaaaacaaaagttttgttcaaaattacctagatactggtgttgatactccttgtgcttgatgctcattgaatcagctccttgagtctttatgagaggacttttcttaggagttgtttttttttttctgagcaactttttttttttttcacttgagcaacttaagatgggcataaccttcctactctctctctctcacacacacacacacacacacactgtctctctctttcatttccatattataatgcaagttattgaagttcttctctttgtcttttattcccctgctcaaacgtttttaatgattttcagaattttgttgcaagttatagattacacattatcatgtggactaccatttaataattactgtcttgcctcttatgagacagtgaagggtgttcccaagttgtggtagacagggtgtgttcctctttgcttgtgatactaccagtactagttttcattggtcctaaggtgcatattttagcattgccgaaatccagaagtgtcttaaaattgctggtgaccaggtgtcagctgtgacgtattatcattgcctgcacctgtgcaactttgatgttattggcatggcgtgactggttagctgtactccctggcttttcagttaataaataatttaaggacattttgagaaagaagcatgaatcctggctgttgtctgaaaacttttcattgatggattctcataagatccagattgtatccccattaacacatccagttaatggtgtcagtgacttgcagagaaatctgagacattagtggaatgaaatacagttttaaaagatacttttctctctaaaattcctgcttgcacataggagagtgtcatgtggaaaaatgtatgcattaatgactgagtgaaaagtgattcagaagtttcttctgtacaaaagggaatatgttaattcattttgcttccatttctttgccatatatacatagtattttctctttctcaatagtacataattaaattacatcactgacatcctagcatcagtgaaatatggtatctacttttcaatatgtagattttttgcagctaagacattttaattttctaaaaaatatattattttggctctgaaaaatcagagtgaagtcttgcggtaattgggaattggatatactgcgaatcagaaatgagtatacttgctatttaaaacgaacagttggccgggcactgtggctcacgcctgtaatcccagcactttggaaggccgaggcaggctgatcacgaggtcaggagatcaagaccatcctggctaacatggtgaaaccctgtctctactaaaaatacaaaaaaattagccggatgttgtggcaggcgcctgtagtcccagttactcaggaggctgagacaggagactggcgtgaacccgagaggcggagcttgcagtgagccaagttcgcgccactgtactccagcctgggcgacagagccagactccgtctcaaaaaaaaaaaaaaaaatacggttgatgactacataaaagtagattaaagcataaatagcagtattttgatagccatcaggctcatttaatgacaactgaaatgttgattatccttatttgttaacttaacctggtttaaaagattaccatttctgttccacccagagaaaaggcagtggaaaatatttttatcactcaccagattttaaaaatgaaattcattagtttgttctttctttcccctcacttcccagtttggtttttttctttcccacctccaatatgtgcatgtattttgaatggggactgctaaggatgaatcgttataaaaagttgtgactttatctgtaaagcttggtgtcctatgaaaaaggaaaaccattcatagccaatgtggcaagatgtcagcatctttaattttaatgttggaacatggatttttttcctacctttctggacttgtgaaatattttgtaaccttttttcaaaggttattttcctattttgggttgataatgatcataagggctatatgatttttaggctaaaataaaaatagtgtaactgaaattgggcaggatcctgtatctatcttggagaaaatgtttaatcttcctgcagatgatttgaaataatttttctttcttacggttatagggctatgcaccaccgcctaaaaatgggattgaacagaagcgccctggacgccccttgaatattacatctttagttaggttatcttcagctgtgccaaaccaaatttccatttcttgggcatcagaaattgggaaggtaaaagctctccgttttgggtagcaggacagtgaccccactgagggttgactttctgtgttttttcttaagctgttggcttcagctctttctgtttttggattgtaatctctaaaaagcagtaattttcagtttagaggtggcagtgtggagattcttaaagttaaaaactttaactctgagctttcctgaatatcatctctttattttcctggaaaggaaatatgcatatttatatttcttaaggtaatggtttaaccacaattgtatgtatgtttgtgtttagtattttaataaactagaagctttggatgataaatatttatgaagaggaacaaagaaagttttatccgtttgggggagaaatggttaaatgtacacatgttgtgattagaaataatctgttctagcctttctataaacaactgatatttcagataacctgtaagcatttgtataaaaatatttacttagaattataatattttctctataccttcaagttgatgaacttgactttctgttgatttttggtcttataataaattatgtcaattttgagataccagttaatacaacaaggaatttacattttagaattacttgtttatataactgaaataatgaatggaaaggagatttcagttaatttctgaccatcagcttcagtgttaatattacatgaagcatcagtttcagtgttcttattacatgttcctaaacagaataatattcctgttttatggatggagaaattgaggcattatttatagcaggaattttttgttttaccaccaaggtaattgcagagctgggagtaactttacagacattggaataaatgattgtagacattgaaaacttttgccatgtaatggggataatactcttccttataattaaaatgattaattgacctagaatttacaccataagttgggtatttagatatctaaaagaacattaaaaaatatttaaaatacttggtttggcagctattaaaagtatgatgtttattgtagaatcaattgaatgaatatatttaataaaatgggaagataggttttttttttttaacatttatgtgaaattatattttgtctgttcatagctctataaatagctaatgaaggttcctttgtgccagatctaacaggtatgggattggacgctgttgttttctggcttgactttttaatttttatcattcttcatgtgtcttacatactatagtagctgctgcttgtcaataaaatacccatttggggtacaggagttaatttatcaaagctttcctcagaagaaagctgatacctggttcatttgcgtgatttactcaaaggccatgtagtagcaggtggtttcttctgccagaattagaactttggaactctggatttgcagtgttaattcagaccactggcctttggaatttgtttctgcagtggaattcctcttttaagtgaaaatatgagaacctcattacataaagtcgataaaagcagaatgattttggttagcaagattctggttagtcataggagggtacattttcagggtggcccctaaggtaccagttttgctaaataagaaccatagtttggaaaccattgatctaacctatattcccataccagcgaatgttttaaagtgataaatgatcaagaaatacctttaaaatgattgagcttttattttcagtgaagtagcttggtgaattttgtccccttcgcagtgattgaccattccatggaagttattttgaatgttatttttagaaaccagagtttcttaaataagtatttcatgtaaacaaagagaatattatctctcatctttaatgcaggttttttttgtttgtttgtagaattactctatgtctgtatatcttgtacggcagcttacatcagccatgttattacagagattaaaaatgaaaggtattagaaaccctgatcattccagagcactaagtaagtaatgtttaataagaccaagcatttaaaaaaaaaaaaaaagattgagcatatgagatactttaatgctttaaatattgctcacatcaatatattagtatatatttgttagcttgtgtatatactaatttatatacattactggtgagtaaaattgtagacacattaccacatagtagtttttaattatcaaaggaagtataaatatttttatcttttctgtttacaaatttaataattgttggaaacaaacaatagtgcataataaaaactgtgatgaatgtgtgttggaaaagctttgacgctcagggtactgctgcattccagcttcctctcctaattgttgttttgttcttaagtcttacatagctttctattttgaaagtcttgcttgccagcagttttacttttaaaaagaaattttaagaatttaaacaaagaaatttgcatgttcataattctttaacttatattgggagtgtgatcgtgttgtcaatacattaatatgtaacattttgttttaagatgctatatatttctataattccatttctttgtcacccttaatttttttaaatttttttttttctcttctttttaaagttaaagaaaaacttactgcagatcctgatagtgaaattgctacaactagccttcgggtatccttgatgtgccctgtaagtaaagcaacaaaacattttggggaatttgactttttataaatgattaactttcctataaaagtaagtgtgggaatgaatgatatattatgaagaatgctgaacttttgtcttttcccattaaggaatcttcatgattaagtcacaattctttgtattatttgggcatgcaaagaatacaaagaagagggaagatagctttaggctcagaataatctgttgtaattaatgttgtagataatatacagctagtaataaaaatatattaagagctgactccttttatcagaatataaatgatactgaaaaatagcaataaagtgactagggcctgataaatgctaattgatggtcttagtttagtgagttaggatgtgtaggatgtctttgtaatgttcttttaaattgcacaataatttttcttttatatctccttacatagaaagtatgagggagaaatcagtcagcaactctcacatcctcctgtgtacttgccactgagctaattgtgggagaaaatattgaggcttgcttagaatgttaataattgagtttgaaaaataaaaccaactcccataaaaatggtgcagacttcacttacagttaggctgttttactaccaagaggagatgggagggtcaggagcagtgaatgaattggaggggaaccctttccggttaagaagaacttaatgagaaaaagtcatggaatcaggaatttataatgtagttttgtgggtatttgatgactacccaccattttgagaaatgtgcagttttttaaatggggagaaattgtgtcagaaaagagaatgatttgttgagtctctactgtatgttcttttatttaactgtcttagcaaacctgtgtggaggagttgtcttcattttgtagatgaagaaactgagactgaatgaggttggctaacccaaattacacagttattggtagaacaaggataaagattgtagtgttctgatattcctgttctttttccaatataccatgctgccagattgggctgaaatatacatgtcctgattacaagtacatctcttttattctggaaagtggtatttgcagatctttttttgaagtgtcactcttttaatcttcattaacttaaaaacatgaatttgcctttattgaaatataattttttgatatgaggattgcttggatactgggaacctgctcttagcaaacgcagggaagaggtgtgcagttccagtagggtaagacctgaaagccctgagggtgttggcagaggttctaggaggcatgcggaaggacacacgacttcctctgagtgcaggctctatgcaaaccttcaggcatgagttcttttcagtatcttcaggttattatacttttcttcgctctcatgttaaaatcaaaattgatagtagattgaaacaagtgaaattgcctttttgttggttaaaaaacagttggatattgacgattttttattatgtatccctagtatattcagcaaacattaattgccagctctattccacatacagtcaccatatggggaggaaactcgtgtcaccattatgttttagatgtcaaactattgtatcaggaagaaagtctacacaacttacctaaggagttttacagttgtgcagtgccattttcttagaatcttttaaattttttttcttcatacagtttgccattctacatgagagcaaccaaaacaaaatacaatggccaaacatactaacagattctcaggctttttaaatttttttttttttttttgcattcataacatatccttttttttttttttaatttattttaaattttttttgagacagggtctctctctgttgcccatgctggaatgcagtagcatgaacacagctcactgcagcttcaacctcctgggttcaagtgatcttcccatctcagcctcctgagtagcagggactaccgccacacgccaccacacctggctaattttggtgtcttttgtagagatctttcgccatgttgcccaggctgatctcaaacttctgacctcaagtgatctgcccatcttggcctcccaaaataatgggattacaggcatgagccatctcacctagccaaactttcaataatagtgaaagtagtgtatcagagaggttaggattccttctatgtaagaatagggagcagttccttccaaacattaccaatttttaagaaaattaacttttcagttacttgaagaaatgaagtaacagatcaaataggtttttgaaatcttgttttaagtttctgaaatgtttttttctctctgctcagaagtgacaacaggtctattcgtgagactgtcttttgagcttttcctgggggttcatcaatcttttcagagcactttctaagaaaagaatgaatgctactctttgggctatagtagtagtgttaacataaagttgggtagctaaactgtaatatgtggtatatattaattagaataccagacacaggtgttttgattagatttggtggatggatgacagaagttagatgatgaaagcagtgtttgagaaagagtaagtcctattatcagttggagaaagcagaatggagtccagccagctaacaatggaaataacatgggatctggtgcagtaatgggaaacggagaaggaaaaaaataaatcccaggcacttaaataagaagtgaaccctgggttatttggcaaaaacaagagaaaatgatagtgtagggtgatagaataaatgtttattacatttcacagtattttcgtaaagtgatttgcagtggacgtgagtctgaaaagtgggagcaaattctaaaacctctgtccttgggactaaaggaaggtaatgtcacagtagttactgaagaggatctaattgagtgtgcataattatatttctgaacaccatatctgaattttacataggagtttcactttggtgatttcagctagtgattttcagtctgtcctgcagaggtggactgggtagctgggggagagaaaaagaaagaaagaaagctaggtttgattttatctcttgagattctagtatgtttaaaaaaaaaaaaaaagtcctgctgaaaagagttggaaaccaccattttgggccttttcaacttaaaaactctcttaatttagattggtagtaattagtctacagtgaatagaatttggataatgccagcttaacattttataggaaaaaagtgttgcattacttagataaccattcataaaaataataaatttcaaaaaagcatcatcatctgattaaattagaattagaatttattttggtggcacattcaggtcctttttaataacatgccatagtcactaggcaattgataaaattttgctagctggtaacaaattccttcttaggaaatgctcattagttcttataagaccactagagtagaattaaatttagggtcagcaacttttatagtcctggatattctcgtttctgtatgctgtggaaattttaaggctgtgacaggagagatggaaacagcatagaagaaaacgacaaaaacaatccctaaacagcagtttgcaaaatgtggcccatggatacctgaaggtccctgacactctttgaaaagaactacaaagttaaaactttttataataatatggacacacaattttggcattttgtgttctttttctcttaggagcataaagtgatgtttaacgtgggttacccaatagatgatgatgatgtcattgctctgatggctaatggaatgtgtgcttgtgtactcttgtcttttaaaaatatgttttaatttctaatatacaaatattgataactatagcccacatacataaaatgtctttgaggtcttaattttttttttctttttctttctttttgagatagagtcttgctctgtcatccaggctgaagtgcagtggcacgatctcagctcactgcaacttccgcctccttggtttaagcaattctcctgcctcagcctcccaagtagttgggattacaggcacctgccatcatgctcggctaatttttatattcttagtagagacggggtttcaccatgttggtcaggctggtctcgagcttttgacctcgtgattcccccgcctcggcttcccaaaatgctgggattacacgtgtgagccactgtgcccggcctttttttttttttttttgacagagttttgctcttgtcgcccaggctggagtgcagtggtatgatctcggcttactgcaacctctgcctcccaggttcaagtgattctcctgcctcagtctcccgagtagctgggattacaggtgcccaccaccacacccagctaatttttgtatttttagtagagattgggtttcaccatgttggctgggctggtgtcgaactcctgacctcaggtgatccaccctcctcggcctcccaaagtgctgggagccaccgtgcctggcctaggtcttaatctttaagagtttaaaggggttttgaaaccaaatgagaactgataactgtaaaaaccgtggtaggctgagttagaacgttattttaaagaaaaaattataaaaattgacaaataggtacttatagattattcaaatagaaccaaaaagtaaaaatgatcattttaaattcacaaggtctgttattcagaagtaacattactagtagcatgatagatttttccagatttaattctctatataattatatgtatgtttattggaaagtatatatactgtcctatggcttgctgttttttaattaacagtgtatcttaagtatattagtatgtgtagattggtcttattttaatcattgtgggcattttgttgaataggtatagtgtaatttaataataagtttagtgattgagttgtttccacacagtgattgtgtaaaaaagccaactcacttacattggtggaaaatttctaaataaccagccaatatttatgttggtactacttaaaaagaataacatgtgatttttaaaaaggataatatgaaaatctattaaaattattcattttataattgaaaggatataaaaaaccggttatctcattgggtgctgaataggtatttagtcaacgttcatttttaatagaacaaaaacttagcaaaggaggaaaaggtgggtaattaaattaaaaaactaacaccatttgtaatgttataaaactggcatgtctctgggatgtgaggaccatttggatttgtgatatagctccatcagctgtgtctcagtgagtgtgtggttttaacctcttgtagcctcagcatcttcatttcagaaatagaaatgtagataccagcttttctggagtcatagagttatgaagattttatgagatttatataaaagccttgggcatactgtaagattctgtttaagaaataatttgtttttaaaggcaggaaaaatatagaaagatgtatcataagaagagaagctgccccaggttttattctgacctttttctgttctaagtgatgagttatatcgtgccacataccttgatcgaatcacagtaatttcgaggctcccttttagaactctggttagacacttagatagaggcagtatagcagtgagagagtggactctgcagggctggagcttcccaggtcagacctgctctgccattttctaactttgtaacgttaggttacttagcttctttgtgccttagtttccttatttataacatggggatggtaataataccatccttttagtataattgttatgtaattgtgaaagtgtttttgagagtaatgtgaagtagtagtcaacactgtaccttgcacgtaggtagaactatataaacgttacttctgtgttgatgattcagctaaattattttctttttaaattaccacattaccaggtgttcattttagaggaattagaaattacagatgaaccaaaagaaaaagaacatcctaaaaagcctgcctcccaggcagagctaagaatgttttaattttgccatgaattctttcaaactttatagcataaaaataggtccgtcttcttcgtttcctgtttgttcttttccccatttccagtccatgtccattcattctcctatctggtcaacaaatactgagcacatactgtcagctagtattgtgctaggacagtaggattcagtggtgagcagagatctagaccgtctttttggagcataagatctagtgggagaaacaaattttcaatcaaaatagcaggactggttataaacagtgatattttctgtaaaggaaatatatggggaggtttgaaggattatgtaggaaaacctggtctgatcaaatctgagtgttgtgtacgtcttggtgccagtggaccactactagttggaataagaatttaacagcactaaagttaatcaaaagtatgttgaaaaattgacacagttgattatataaaaacaaattttcataaatgaaaaatatatttgcagttcatattacacacgatttcttatataaagagtgcctataaataacataaatgaaaaatatatttgcagttcatgttacacacgtgatttcttatataaagagtgcctataaatagataacaaaagattaataaccaaatgggaaatgagaaaaggttataggtagaaagttcttagaaacacaagtgactcttagaagtaaaagaagaggctcaactaccacttaaaataagaggaatgtagttcacaactgtaatgggatatttgtcaccttccagattggcagagaccgaagaatttaataacattatattgaaaaggttgagtggaacaaagcatgttaatacacatgtatgcataacccaataggtactttttgtggaagatagtgtgttaatgtgacaaaaattacaaatgtacttttctttccatccaaaagttatacttctaggaattataaatattataaatataaaaatcttagaaatattcattacagcattgtttgtagtgataaaagattgggaacaatttaaatgtcagtcattagtgtactgattaaataaattatgataccttcatataatggtagctttttatataccgatttgtgtgcagtagtcaccaagttatatgacagaagtgagttggaaaacagtgtgtattgtatactatcattcctgggaaaatatttctttaaatacacacttggtttatgcttagaacatctgtgaaaggacatgcaagagatggataacagtggttctctaaatagggaaactggggaccaggtaagaaggagtcatactttcaatgtatatgaatctggatttacatgttaacccgttttgaaaaagtgaaatggtttttcaaaaatcatagggcagtcaatgaataaaaatatattgtaatcttcttgggaatacattctgatttggatttctatttcatttttatcatcttcttgtatgacatcttccgacttttacaactgaccatgttccctctgagctcattctcctttctgaaatagttttccttgtgtttcctgtcctgtagttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggtaagtatatcccttttaacagctgatatggactaatacaacagctgttggcaatgcctttgttcactacaacttactgaactaaattctaaataaattctactctagcataaatccagatgtttgtatgttttccgtcttatacctaattatactcaatcttattttttaaactgtggttagtggcatttttatctctataatatgatttgcgttgagggcaatgtttttgctttccaagattatattttataaagcccacaggaaagagggaaaagtttgctttgtgatgtcattttgcttacctagaatttcttgaagtagcaattagggtctatgcaaaaaccagaggaagtgatagggtagatacagacatagctcttaagttcaaaactggaattcatgcccaggtatttctgactctggagtccaaactttaagcatcatctctcatattatattgcatgtcagaatttggaaaatgacatgaactaatttttagtatcttgtttcaaataatacttttttaaaaattgcacgtcatccatgtaccatgtaagatttggaaaatacagttactgaaaagatgaaaataaaattagcagtaccatcctatggtgatgactttgttattgacattaaaaaagactgaaatgatactttatgtaatgatttatattaatatatacatatgatttttactcaatatatagtgaaaagtatcctagagttttaaagatacttgtacaacttgaaaatgttttaagccaggcactgtggtacatgcctgtagtcctagctacacaggaacgtgaggtgggaggatcacttgagcccaggaattcaaggtgagcttgggcaacatagtgagttgcatctctaaaataaacaacaaaagttttacaagagtattatctgtggagaggaatggggaatgaagagtgaatgggactttaatgttcctttctgaactttcctttgctgaatttttatttttagcttattttgaaaaaattttaaacctacagaggagttggaacactagcacaaagaacctcccatgtaactatgacccagatgcttcagttgttaacattctatcacagttgttttatcactttctcccttaatatgtgtgcatatacacatttttggtgtgtgcatttgtgaatgtagagagagatgattattaccatttttagaattcttttgaaccatttgagagttacatatgtcatgcccctttgcacattaatattttgtgatgtgtttactaaattcttgatattccatatttgtttctactttttcaatttaaaattgccctgtgatgttagcatttttgaaggtggcattttgtgtatgtctgtggagttttcttcaagttcttagaaatagaaatactcaaagggaatgtaagacttttactatttattattaagatgcctcccaggaggagtaagctatttttcccttctagtaaatcatttcactctcatgccaacaggcataacatcgtccacttctcagccctcttagcagccttacgtattaaaacttactttaaaaatgtctactcttgggtgtggtggctcacacctgtcatcccagcactttggaaggccaaggcaggatgattgtctgagaccaggagtttgaggccgcagtgagcaatggtcatgccattgcactccaacctgggtgatggagaaagactctgtttcaaaagtaaacaaaacaaaatggaacaacaaataaaaatgtctactaatttcctaattgaaaagatagctattttgatttttaatttttgtattataggagttatcagatatttctttaattccatatattggtcattataatatcttttacaaattgcctcttaatattccttttttaaaaaagattttgctatgggcttgctcatctttttcttactggcctatacatagtcattatagattgaggatattaatttctctgtccacatgtgccaaatgtattttcccagtttcccttttatttgtatttattgtgacctttgttctccattcagaaggtttacatttttttttatcaagtcttgtcttttcctttttgaatgtcttccttgaaagtgtttagaaagttgtagagattttatatgagcacttgcttgttttcatcaggcacatttgtgattcctttttccagttgtgcagttgttccgtcatacattgcttcatgaattcattcaacacagtacttactaaatacctatcatgtgtcagatactaggtctaaaaatggtgagcagggcacttctagtatgggagatggtaaaaaaaaaaaagtatattaagtgtaaagtgctgtgaaggtaaggaatgacactgtgggaggaaaattggggatgaggaaggaactttacagtagggaataggtgatcccattaaggtagggatcatgtcaccctagcacccagattattctcaaccacatttacttgaataatctctcccacagatctgagatactacttgcattatctaatacatttcttgtaaatactagtgttaacttctgaactgctatttgttccattgatcaaagtattactgggccaatacgaaactattttaattattagatttctattatgtggtagtatttcttaggccatttcttttcagaatttttttgactagtgtcataatacattctgccatgttcacttgaataaaagcattctcaaattacacagaacctttttgggttttgatttacattatgctgaattttcagtataattgagaaaaataaacctcttatgaagtaggcatttttggcataagaactactcatgtaaaatgtacaatttgataaattttgacttattatatacctatgaaatcattatcccagtcaagataatgaacacacccatcacacctaaagttttctcatgtatgttttcaatctctccctctcagtcctcaagcaaacactgatatgctttctgtttctatagattagtttggattttctagacttttatatgaatggaatcataaactatgtgcttcctttgtctaacttcttttactcaacatacttgtttgagatacatttatgttgcatataccaatagttcatttttattgctgagttgcattctaacccacagtttgtcatttcatgcgttgatgggttttttctgttttggggctgttggaaatacagctactgtgaacattcatgcccaagtctttgtgtggactgttttcatttatcttgggtaaatacttaggagtagaatgcctggtcacatgccaggtgtgtgcttaactgcaagaaactgtcaaactgttttccaaagcggttgtactattttatatttccaccagcagtatatggagagttttgattgctcctcattctcattaacatttggtatggcttctctttttttttttttttttggagacagaggcttgctctgttgcccaggctggagtgcaatggcaccatcttggctcactgcagcccccaccccccaggttcaagtgattctcctgcctcagcctccccagtagctgggattacaggcacccaccaccacgcttggctaattttttgtgtctttagtagagatggggtttcgccatagtggccaggctggtctccaactcctgacctcaggtgatccacccacctcagcctcccaaagtgctgggattacaggcatgagtcaccacatccggccagttaatctttttaattttagatcatactagtggtatatagtggtactccattgtgggtttatttgcattttccttattactaattgttttgagcatctttttgcgtatttattctccatctgtacgtttctttggtgaagtgaccaaacttttgcccacttttttttgtttgtttgtttgtttgtttgttttgagatggagtttcgctctgtcgcccaggctggagtgcagtggcatgatctcagctcagcgcaaccttccacctcctgggttcaagcaattctcctgcctcagcctcccaagtagctgggactacaggtgtgcgccaccacgcctggctaatttttgtatttttagtagagacagggtttcaccatgttggtcaggctggtctcgaactcccgacctcgtgatccacccgcctcagcatcccaaagtgctgggattacaggcatgagccaccgtgcctggccttttgcccactttttagttgggttttgttttcatgtcattgaatgttggtggttcttatgtattctggatacaaacgtcttaccaggtatatgatttttaaatgttttctatcattttatcttttcagtcttttaacagtgtatgtcaaaaagcagaagtgtctactttgaatgaaggctggtttaccaagtttttcttttatgaaagattgtgcttttggtattattttaagacattttccctaactcaaggtcacaaatattttttctgagcttcctgtagaagttttataatttacttttacacttaggtttattatttctatcaagttaatttttatgtatggtgtaagataaagaacaagggttttgtttttgtttggtatatggccatgtgattgctgcaccatcatttgttaagatttgtttttcctcattgaattgcttttgcaccttttacaaaaattaattgactatatgtgtgatctctgaactgttctattgatttatttgtctgtagttatgtcaatactgcatttgctggaagtcaggtagtgtgactcttccaactttgttcttctttttcaaaattatcttggctattgtagattctttgcattttcatacagattttggaatcagcttgtcaattaggggaaaaaacctgctgggattttgatttgtttttcattgactctgtagataagtctgtggtgacataagagtattgagtcttctgatttatgaacaggatgtatctttctgtttatttgtctcaacagtgttttgtagttttcaatgtgtcttgtacatctcttgtcaagtttattcctaaatatttcatatctctgtggtatttaaaaaatttttgtgattatggctaatatatagaaatatagttgacctttgtatattgctgtcatatcaacatatgttattcccatcccttagtagttctagtagctttattatagattacataggattttctatatagtcagtaatgttttttaaatagagacagttttacttcttctttctaacgtggatgccttttgttttcccaccgccttgcattgactagtctggtaatacggtgaattatgttgattgacttttggatattaaactaatcttgtattgtgggaatgaaccccatttggtcatgatttgttatcctgtgtatatttgttgttggatttgttttgcagagttcatgggggaatgttgggtatttagttttgttgcaatgcctgcctggttttattatcagagtaatgctgaccttgtacaatgagttggaagtagtggtattatttctcctcaaatatttggtagaattccctagagaagacattgggcctaggattttctttgtggcaaagtttttaactacagatccaacttatttaatagacatagggcttcttagattatctgtttcttttggagtgagtgtaaataagtttgactagaaactgatttttctgtttttctttttttctatttgtttgttttgttctttgttatttctcttttcttgcttttactataatttgcttttttttctagtttcataaagttactgatttgagactttatttctaattagggaagattaatgctataaattttcctttaaatactacttcagtgtttaaataatacagtccacaaattttattacatttttattttcattcagtttaaaatcttatttttatctttgactcatgtttcttttgtttagtttccaagttttcaggtttttctggtacggacttaatttgaacttaattcaaatacacttattttaaatttattgagacttcttttatttcccttttcttccctccttcccctaccccattatccttttttctcgaagttaaagtttataaattattttactatatagtaacctttatctgctgatgtttgttttttgtgctgtgttagaggttgttcttactgccagcctcagctaggaggctccaggtatctacttctctctagccatttatactcattgagttacacaggtgatgctcagtaagttacttaactattatgttgcctgttacagatttaaaacataggacaaagggagtgtaataattgttgtaaagtataaagtattgcaataccaaaagaaaagggggtcagctaacattacttatgttttcaaggtaatgtgtattactttcttatttcacctttaggcaaagctgttgatcacatgtatgtacttcttaattgttttttaggctttttatggaaattctcaatgactgttctgatgtagatgagatcaaattccaagaagatggttcttggtgtccaatgagaccgaagaaagaagctatgaaagtatccagccaaccgtgtacaaaaatagaaagtatgtgtagaatagcagcagagagtaaagcagtgagactcgtgcaacattatcattaatcttggcccctagaactatacgtttggaattcagcttgttgactcagtcttttgatgatatatagttttcccccaaatgatttttattctttcctgaaggaatgtgctaaagtttataccatcttatcagctatttcatagtatatttttcctgtgtagaataaaggaaacattcatctaaaatcattttaaaatatgatgtttgttacaaaacaaaaagtcacaaatgaatttatatggacagtttttcagaattgttcttagagtatctgtaggtggaaccctaggtggaggtgaggttagagaggctgcatcattggttaatggccttggtggtttggggatggtcacaggttagttgctcagaaagtaaacaaattgttaccttccatttctttgtggagaagaattttaacattgccttgattacctagaatgtatactcatccatcaactgcctgcatccatccacactaagtagggaaactgagggcatttggagtaattgaaacgcacaggtgaacttagagtttctttttatctaacagtctcattgaaacccacacgtgaacttagagtttctttttatctaacagtctactcactgcatttcagttttgttctgattacatttgaagttctaacaaacaatgtaatgaatggagtaagaagaaaggggaaaaaataaaggatttatgccattattaattattcctctgcgattgacactaaacctgagtgcagtgaccaaggtttctctcatctttcagaaaaatggggagtgatttagttgataagtttctgttgcttttccattatcaactgtcattcatttttaactaaatacattacagataataacatacttttctgtgaaaatgtgagttaacaaatatggtatgtgagactgtctttgtgggtagaaagaacctacgtgattagcagataattcataagaaaagtttaaatgtcttagtaacttaattgagaggtttgggtttttttcaacttatcaagatgaaagtttttatcaagttctggcttatggtgaaaagtctgtactttctttgatataagcataattgctagaatggaaatatctggttctgagctaactgtgccacatgtgtgcgagaatacatagctgttgaactcacccattcttgtcccatgacctgagaccagttccctaactctgcgtgtctttctgtaaaacgactgctgacctgcagagacaggatgagcagtaggagctgcacaaatccttcagtggtattggaggcataactaagaacattctgtctgaatgagacttctaaccatctgtcaaggaatagtgctcacctgtctccctaggtgaacaaccattttacagacagaggtctggagttagggagttggtatttgtccatgggttggagtatgtggcttcactggctatatgttgtcaggaacatactatactgaatatactagactctaccactagagtttatttgtgttatacctttaatttttttttccttttgtttctttacatgcaggttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaagggtttgttaatttatagttcactattgttcattacccttgcaactaattgctcttggatagatttataaatgtctctttgggaaatggcataactgtagaaggctattttaatttgcctttgttgagttgaaatattttcgagtaagcacattgtttataggaagcaaattttgatggagaaaatatttacatctttggaaagtgagcgtgtgaggtatttatttcctacctgagactttttgttattttcttgaacctgtttgtaaggaaatttggcatctcagaccagatgagaaagtctggtgtaatggagtgtggaactgggaatctgacaagtatggattccaattttggcacaccatcgcttacttgttctgtgatcttagatgaaatacttaatttgattgagcctcttttttgtgttctgttaaatggagctaaataacgcctatattacaggatcattttcaggttttaatgagatgaaagaaagcctcggtgtcaggcatgtggtaatttcccaataaaaattgattcctttcccttttcaccctctccagggcaaaatataggtgggtaggatggcattctacctgaattttagcgtggattctctgtaagttatctggcagaaggcattactgacctgcattaaaaatcaggtttgggtatttaacaatagttgctttttcagagaggttttgaaccataaaaggagataacaggagagttctcctggctgtctacgaacacattctttcaaacttgggtttgctagtgtcatctttttggcctcttggtccacttggttttctaatggctttactgagttataatttacatagcataaaatgtacccatcttaagtatataatggcacaattcagtgattttagtaaatacatagagctgtgcaatcatcaccatgattcagtagtagaatattttcaacacccaaaaaactttcttcatgttcttttgtagtttattcctatttacaccccaaatctaggcaatcgtttttttgtgtctataatgcctgtttagacattttatataaaatgtcttgttttgcaacattgtttatttttataattttaagaattaaaccttttcagctgccttctttgctgttaaaatacttacatttccaaatataatttacacatatattaaaggcatatatttacttctacccatttaattagaatgaggtggggtttttgtgtgtgtggaacaaaatgaggaagtatttcaagtggattttttcctggtgtgccaatcatttattgctcctttgagacaaattggttggtacatctgtaatttaaatgataaacagaaaatgaagttataattttgaaatggttacgttcaaaatgtattttgaaggggaatgaatgcttagatgtgatgtttctggattttactctgtaatgatacgctttagaatatagtggaaaaacatgagttgcaagtactgcagttggctgaattcatgccaggttgagaggtcatgcctagtgatgctgactcatgagttgttgtgatcttggagcatgtctctggtggcatgccacaagggtctaccctctgtcctttactacatttttatctgtgtttgataagtccatgaaacaggagggatggcacatacacagtgggcgacaaaatctgaaatgacctcagtatgcagaggaataaggatagtttacatctgtgatcagctactatagagataaatgttaaggttcctcatttaggctgaaaagaaaacaaaaactaacattggtaagtataagatagaaatttgtgactaaaccagcaacacatgaaagtttattttaaaagtctgtataaagcgcagctacctagttcgttccatgaagctgatgtagcccttaacacccaacctagacatacatacacattaatacacggaagaactcttaagaaacagactcacatagaaagataaatgaaaattctgaattcagtcttaggaaatcatttaattatatattaaaatgacatctgtgaccaactagagtttatcccaggagtgctttaatattaggaaatacattgataagatggatctcgtcataaggacaactttgtagtcatcttcatggatgttggaaaggccttcagtaaattaattgccatttctgatagaaactctttcaaatgtcaggtttcagttaatggtttgaagagttcaccactgaaatcagtttgttcttagcattaataaaataagcatagtgtccaggatccataccatgccagttttgttccattttaggctatatgactctcagagcatttcagtcagtgctgatcatcaagaatggtattaacaaatgagtatggccagagcaggggaacgggaaggtgaatagtggaatctggagcaagatggatgagtggatcttaaggactgaagctgttaaaccaggagaagagattatttgatacccaccttgtagttcttaaaagggagacaatgactagctggattaagtttgttctttattaccagatttaggtccagtggactaaagatacatggataaactttctattggagctttctgaatactaggaaatttaatcttttgtcccaaaatcatattttctgtgttagagtggctgccacctgtcacagtgtcatagtggaggctcatgctatagttatatcatctctgtgatcccctcctactcttagacttttgtgactttgttcttggttgtccttttcatatcctttcttgtagttcagcatctagagtttttatggttttcctgtgctgtgtaagtttatcataggatttcttggccatcaaagatagtaagcaaatgagaaagaacagagaatgagaaatcaggaaaacttactctaatttacagccccgaaattatgtgagcaactatttttttttttttttaattttttgagacagggtctcagtttgtgacccaggctagaatgccgtggtgtgatcgcggctcactgcagtcttgacctcctgggttgaagcgatcctcctgcctcagccctccaagtagctggaactaccacccccagctaatttttttgtgttttttttttttttgtaaacatggggttttaccatgttgcacaggctggtctcgaactcctgagctcaagccatccacctgtcttggcctgccaaagtgctaggattacaaaatgcataagccaccacgcctggcctgtgagcaactatcttttaagaggtattattattttagtaaaaattattcttataaacaattttacaaagcaccaagaagaaagcaaaaaatatctcacctagagagaatcattgccattttgatggcagtcctattccctttctttgcttacgaaccggagtctttaaatgcagtcttataatacctgtcagaagaaacttgtatgttaatcttaagacatttagaaaacctctgatgtttttccatattaaaagataattttacatattgtgccccttctgaaaaatgagtggttgctttgccttaataagaaggtattctaaagacaggaaacataataaggataaatctatatgtctccagattgataatcattaagaattggtagcaaaattgcatcttttttatacttttatgatcataaagtgggagcatacagtgaacttcagggttataaatagaaatggtcaacctattttcagacatccaagtctgagcaaatgtgagtttcatgcaattctctgatccagcatataatccggaatactaatatttgctatatagcagcattctagcaattcacttttgtgctgtgatattatggataaagttacaaacgtttaaaatataaatggtcacttgcataatgtatacacgtatctgtgtgtgtttaccaatcctatgaagaggcagtaacaagttttaaaagctttaaatctttttattaacatatagcatcacatttttacatccatcatttcaccatccatagccatttacattttttcatggaatctgttactcatatctattttttgcataggctttagaatcattttgtttctgaatgtggtctttgtgaagattttgataacaaaagcctgctcccagtatgtaatttgataatcctaactaatgactactttaagccattctatgtaaagttgaatttgtattaatggttgcaacattcaggtaatgggaattaaccaacactaagtagtttagcttttcatatgtttgctgaggttttagatgttgatttactaatttgtaccgccattggattttcacatttcacatgttttgacagtcaaccttttggtgttgcctaagtaaggagtagctatttactcatttaaagtttcatgttactaagtgacaggacacgtacagttattaggtgttactgtagtgacagacaggtgtgtaggtacattcacttgactccttttatagatgtaagtcaaagggtcagggaaggaaagggagctctgttattgttgttacgtgtaagtctatttcaagttgaaagggcaatcaggatcaaaacaaaagaaaatctccagtgtgaaatagcaaaggaagagaagggggagtgggaaaaagacattcattagctttttcttgtaccagaaagtcttttagtttctttcagtggcagagaaaaaaaaaacacgataggttaaatgtacttttttttgagacgaggtcttgctttgttgtctaggctagagtgcagtggagcattcatggctcactgcagcctctacctcctggactcaagcagtctcagcctcagcctcccaagtagctaggaccttaggcatacttcagcatatgtggctttttttttttttttgtagatacaaggtctccctatgttccgtagtctggtctcaaacttccagctcaagcaatcctcctgccttggcctcccaaagacctgagattacaggtgtgaaccaccttgcctggctctaaatgtactcttaagtagaaactttttaaattaaatgaaactttatatatatatttggtcttcaaaagcctgcctgttaacatttttaaaacaataagatattaatactttgagacagccagaataatcagaccacttctttagtcccctccccagcactcacgtataccccagtctctctctcctccttacccactgtgtccttcctccagtttctcatataaactcttgtgtgtgagaggtggtctcatgttatttgaaaaacttttgatgatgtcctgttcgtttgatccctgtggaggaccactgttttcaaacctccagaaaagatgagctttagatacaatataacttattttatctcctcccaacttctctttttcctccagagtctgccttttctaacattgctcacatactgcttgtggttttaggtcttcgagtagcactggaggccaagaaatctccagattctaacctacagacatgtggttgatttttggaagataacttccttctgtctttatctacctcgggaaaatgtattttcaaataccaggcttatgttattgcctcaagcatattatatgtcataagcttcctaaatggatcagtttttgatcaaagatttctgaactctgacctgtgttatttattcacttttctgagactaacatagttgccaactcaacaatgtatgtactctcaagatgactgttttccacatttgtattgatatccatatttaagtggtttgacatttaaattgaggttatgaaatagttttccagagtacaaagaatgtcatgcaatttgtcatcatttctcattactgatatttaataatcagcaataacaggaaagggaaaggatgcccagaggttatcccagtctagctttgtgaccatggttcccaccatcaaccataagaccagtaacagtgctcagtttcctacatacattcaaggatgtctttcttgtgaagttgtagttgtttaccctgggctaagagaaaatgcaggttaaataggaagaatgcaaaaaaaatctctgtttaagcttgaactttttcaaaagtatgtttaattatactgcttcttgaaattataaagtaattctatagtgtatatacagttttatataataccaattgtgaagtatttattacatatgtttaatttgtatttttggtagcatgaacagctaattttaaaatcataaactctcttaggatttcacctacctggtaggtgctatcatggtagccagcatttttatttctggatattatattttaaatcctgaacactcatcctcgtttctgattgtggcctattgccatcaagttggtcggctttaagattgggtaattttgctcagatgattcccaggaaagattgcaaataattaatacaattcgagttagacttgaagaaatttggattgtgctacagtgagtagcttcacttctcaaggttccctgatttaaatcaaaccttagggatcttctatgttagttttaaatttctttatagataaaattactgatacccatatacatattacatacatattaataaaagtgatgtctatttctatttgtggatggaagtgttatatctcactccagcactgtacattgtgtttgaatgtcaacttgctcttatgtcgcagctgctgttgagagccaagatatgttcatgttaaaatgaagactattatgggagaggagagtagagtggagtgctgtgtagtgagtagctgccatatagttgtgctgaaactggtgaacgaacgactgagaatgcccagtggtgcagctcttctctcctgtgaactaacagccagattgtttgtaatttcccgtgctatttaaaacagggttctcatgtatcagccatcttctgtaagggtgcccagtgtgacttcggttgatcctgctgctattccgccttcattaacagactactcagtaccattccaccatacgccaatatcaagcatgtcatcagatttgccaggtatgtggagtgtttttgtttcttttgttttttaatgaaagtttattttttttaatcttaatctgtgaagccagtatagttttgaaattttcagtagaggtgctaaggaaatttgaaagcttcgggtaaaggtcttatctgtttttatacatcacatccagttgttattttaactacagagcaatctatagattcctggtgataagaaatatagtagaataggaaatgttagagattttattcttccttttgaagaatttgtacttagagacttcttcttggtttctttattatagaacctcacaggtgaagggagaatattttctcatactcttcttggtagctcatcagaacttcagaatatattgatgttgtttggggctgatttttcctacaagctgtggattttattctccttacaaagatagagtctaccatctgtttccctagagtggggcttaatacttgggatatcttttatatgtacagtactttccccttatccacgggggataagttccaggacccccagtaaatgtctgaaaccacagatattacagaaccctatatactgttcttttctatacagatatactcatgataaagttgaatttttaaattaggcatagtaagagatgaacagcaataactaataataaaatagaacaattataacaatatgctggcatcactttggtgccattattaagttaaaataacggttacttgaacagaagcactgtgtactgagatagttaatctgttaacttaaatggctactgagtgacaaagctgggagccactggacaaaagaatggttcatgtcctgggtgggatggagcatgatggagccaggacagcatgagatttcatcagactattcagaatagtgtgtaatttaaaacttatgaattatttctggaattttccatgtgatattttctgactgcagttgaccacaggtaactgcaatcacagaacgcaaaatcttggataagggggaatctactgtaaaatattaaggttgctagaattaccttagtatcaggacttctgcaaccaaggccatattacaaaatttaaacttccctcctttactcttcttccctctccatagctattgcttttgcagacatttctgtcaattatatttgagcaagttagaaccagtacattcatgacttcccttctctccgaaggcccttttagtggaatacaattctctcctcctgttactagttttcttctctaggtttatgaagttaattttgacctatgatttattttttttctccccttagtgaggtctttattttaagcacaatgcttatcctgttggtgaaagtttatgttactgaaacaattgataattggctcggtataattttgccacttgaaatttgtttagattatgtgaataaaatttagtggaaaagaatagacattttatagtatccatagaaaaaaatggcttttaaagttattctttgcttcttagatatagttactccacatgtaatttgggagttggtattttaagaagttctttgtagacccagctagcacaaattgtaaagtatttgtaaagtatatacaaagtctaatgccaaggtacaggtgaggattcatgtcggtgacaaagatggaaattcagagattcttaattcccaactgccttttatggctgtaacatgggttgttggaagagtgtctgcatgtcatctcagtatgtgttataagcaagcattctgaaaggatttgtttcctaaagaccttgaattaaaaattaatcctgaaaaaaggtaatgagcatttctgttcattaaagtgatcctaccatttagcagtagcatagacacaatttaccaatcacttgccctgttagtttttcagttctctgaacctggattaatttttaattgggggaaatttacattatttcagaatttgggcataaagtgagactttatttctttttagaaatgtgcaaacttgagaaaaatgcagtaaaatatgtctgaactggctatttggtaaaaatgtgtttcaagctgatattgagcaaacaagactaatatccaaggctgatatttagccagtattaacagttatggtgatactggttgttattattgaaaagctttcttaccagttgataactgaatagaataggatctattttgctttagaagaattgctagtttatcatcatgtatgaattatgtagcagttactatatctaaatagtttagttttactttgattttattgttaatgtgctcttttgtgattagtaatttggttttatttttatgcataatttttatgtagttagtcatactgtgaagagttttggtattgataaacttaataatttataataaaatattaaatagaacaccaagaatggagagataacaaagttttaatacatttcttaacattccttttaaacatcataaacatgaatcttctgaatctgcaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcatgtagcagttatgttttgttaaaagtttatgactcaaataaggaaaatgtgttgtcatcaatgagaaaaaatctaatgagtcaatttcacagtgaagcacttaaaatttttaaattaaaattttatcagtgttaataaaataatgttaacactacctgctttttagttaaaagtaattgagcattttcaaccatgaaatacttcggagggcataaaaatatatcagtatgacacgctgcagttgaaacttatggtgaaataagaaacagcattttgctaaacttacgaaacaaggcagtaaaattttaatcactactgatgaaacttgattttatataagagttttaatattctgcttaaaatgtaaaatgcaagaagactttgatggtttcgttttttgttagaaagaataacatctaaaataccatatcaaacttcactgttagtacttgagaaaaaaatggtttcagtgagagaaatatttacattaaacaggttttatatagacagcacccttgtaatgcttggtaaacaatctagaattccaaccaatattttagaaaaatttctaggtattttattatggtgttgtataagtcaccacattcaattttccgtggatgaggtatcaatatacagataagtaaatctcttaattgttttctaaataaactttatatttaccacacacatgaaatcatcaaagagaattacagtacatctgaagaactggaattgaaataacaaaaataggatcctcagtgggtattctctggtgatagagcttcaatttttaatttcaattaaaataaataggcttgatataattttcaaactgttttatatcaagcttgcgtattttaattgaaattctgaaattgaaatagttgaacatttagaaaatgagcatttttgagtggcttggcttcagtacacaatattccaacaccattgtcaatacttagcgttataaaaaggtttcagttactaacatgaactgagagatacagcaaatattaaagatgattgaacatatgaaactgaaaaactataaaaaggtagaagctattgtaaaaatgaagaaaactgaaaaactgaaaagataagaagttactgtaaaaagaaaacggttataccatttgaagcagaacaaaatgttccaataaactttttttacttaataatagaaatattgaaaatgcaaaactctgaaggtattacaagggctagacaaattttgaattgtttggcataagaagggagaggatttattgaatattattaatatgaagacaaaatctgcttattgagatatctcacctattatcattttaatagagaagtcattggaaaagtttgttgtaattctctttggtttagtattggctcaaaccactgtgtcatatagctagtgacagacatatgaaatgaaaaattacagcaagctgggtgcggtggcttatgtctgtaatcccagcactttgggaggctgaggcgggaggatcacttgagctctggagttcaaaaccaacctaggcaacatagcgagaccctctctctacaaaaaaaaaataataataataattagctgggcatagtgacacacacctgtagctcctgcttcttgcgaagctgaggccagaaggtaaaggctacagttacctatgattgtgcctctgcactccagcctgggcaacagagcagactcagtgtctcccaaaaaaaggaaaaaaaaaaaatctgtagcaacaattttcaaaaaggctttagaaatcgttggaatgatttctttcaaatgattggtgctatagcttgtatcacttgataagcatttttgtaatacccttatttggagattataagagaataaatatacttaaattttttgagttataaattcatactggttagtagatattttaaatgtacccactgatattctctattttgcataaaagcataatgtcagactttctctgtgtggtggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccaggtatgtatcctgaatttaagcaactaatttgtatttgattgttggttatgtcatactaactaaaaatgaccagttgcataaaatcaggacagtcatctctgaattacttacattgatggaaaggaagtactgtgcaaatatttcacaattttatttgaaggaataaagttgttttcagtttatgatttttgtctttaatatctaaattttaaattctgttttatttagcttaatcagttggcatctcctacaagcatttgaatgattagaatgaatagaagcagtgctgggtggctagaagttaaaattttacaaatacagttttattttttagctaaaacattctgtatatagaaaatcaatagctaaacctgattagacagacttgactcattaacttgattcttcattgtttttaaagacattcagatttggactttggggaggccccagtttaaagttgctatatgtcaatcatccccgttttctctgtcaaagatgagaaaccctagtagctcggtgtcccaacatgaagaccttgcagtgagcctggattgcacagacaggcttatagcagaggcagagcagaggaggagaaggcatgagaaaagtgaagggagaaaatgacatagaacaaaagactttgagaggagttgagtatagggagggatagaggaagaaccacgggtcactgcttcatgggctgctcagtcagctaagcacaagtcctgtatcagcctcctgtttcagtactctgtatctgattacatgaacagcagcagaaatttgggcccaaggtaatgtgcagactgaggaatttcttatcattcggagttgacctcattacagcagtatatataacgaaggtacctagtgaaagtgtctatgtatttttctaggaaatggattcttcagatgtgaggattactaatttttatgtgaccagttcttttaaaaaaaattatcttggaacctagaggtttttatttcatagctctgttttgtatatttagtagtggtctaagttatttggtgagtcagtagtagaagggtgatgtggggccttcagtttgccatagaatccttaggttttactacttgacctccatattatcccttaattcttgtcattgtagctacaattagggatgcagggttagaacttaagtggctgcaatctgaatactactaagaattcaacgcacagagcctgttgatggcagcactgtagcatctagcacaactttcatgaatgagtatctttttcctataaggcaatcaaaaactacctgagaggcagcaggaataaaatgtaagtttctgggctttgttctagatttaccccccagttttagtggaaagttagaaattgatttgattttagaaaagagttttaatactggacaattcaaccatctttagagctccttggaagctctttaagaactgttctccctgtaactaatgtcccttgactctgtatgtggcattcattttattgatgaaccaaaacagttatctatccaaagcattaaataacttgttcttttgaagagcagtctgaattttacttgttgctgtccctctggctggcaacttaaacctgggactgttgttcctgttttattcaccggccttggaaatcatgtagtctaaacaacttgacttaaattcctgttccataatccagtgtctctaatgataagctgcataatctttagaatggggaatatgaatcagatatccttactgatctttcatacagttgaactaatgacaaacttaaaccatctcttgcaggatatcactagacctcttgttttactaaagtcagtgcagtcgtttctcacataaaaatattctatactgatataatgcttttggcttgtctctcttcactcctctgttaatattagagtagtacattcaggtttgtacttgtttgggatcagtaatgggatcagtaaccaggattgtaaggggacttgtgaaatatgagcactaggaaaggggtgttaagcaggcatcacgagaagattaggttagatcttctttaacatttattgcaaaacttggtgattacctgagataattttctgtcctgaggatcctgtgatagctagctaccgtgtagtctgtgttttagaatgaatgttgtcattctgatgacacaagtattttacgtttatgtacaaaggagtccaatgccatcattcagctggtcagccttaacattcataaaggatctgtttgatactcaatccataccgggaaaggctaacaaatacttttaaaaatgttattaagcaaaaatgctggtgtaagatcaacaattctttcaaaattgacacccaactaaatacagttagggagcaaattctttttgagattagggccaatatttagtattaaatgacttcagttattgttgacattgtacttttacctttgtatgtggtcagcaaacaagttccacaagtttagagagaatcaagaatatatgctgcattctctaaataatgtaaaatagctaaattcatgctatcttccacccaaagatgtgaagttttgagcaatttttaaatcccactgggatttaaatatgtgactattgcttgtgcatatctaataatttctagtctctttatttaaaatcaagtagcctcttcctcattggcatcattgtttgtttcaagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaatta

SEQ ID NO: 38007 - DNA, 74675 bp, Homo sapiens
taagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaaggtgagcgggccggccggcaggctgggctcagagaggcagagcgcacccctcacggcctggccgcgcccgggtgcggggccggcggagccgtggctggcagctgctaccgtcagcgcccgcagcggccaggcagggcagggccgggcagggtggctgacgccgcggtcccgggctagcctgggcgttggggaagcgggcagtcgggcggcccctggcggcggggccgaggcagccgcagccctgggtcggctgcgctgccgctgcgggactttccgacggcccccgaggatttcctggcttgttgggtcccaaggagggagagaggccccgataagagaagtgagatgaccacgctaccctcggcggggaaggagggtagcgagcagcgtatgggcaaggaaccagggacgactcgcgggcaccagctgcccgcgttttccagttacataggcacggtggatcctcagagacaggacacaggcgctccgcgtgtgggggtgggaccttgtattcccagggacttggggacacaggcgctccacgtatcaggggacacactgtgtgctcgaagggatggggactcgggcgcatggtgaggggcacacggtgtactcatagagatagggacttaggcagtccgtgtaagggggcggcgcacactggaacggcggggacactggcgcttcgcgtacggggggggaggggacacacctgcattcccagggactccgggacaccggcgcatcgcgttactggagacgcgccgcgtccaggacggacacaaaccaacacagtgccctggggagagacctgaggactcacgcacacttagcgctccccgggagcaagacatcgggttctggagagagaggttcacggacgctcaacgtacccgaaaaagctcccggcgtcttgggctgactctgggaagtgtaaacggggaacgagccagagccagaaggtgtggggaggatacaatgcatcccgggcagagactcgggcctctcacccctcgttttcgagagaagcccatggacacacacacacacatatacacacacacccctccagtacagagagaggctcagataggcgcacatacactgtaattggactacaaatccagacgctttcatgttggaaaaaaaatgggagagacagggaagcaccgagaagggacgcggtaaccagggtgcatggggaaacagtttatggacatgcagtactgtgggagaccggagtggatacatcgcgtgagggagggatatgccatatgggggaacctgtaacgttttacaggagaggagagagtcggaagggagatagaacccacggggcatcttacaaatagcccgttcggtactgaggaacacactccaaccggtctcgtacaacagacagaggggcagaaggacaccgagacacagattcacatagttattcagctaaaagtggggaaaagaattgacatctgttgagctcccactagtgccaggcactttaaatacatagagcgaaggcagagtctgaggcagagcggcaggagaggtgtgaaccctggtttactgggagtgtattcagagagcccccccaccccataagtgtgcacacagaggaaggcattagttgtgcacgctttggatagaaaatgaactcacatgatagggtatttgtaaacagcagtggaggctcagaggtgagtgtattgttaggaaggtactcacagaattgggtggacacatgaatgtacgtgctaggacacttgtgttactaaccagagaagcatatggtgaaaaggactcacagactttgtgtggtggggtgagggggcgtcagggaggagtgcatgcacagggagaaaggtaccgtcctacatacagtgaaatctcgagagaaaatctcaagaatggctgggagagatacaagaaatagaaaactgcatgtgccaatagctactcttagataggtgcacctgcagtgaagagaccagcatcagacggagtgggaggcccatatgggggaagccagaaacacaggcagagggacagaagcagacagtggagagaaactctggagagaaactcagccttgcaagatggaaagataagcttgcctgttccaagggaagggcgtgggaaggaatggcagtgggaagaaggtaggtctggggatgtgaagagaaaacccagaggcccagagaaaaagaagtcagcaggaggcggccagcccctattcaggagcagacccgaggagcagagaaagacttgacacacagtgggtgggaagaggcatctctgggggcagtaggtcagccagctaccttgggaaaacaacaggcaactgtacagttgattacagcaagattgacagtgtacacttgtggggaaagtgggcagatgaggaggtccacttggggaagggaaagcgaagtgacagtaattggtcatgatctgcatgaccactggaggccccagaagggagtgctttgttttcctacctttgtatggccttcatttctgcttcctataccctagtgttttcatatttgggattaagtttacagtgctctaaaagcccctgcatttatataccagtagcttccaggagacagaagatcaaaaattctttctctgccaacccaccacttagttcttaatttaaaaaaaaaaaattactttttaagaggtaccaaagtcgtcaatgtctttgtttgcttctgactgcttctagtactttttccatttctgtacatgcccatttatgggtctggttggtctctacagaggcagcaaagggaaaggaggaagactttttcccagatctctctaccttaaagcatggagccaagtagcttgtattagtcctaggattccttttctcctgcaaaactggtggtagaaacagtggcatgcgggggatggtacataagctgaccatccttaaccagctcctatcaggactcactgtcagctcagccatggaaacactttttaaggggtgtggacaagcaagcaggaattggagtgaaactgtcaacctcagttggatgaaaactgggaagaaaccaaaaaaatgagatagatacctttctggtgactgaatgtaccgttggtacttactgcaggctccacccacctgtgtgtcctcagtgcccctcctcctgactcagccagaccagtgtacctctatgggcacagtaagagttgctagcagtaggcatctggctgagcttttatcctccagtggaaggatattaatttggtctttcttgtcttccatcgttattagaaatagggctcatgactttaaattgaagctgctgtttgggaacatgttcacatggattggctaattgggaagaggtttctagtggtcaaacctgttctctctggggggaaaatggttttaatttctcatataaaactgtccgccaccattcctgtactcatataggagggtacttgatggcaggtagcctctaagcagctctggcctatgtaaagtgatgactattactccttctcttctaatgactaagagccagaaatttcaacaggttaatttgctaaattaagcatcagagaattctttttttgtccaaattattttgtctattggagttacccttctaaattaacccactttgacgtaaggcttcagagaagtgaatttaaaaattttaggaagctatgatttaggcagaacagagaacttctttagatgtaattgagcaaatttacagcgttctaagggtttgtggaaacagaatatttgatgaaaattttgaaatcttgttttttttcaaattacaattcctcactgtttcaaaagacacataatcctacttgaccttcattattcaggttccctatttttagagaagtgatcttgggagcctttctaaacaggcagaggggcattgtgagtccagcaatgagagttatagttggagtaaatatcttgtaaaagttgttttgctactcactttgaatacagaaatggtttcaagttgattgtgtatcatgttaactggaaagttattttcatgattggcagaaaaatttagacatgataatacagatatctacaatattaaccttttaaaatgtagattattttgaatgaggagaaaagttgctaaataaataaaatcacaaattacaactttatagtcattttaaattgttatctgtgattgtgtggtctacataagctctacatattttaaatgagcatatattactgtaattacatatttcccccaaatggaaaactatatttaaaattaaaatccaacatttaaaaatacattttagctaggttcctcagtaatgctgctggctttattttgatgtttgagtaacttacttttataacaaaaactatatcaaagcattattttcagattttgttgctgagcctgtcagtttagtttttaaaaaatgtttactcaaagtttcaaaggtggtggctcaaataatactaccatgtttgctgactattacataaacagtcttgcatagttgtgtttgggggcaggggctactcctgctctatccctgaagatcagaaagcagatgcctttaagtgggattctgctaacactttctcttgtcaactccattggattgaaatacatttttctgcctttgttagtgtcttctaggaaagtgataatgtttttaaaatttgtacatatatattgccatttaatttttcataattttagatgctatttacaaagcataagttcttatttaagcctccaaaattattgtccttcatagtagctcccttcaatgtgttacttgaccttttgttaaatcactgagtccataggtcagagggtaagtgacttccttgccttatcctttttttctaccaggtgaactttttagcatttgattcattatagtttaagacacagaaaagactcatactctgcttttttctctttctttttttgcctgcccatattttgtatgtgttttcaataatctgccttataaatgcagaagactgttcttaagccaccacttgagcatccagacctgccagcacagcactgccaccactgttggacatgtttattaagtaaaacagtgaggtttgctttagcagattctatttgctccacttttaaaatgtagccaagtttaatttaaataaattaatcctactgacttttaacttagacccattttcagtctgtgcttgattttaaaatgctttttatcaagtaaagtcaagtttgtgccccatccttcagtgtttggaaagtttattcagatgcccagttgctcaatgcaacggagggtgttcctccctgagaaaagtagtagccagattgcctaaaaagatagacagggaagcttggcaccagaattgggaagagaaagaaagaacatatgtgaaggattggaacatgttcaagaaaagaatttaaaaggaaaggggcgtagaattcttggaatgacttacagaaaagcttaccaaggacaatcaccagattcagcctttccatttgctccatttgcacttgtgaaaaattacagaagctgtgttcataaggcttattaggtaattggtgataaagccagcagagagaggaaaatgagaatttcagctgaactaaggctaggtcacttttaacaatttgtgatgacccttttctctgcaacagagaagcttaggagcccggcactagatccagcccaccatttgctagattgggccaaatgtattttagattgtttgagaaaatgtccctaaaatgtgatattatggacattcctacactgaagatgaactaagtcttacaataaagaaaacaacatgtatataacccaacatctgactgtcctgcatacctcagctccatacagaatttcctataacttatgcacaaatttaccgcagttctggagtagaatataataaattaatgtccatgtctttagagcaaattaaagctggaaaacacagcataactcgggtcaggttaccagcgaggattgctatctctgtctttttttatctccttccttctttccttccttcctatttttttctgtggcagtactatggctcttgagagccaatgttaaatcttcaggaagaactggtttaagagttgccactaatactttgccagcaaagaccaaaactggcatttgcatggtttaattcaggatataagaaaagggaattttattaattaagctataagctccttgaagattcatgaataaaattatcaccttgaattgacctctacagaaagggcatttggctgctggtttcatagtaactagattgttaaacaaatggcatgagtttctttccttcacagggatcctatatgttattggtctaaaatccttgggtcttaaaggattttagcaagattttagcagacagaaactggatggggaccacatctccagcagaaacaatggcataggtaagcaaagaagagtggtagctagggcaagctccaagaattgccataaagaccctgttctgcttaacatgaagggcaagagaaaaatgtagttgagtttaagagagaaaaagtaggtcagagcagattcattaccttactaagaagtttggattttattctgtaaacagagtagaaatataaggtaatttgatctacgttttaggattattctggccctggtgtgcaggatgactataatgtgaatctggaaggagatagacaagttaggaagaagtttgtggtccaggccagagataactggagtccaccctagggtgttggtgggagaggtaggagatgaatagagtctatagaatttaacaagatattggccgggcgcagtggctcatgcctgtaatcccagcactttgggaggcctaggcgggcgcatcacgaggtcaggaaatcgagaccatcctggctaacacggtgaaaccctgtctctactaaaatacaaaaaaaaaaaaaaaaaagaaaaaaaaaaaagaaaagaaaattagccaggcgtggtggcaggcgcctgtagtcccagctactcaggaggctgaggcaggagaatggtgtgaacccgggaggcagagcttgcagtgagccaacatcgcaccactgcactccagcctgggcgacagagcaagactctgtcttaaaaaaaaaaaaaaaaaaaaagaataatttaacaagatattttaaagaagcaggattgaattgagatttctagccattggcactaggaggagtacccctaatagaaaaagggaaattggaagcagttgggagagtggagttgggggtaggagagataaagatgtgagtgatattttggtgaacattcactcagtcttttagttgataatgaaaagacttgggtttgattagatgttttatatttgtgaagtatattcaggagtttgaggcagacagatatataaaacagtgctgtattacttaacatgtcttatataaactgttttatttggatggaaattttggagattgttgacgttttgaggaaagttgaaattctttgggaaaaaaatttggttttgagcagggcattttaaattttgtttgtatttttatagactttctttattgaataacgtctataaattgtacttaaggccatcataaagcactgataatatgaaatctaattttattttaacatggaaatcagaccttctgtggtttctgtcctattgattaatgaaacgtaagtaactctatataacgttcctggatttacatttcaagttttattttgaaatagtgtaattcctaaagtccttgaaggagtgctttcaattacctcacattacctctatttctgttttggtgttttgattcctttatttcttttttattggcagttccttatgaaaaacaaaagaatcatgagtgcataaaacttttgctatacatacacattgtaatggactattatgagcgcttgtttcttgatccagggagataacctagtctggaagactttttcactcaactgtgagcttattcaagggtgtagccaggcttgaactttcttataagattcacagagatactttaagacttaaatatgcttagctagaaacaagtattagcatattttaagataacatttaatatcattgcttttggctccattattagaaaccatgatacctcaagagccagaaaaagtgtccatgtaataaaaagtcagctgagtatcttaagatgttttttctttaataaaaagttaagaggtagagttaaactaccaaatattcgtttgttcactcagcaaacatgtatttatcttctgacatttgccagggatagaactaggcattggagatagaaagctgaataagtcatgaatggtccctgccaagaaagtgcttgtcattttagtagaagcaggcaaatgtgaaaaaaaatgaacactataaagtctgtgttcaaagagatgtcttctttacctgccatcctctgctcagcccgttgtttccaccacacccgtgaggttatacctgccaaggtccctgttaaaatccggtggtcatctctttgtttccatcttaccagacctcagtggtattccattctcttgaccacttcttcctattagaaacactttcctgattttcctcctacctctctgcctattctttctcattctcctttgcctactttcctctgtttgactggcctctgaatgttggaggtctctatctcttctctttatctgttcagtctccctaggtgagttcatttagtcctttgaatttaaatgtcatctatacattaatgactcccaaatatttatctccagatctatccttttctctagctccaagtactgatttccaatatacttcctcatcaaagtttaatagatatctcaaaccttacatatccaaactgtgttttatacccttttaggagtttttctcaagggtatggctaatcattgcaaggagaaaactatcttctgacaatcaactatttcaataagtacagacataaaggaaattataaaagtgttacctgattttgttattataaaagatcctctcctttgttgatatgagattccatgagggatcaagtaagattttttttttaacttttattttaggttcggggtatgtgtacagatttgttatgtaggtaaattgcatgtcatgggggtttggtgtacagattatttcatcacccaggtaataagcatagtacccaataggtagttttttgatcctcaccctccttccaccctccaccctcaaagtaggccctagtgtctgttattcccctctttatgtccatgcgtactcaatgtttagctctcacttataaatgcaaacatacagtatttgtttttttgttcctgtgttagtttgcatagggtaatggcctccagctccatctatgttgctgcaaaggacatgatctcattctttttcgttgctgtgttgtattccatggtatatatgtaccaccttttcttaatccagtctacctttgatgggcatttaggttgattccatatcttcgctgtttctaaaaataactcgtgattttactcctcaaatctctatctacctaagtgttccctatctcagtaagtggcagaactctctatcaaattgcctagaaattgactagcaacccttgatttgtctcctgttttcttgacatatttgatctatcagcaagtactgtcaccttcaaaatatcctgaatctaaccccacccattactgctattccagtcccagttaccatcatctctcctcaggatcactgccataaacttcgaggtggccttcaagtttctacccttcccccataatccacagcagctagagtgatcttttcagaacattaaatatgatcaagtagtctcccagtttcaagtccccaatggctccctttgtaaaaaatgttttagatgccacattttattaatttctagttttaaaaaaaaaaacttcatcttccaatctaagcttattttaccacttctccttatacttctgctttagagttcatgatcccaggaaacaaatctttatttgcatttacagtcagatttgacatataagctaattatacaattataaggcccacattaaatctgggggaaaaaatggtggaatactatgcttcaagtgttgttgatttatttatttatttatttatttattttattttatttttgagacggagtctcgctctgtcccccaggctggagtgcagtggcacaatctcggcttactgcaagctccacctcctgggttcacgtcattctcctgcctcagcctcccaagtagctggggctacaggcgcccaccaccacgcctggctaattttttgtatttttagtagaaacagggtttcaccatgttagccaggatggtctcgatatcctgaccttgtgatccacccacgtcggcctcccaaagtgctgggattacaggtgtgagccaccatgcctggccaagtgttgttgatttaaaggctggttcacagtaactaactttttggctggttgtttggtttagatttttgccttccatgttcaagagctatttgaaatcctaagatttaagacaaccatatatatgaagattttatatatatatatatatatatatatatatatatatatatatatatatatacacatacatacatacatatatatatataaataaaacttggcatgtatcagatagccaccattttctagaagctatctttcaaaacaaggattgtgctaaatagatgttggttttgataatcccttatatttcactctttccatgctgtagtggctagaaagaaattattctttacttcatatgttctttaatctggttcttccaaatctgcagaaaaggaatttcttttgaatctaaggttacattgactcacagggaaaaatactagattggttttgtgaagcttaatgactttctttttggcatctaataaaaggtttgaggcaaagaaggagataccattttttaaagtagttttggattatttctaaatttcatatcatgtattattctaagcatattattggcttttaacaagagctgagtgtattttatttcttcaggatcaactgtctgatttcttgtgctattttctgcttttaactccaattttctttcttcctcctctctccttgcctagacattttttattacagtggttaaaatataattattaaatagtcttctttgggttctctatcagatgatgtcttaaagaacaaagaaaaaagtgactcttgaacaaaagaatcattactaccagttcttaaatagcatagggggaaagaaagatgatctattttatccaagttgcatcccagggaaaagcatgtctacttatttactttttactagtgcaagtaaaaacaagttctcaaattgtctggtattttccttctgccatagtgcaaaaccaaaaaagtgattcttaattctctggctttcagtttcaaatttcatattactattgttgaagaggggcaggaaagactaactatataaaatgctgaataagagcacagttctgagccccaggtcacttattagccatgtagccttcagtaattcacagaacttacctgagaaatgagaataatagtatctaccccacaagggtgcttctgagaattcccagaggtggtagtaaaaatggatagtgcctgacacattgtaaacgctcaaatagtaactggttagctaaaactgtttctttaaacaatccactttaagtactcacttgaaccatcaccacttatagaaagtttttttgttttgggcaaagttccaaaattatatttgacattggaattttttttttttttttgcagtatctttatcatggcttataatgcagcttagatacaaaggtagataccaagtatttaataaatacttgctgattgatttcaaataatttaagaattcttgaattaagtaaagaataattcaagagttaacctttagttaactcaaagttccatgatgggttcaaaagggaagctaaaggtgtctcaaaaacatctctaaccttaaagaataaagttggaaagatctctataatattttttagaaatattgttattttctaggcccagaatgctatttcttgcttgtatatttgtaaaactgacagttgttgataagggaaaggtaaccacacatttaatttgtttacatgggtaagcaatatgtaaataatcaagagatggttataaactacctttataggataacttttttattcaactccaaaaaaacagctgtgctcttctcccaccccaaaggaatcatgtcagaattaatattccttaggaaaatgaatatttcttaggaaaatgactcagtaaattatatattacttttatagttctgatatattgtgaggaatagtccctggaaataagtgtacatagatctctttggtcatagagcaattcttgttgcagtagcattggcttgtaaatgcagatgtcaagagtataaccaaacttaagagcattttagcattgcctatactactattctgtgcttaggaatgcccaacatttcataagaggtataaagggtaaattcaaggagcttctaagagcagtgaaagtactaaaatttgacagaatcttttgactgcaaaccatcacttttatcaggttgttgaaggagtttccctagccaattacaatctgcctttgtgttcttggttggaaatagatacaagataactctcttacttatagctcaaatactattcccttaagccctagagtaacttgattttcagaagagctacttggtgaaaatatttacttaaagctaaaagcaaaagttgaagccttacctgaaactcatttctaatgggaatgtattcagcaaatgtttaaagatacaatgagttgaggtcatgtttatacaattaaacttaggctaaaaaaatttggataaaaaactaacatgctttagacatttgcttataatggtattgacttctaaactttttcctggtggctctcttaataacacagtgagtgatcagatacaaaataagtggtgtagagttctgtttcttcctgtggcttttttttttttttttttttttttgaggcggagtctcgctctgttgcccaggctggagtgctgtggcgccatctcggctcactgcaagctccgcctcccgggttcacgccattctcctgcctcagcctcccgagtagctgcgattacaggtgcccacaccacacccggctaatttttcgtttttttagtagagacggggtttcaccatgttagccaggatggtctctatctcctgacctcttgatccgcccagcctcccaaagtgctgggattacaggcgtgagcaaccacgcccggccttatggcatttttaaaaacattcaagagctgcagcctagttaacatgttcttttctaaaattgggattaaaatcagtaaagcctttgaggttcttttaagtatttttctagattgctagatatcttaaaagaatttctgagtaacaatgagcttagtttgccctgtttggataagtacatacaactattccataaatgagtgttttattatgtattaaataaaatggtaacaaatatttatgttctttcactatacatcatccttaaaggaaaaaaaaactatttttttcagtttttaatcagaaactgaactaaattatactttagtttttttggaaattataattactttatgaaattcattttccttggaaacaaaatgccaaaagaactgagtgaacatttaaggtcttttaaatatttagcactagggggtaacacatttcagaggcaagagagaaagaaagagtactgtatttggaattcagaggactggatttaaggcccaactctgctaatcaccaggtctgtgatcctaagcgatgtactctacctcttagagactcattatttattctgtctctgaaatgggggataatgatgctttcctaccacccagggctggttttaggaggctcacttgagacgatagatataaaaatgctctgtgccatacattagaaaactaaataaaaattattcttgttgaggagtcaagctgtataggtagaactataagcatgtcaagaagtcaagttctaaattcagggcgtgaggtaaaaaaagattgtatatagtcaaaatttcaagtttctaaattgttgtgaagaatagtacatattgtcttgtctgtacaaccctgaatagtaatctgcatatgtgtacagtgtgtatagtggtatacttcatatataaagagaacatatacaaaatgattttacaatactttttttttttagctgagcacgtaatacttgtaagttacatatgcctaagactcctgtatcataacaatcaggaataagacaacctatgaaaaaatataccttatgtagtggaacagtagatgctgggatctgaacaaacagctaatgagatttaactcatagttacatagttccaagttagcaaaatggtggcaccagagttttgtttggctagaaacaggtttaacatttttaaatttggatttttttcctttgggcattcattttccaggtactcaccactccttgttgccttacatccatctgttccaaagacctttgggtctttgaagacattgaaacattgagtgtttgacttctggtttatccaaaggaaggtctcactgaggaaattaatgttgagcttgaatgttaagtaagcaataactatggattggcaaagtagagcttgggaatttatgccaggttggaagaacaggaaagagttagagaggaaagtctttgcaaaacaaacaaaggttaacatagctgagccattgttgggaggaagtggaagatgaacttggttgattctggttgatcttggttgatagcggatgtgttttctatttagtagttggctttgttttgacagacagtggtaagaactactgtgggccaacagtggtatatgagagaggttctgctggctatttgaacaatttggaaggacttcaaggaagggaaaaagccattgtctagttgtgaggtgataagggtcttgcttttgaaatggagactaagaacttaatttgagggagtttggggcagagtggccagatttggtgactgggagccctggagccacgctggcatcatctttctttggtgtctgatattcaagctttcagcacatcttatcatttttcctggggaatatctgctctgtccactatcccctgttagctgcagatgcagtcatactaacttaggcctttattaccacttccagggtatttctaaagcatccgcccggactgcactagctcacttctccacccctgccctgccctgatccatctctctccatctattttacacataactgaaagagctgccttcccccaaaacacttctttgagcaactctcttatacaaaaaattgagagagcctccaatagtttatcaagttaaaggcaagagtaaaacccatcagtgaggggttagggaggggattagggcaggattatttcagagtgataaactttttggacagagtcatcctgaggtctgaaacttaaattattgccctattctgtagcaaatagaaactaaaaatgaagacacattttgaggataaggaaaaattaggcaggaatttacaggtcagatctcatccttgctgttgtatttcaagtgggaaagaagcgtacacatacagacctgccctctgaccatacagtgtccattcctgtcttcttgcttttttcctcagggtattctctctccttggaacttaccttttctaaactgctattcaagagccaccttttcaataaacatttatgtgttctaacccgtactgtcctttttgagaattcttactacacttcccagtgctacttagcctagtacttaatcattctcaaattttccccaactaaaagatgaactctctggcatgagggattatgcccccacactcttgaataccccattaacagatgtgtgtggaacataaggtagtagaagaaaagcagcatggcaaaatagggagattgagtcttgggttctgatcctgtggggcataggcgccaactgtattatctctaaggcctcatctggatttggaatcctgtgattctagtggcatgtagtatgtaaacgactaatagaatatgaagtcggggagagaagagactgtaagttaattttaaggtggcgagcctggataaccaagaggataaaagtgcctttgccagaaaagtaagaaagaggtgacggtttggttgggaaggctggggatgggggaattagtttcatatttgccagtcattgagatttgctgccattgtgagtttctaatgcaaaatgtcctatcagcagtagtaagtagcaggctatgcagaggtgccagctgaggaatggagaagagattcagagttatcacccaacaggttcagtgagcctccaggatgaaatggatctagaaagaggaaaggaaaggcactagcctttcgaaatgaaaggtgtgatcagagagctgggaggactgatggatatccagtggggatatcagcaatttgaaagctgagaagtttgcatttatctgaccaagaagaatcaatgaacttgttggagagagaatttcaaatttcattggtgagctgaagacaacctctgagttgccagaattcaaggagggaagtgtaatgagggaagtgtaatgaggttatgttcagtgcttctgatttggagagacattcagaaagcaggactgatggaaatattgtgaaagctggaacatgaacctgtataatctcaattgtagggccaccttactcttccacatgaagaggggctacctaggcccctatgggcatgctttcattacttcaggaagagtgagtttagctgtggaaagtagtttgggggtggcatttttcgccttaagaaagttaatctatatttatattttcataaaagaccatgaattagaatgaaaatctactaaaaaattggattttaaaaattcaggtactacctttttatttttcctttttaaaaagctcacttctcccacaccaataaatgaatttgttacccagtagtacttagattctgctgataagtctaaagttaaatgatcttttatggtagtagaacagtaacagtatccattataatgttttctccaagaagatatttgtttattcatttttatcaataataataagatagctaatgttacacttgattttacattcaggtggtctgtcttttaaagaagttcttatctttatttctctttctctttcatttattataatccctattagtaaacttttaagtctgcagagaagttttgggaagcatttggaagtagtaggtgatgtgctatagctgaggtgaggaacatattagtgcctctatatttttatttggggtagagatgagaccagaaaccactgtttttgtacattggatttgaatatgaaggtgtgaatagtttataggctgatgtactaccattaaacattacccaaatctgatttcttcgtgggtttctgttggcaatttggaaaagctttcccatagaaaaatatgctggtgactttgaatacaggaaatcatgcaaaagactatggctgacatttatgataacagcttttcttctaaatgcacaactctatgataaaatattgaagttatcaagaagaaaaagctcataataaaaaacactgatctagaaattacattctcctggtgagaatcatgtgagagaactggtaacctgtttggctctcaattaaaaacaaatctctgataaaatgtgagaaaatagcaaacaggtttattctcaaatatttaattttatatttctagcatcctgttacagtattgcaaagttcctccaattatctcttccctcctcccacccctattaaaaatataccaggaaactatgcaacaatacagtttttttaatgtaaaattgaattggtatactaaccattttttgccaaatcatgttggtcagtttcaaaaacatgattagctgcactgccaaaaaatatattttgtttgtgtggttcagagagaaatgtaaatagtgtgatatggttcatccaaggcatcttaatatagtaacatgcaaaagaaagtatataatgaaaagagattttcacacattatgacactgaccaaatacatatatttctttctttcttttttttttttttaaatagagatggagggggaggtctcactgtattgcccaggctggtcttgaactcctggcctcaagtgatcctcctgcttcagcctcccaaagtgctgggattagagtcatgagtcactgtgcctggcccaaataacatagatttaaagtttaaacatttagttctatgtcacagtaaccaaggtttacctgtttgtttcttttgtttcttttaatagaatttaattccttttcgaccttcaatccagttccaaggactccacggggtgagtactcttattgatttaacaaacaaatctaatgttcttgcacgctattcaacttttaaaatccgttttcagttgacccttttattataatcagccactcattctgtgagctttgtgactaaatgaaaatttctgacatctttaagatgcttgaattatcttattttattaacttacttttaaaaaattcatatatggttattgatattgacagtgtttttttatccataacatggataattgcatgtttgaacctttttattgaagtataacgtacatcaaggtattatgtgagtatgtattatcacagcttaacatccatacgggattatttatttcaggcaagttatgattgtaattgcttttactattaacaaaattttgctgtgtgtgcacttttttaagttgtatataccaggaaatgaaatatgtaagtagaaattgagtttttcatatatacagaataaacaaagttttctgtgtattttattactgcatttaaaagcacaataaatgataatgcctaataaaatggacttatgaattttgtctttatgatagatgataaagtttacaggagtagaatcagtactttaaaattattactattaatatttcatagtaataaaataaatagtagactcaattattctttttgcttcttcatttaaattaatatgtattctatatttgcctctatatattagctataaaatggaaatttgtaatatccgtaaatggatttttagagctatagagaaaacataagctgagggaggaagattcttgattattgtaaatctacagacttctgaatttttcttatgtcacaaaatgcaaaagtgtcaatttaaataaatagtctttctaacctttataactggaaaacagttcaagagtcagattaattacatcattcaacacaggccaagagtacttctaaatgtgttttgtaatgcttacttgaaggagatgtttgtgtggatgtcagagttttgcttctacatgacagctttacaattaagtcctgttttcctcttcagtgactaagtgttcatgaatgggatcctaactggaataagtattcttctgaattttgttgtatagctttttagtaggtagtcattagcacatgctgattttctatttgagggcttagttcaggtgtttatttaaggcttcttgagttttcctgcaaattttaatggcagcaataatatctgaagagatgtgccagggtcaggcctaattctaccagccctggagggctccatggattttcactaaaggattatcttgggagaagagggctagaggaagagtataaggtttgagctgcatttctcttactaggagcagtagggttctagggctgatgcttcccttaattctttctcctgggaaatgcaagtaaaggatattttctaaggaggcatcaagttatgccaaaaccctaaattatggggcaccaatatgtgcaggcttccaaactctccattctgacccttgcagtttttagcagtctaggagggagtatggttttctctagcatactagttgcccctgggccccaagcagcattgcaaagcaggcagtttatatttgaaatcttagaccaccttttctaaattttcctacctatgtccccctgtagctttcctgttccatgtgtccaagtgccctcagtttatctttgcctgctctactttctcttcctactttattccttgccttggtatagttcactgatggaagcaatttagatataaatgactgatgggtttaaatcttaatgggtgtttgaattttaacagataagctttttaacccaagcaaatggtgattggatttggtagagtagatgaggagtggaggtactatagactgagagctataggatggttgatcctaccttgcttattctgtctcaaccccccactcttttcattattctaactgggaacaaaatatatggactcagcattgttttagagcctgcagctgcattccatccacccctcccccccttctttttgcagagctctccccagctctttgggacttagtaaaaacaaagagtcattactggggagagagtgggttggcacagcccacagggaagacgcagggccaccgatgtgagggtcttctgtacactgctcctctgtttttctcgagagccatgataatttaatgttgccttgctgattgctttaaatcctctctgaagaagtatgcttacagatttttttcctatgtgaaatatgtttagggctttaaattaatagatttaaatttaaattttccacaaaggatacttttccttaatgagaaattttatttgtctttttacatcaaatatgactgaaattgtaccttaactgtcatgatactgtcatatataggcatatttgacgtataactaagcattgttaaaatatcgttttaaaactgaacatataatgttaaaatcattttctgtttccctgatgagactcacactaagcactgcatggttatactcttccttgttactaattataagatttttttccctcagtgatgtctttagaaggccagaatttgggtcttggctggttagcttttaagcatatttgcttttgtgcctgaacatgttcccttaggttgaagttttcttctaaataaatgcagactgaaatattaaagtatagcaatatgctgctaaagagtagaaattctgaaagtcattgattacctggatttttattatcacagttgggcagcagcctttgtagtattaaaaatataaattgtgacttcactgttcattttacccctgttccttaatggaaaaaggtgctcagaaaattagatggtcattgaaggcattttctggattcagaaaggtgaggaaatatctatggtagcagttgattctcatttctaaactcatgaatatcaggaggtgaataaatcatccaaaattgctttgctgattctgaagagagtgaatcaaccaattctcacagttctaatctgtacctaagatacttacaactaaaggtttactaggattataaatctctctagaacagcatatttagacagaaatggtagccggtacgttcacatgggctactgcattgtgatcttcaagttacaacattcagaggggtataatggtataatgcacccaatttccaaaagcaacatttttattgtgaagtaagctttataaaaatcaagatagttgtatctactgatctggtactgaaaatgtgacaggtgataattttccacagatgtgtttcagtacatttttaaaaactaaactctgtatttgcatgcttgttgaaagtttcttgtctaaagacacacagttaatagaggcagagctgtaactacagtcttgttcttcacactgctagggagaagttcttcctgccatactgtaatagcagttgttactgatgcagttatcaaccaacgtaattgttctaagcaataaactataaacaggtagcctaatcaatgaatgtgttaataggttaatttgttgttctgcttttttcttattcactgtgcaaacattctttcagcctttagtagtgccaagtgcttgttatgtactttgtgtgaaaagatgcagggatgggcatggcatgggctccaccctcagagaacgcacagtcttaacaaacacatacagactaatacttagaaaataattcataatgtaggattcatccagaaccctccactcagaacttctatggaaatgggggactatcaggaacaaggcgtatatgtgtatttgtcattggtatgaaatagccttttaaacaagggttttagtagatacaaaatgtcacatcttggcaataggtgtgtaaaattccagaagacctatttaagaactgtgtgtgtgcatgtgcacacacacaaaggtaagtgtgtggtatgttataattgagataaaatctgaaatggcaaagttttcaatagtgaataatgcccatatctgctggcatgtggtagccttacagagtggacttgcctcaggcctcagggactcatgtccagggagtaatttccccagggcagtgagaaataatgctaactttgtcacagtatatgagattctagacctcggtattaactcagtatttgttatgagaatattattcttaaattctttctaatttagttgcttactttcagactcagcaatcccagaggctttagaaaatagttttacataacataatttttagaaataataaaataataattattttttgagacaaggtcttgctctccaggctggagtgaagtggcacaatcatagcttactgcagccttgaactcctgggctcaagcaatcctccctcctcagcctcccaagtagctaggattatagatacacagccatgactggctaattttttgttgttgttgtagagatgggtctcactgtgttgcccaggctggcctcaaattcctggcttcaagcaatactcctgactgggcttcccaaagacctgggattacaggtttaaagcaccataccgggcctaatttttagaaatcatgtttaagaatttaagaagaggactgaaaatagaaaatattttctataagtaccatgcagtatctcctgtgaaacactgagtcacacacacttttcccagaatgaacaaggaatagccagccaaacaagttctaaatgtatgccttctaaaaaggcacaatgaccttccgaagatgaaattggcatttaactggtaactttaaaggcttgaatactgctataaaactctttcagtagagtcattaaacagagggttggatttttcttctcgtttttttatccccaaacttagcaaagccttcagagatattttgttaattatttattttactttgtggggggtgtggagaagattgggtttgaaaaacaaaattatacagtatttgaagttagtaggcaatttcagcccccttgaaaatgcttcctgcagattgtccttccctaccctacttggttcctggggaagcaaagatagctatcagcttgaaatacacagcaaagataaaaataaatcccccgcactgccataccttcttagataatatgccttccctccgacttctttcccttgatgttttggtttggctagcccactggttttgccaagggttgtgtttagtcagtcggctctgaatgttgccagctaacagctaccttgatactcttggctctgagtgtaattaataccagaagaatgttaaaattatatttctttataaaggtagttctgttttaatttttttaatattacagtggttaacatgcatagatatcatctaatatttttgctgaattacacctctttagccacctgttaatttactaaggtgttaataaaatagtaaattacctaatgttaaaaaaattttagtttttatatatacacacacacaacacgtacacacacactttttttttttttgagacggagtcttgctctgtcgcccaggctagagtgcacattttttaaaatctcattttacccaggagatgggctgcccctgggaactctggaaactgcatattttctcacacaataattgaatcatactttgaaactattgtaaattgactagagtactcggtctaggccaccccttgcccttgaagagctcagaatagcagagtgtgggagaataactttgattgtatgtttgtggtgcctgaggaaactatctcaaagtactcacggatcatacccttacacaggccccactgtgagctacagcaagacaagccccccaaagcatgagcacaaacaggggtgctcaccctgctctgtccttcaccaaactgcatcactttggaatgcagcagctggagctataactaatatctgaagctaccacaattgccttaaattgtattcttagcaatgagttaagcttactgccttcacttagcaaatatttgtcagtgcgcgatgtgtaccaggcaccatgatagacaggtagacactgtgtagacaaggtaaaatagcccatttgtattcctgacattatctgtttgtcgataaaatttgtcactaattggctttgcttttttgtttcccaccaaaaactgaacttgtagaattgagttatttatgttgcaggcagtatcactttaatagtactcacacttatttaagcttggaaaataatattttaccaattctttgatactttgtggtcccttaaatttaaccatcccttactctgtcacctatgttggagtgcagtggctcaatcatagctcactgcagcctactgggtagctgggactataggcacgcattaccacactctgctaattttttcactttttgaagagacacggtctccctatattgcccagcctggtctccaactcccggactcaagcgatcctcccgcctcagcctctcaaagtgctgggattacaggggtgatctaccacccagccccaccttcttgaggagttaggtttcaccttggagatcagtgcttcttatctataaaatttccctggagagctatgatgaggtttggaaacctggacttaaaacaatttttttcccccagatattcttaggatagctcgattcactgtcataacaatgtttggagactatacatatatataggtacgtatacattctcttctcaaaagaagcttcatgacttccatcaatttctgggtaacctctgacctctctaatatgagaaaactacatcagtaaatgagtggccttcaaatacatttacaaataattcacaggcaaaactgttttacatcacatagctttacacatatagatgtagacattcacacaactgaaacaaaagttccacaacatagtctttacccatacttcatcaatgtaccctgatatgttctattccattctctttcatttaaaaagaatcctagtcacaattcactaaattaatgccatgaccttccaatgggtcacaatctattatagcttaccaaacatggtaggagattatcaactatttaaaaaattttagccagggagtcatgtggtcagatttgcattttaacatgcttctccaatggctgccttgacttagtcattccttatacatgggattccttacatatgggaggagaagaagaagaagagataaggatggctctgtatttattacttgagcgtttggttaggtggtgaggccattattcaaatctgaaatagacgaaaagagcaggttgagacaggagacatgggtgtgtttggtttagaacatgttatccatgaggtgttcaggttacactccaatcctcattctatcagaatggagctgcccagggggtattcccattggagaattggaacaaaaggattttcaaaaagcaactccaaaggacattttattgggtttaattatacctggaaccttagtcgtaagaagaaagaaaaggtagatttacagatgaaattctgatgtgaagccctatttaaagagtaattttttttctagctgttaaagaatactggtttacatatgaatactgaaagcatgactattgttacttttaattactaatatttaggtaatttgaagctccttttgttaaattttgcccatattaattaagaacaatgacaggctaatagagattaagtgtggtatattcatttagtggaataatatacaacaatgaaaagcagtaacttataactctaagcaggcagaagaatacatacggtatgatgccgtttttataaagtttaataacaggaataatcagacaatctatttgtaggtttatgtatattataaaattattaaaaaccaaaaaagggatgacagttatgaaaatgagaacagtggttacccatgaagggaaaggcaggcagagggaaaaggagaggagtatggatggatgtgttattgctcacattctagttcttgagtttacaggttcttattatgacattgaacttcataactatcaagctatacttattttgcagaaacaaatatgttaaagttgttctcattatcattaaagataatttgtcatctttatgggttaaataagaaaaaccagaacatgtttcaatagatgccaaaaaggcattttaaatctgtatttcctaattgttcgagaaacataaaagaaatttttggagatgccaagttcaaatatgacaagactctaaggagaaaaactggatattaaaggtttaaaaaaacaagttgacaaggagaacagagaaggcaggtcttgttatctagagctagacaccagctaatatcttggtagtcaactacttgatagagttgctttgtcatctatcagtggagaaagaaagttttctctctgtctgtgatctctctctctccagtggaaagaaggtgcaggcagagttgctggtgttatcaagggtgtgggagtggaggttactttcctttctgagttaacacttgatgttttggagcagtggcattgtaaagtgtcctaggaaaaagtccagtctagaaaggacagattaggggaatgaaaagcagcagttggttgaattttaaaagatgaggttcttagggggcttagggtaataaaactcagaatgcaatagccaagtgattaaagaactaaattgggcccacatcagtagagggttggtacctaagcagccataggaaaagggcagttctttataatacatgaaaagcctagggtttaataaccacttagtaaggtatgttatggatatcttattttagagtaagaatataaggcatagccatatttatgaaggtagtaatactctactaatcaatacttagaagtttttgttatgactaatctgaatgctttttagtttttccttaatctagttatgttggtaatttataagtcagttttcagattaggaaagaaggtatttgagggtgttccatttccactgaatagtaagatgatgcttacttagatttccacagctgtttgaaagctctgtatttggctataacggaaaactttgttagggatgcttgatgttttgtgttttgtttctaaaggaagacagtgttttgttccttctttagaaaacttgaagaatagaataatgagtccaggattaatttgggataaagtcttttacttcataaattctgattctgtaaaaaaaaaaaaatctctaacctctttcaagaatatttaaggtaattggtcaaagggcaagtatcagtgataacctaaaatctagttattatttttatgcagcctttattgtttttctgattgaaaaacaaagtgaataaacatttgtaaagtgtataaaatacacataagaataaagatgagtaataaaagggtccctaatagtgaaaaacagttttattcaatttctttctagtcttttcttcttgctcacacttacatttttaaaattgcaggcttaatgtgtttattgcttttttatattcttttttcatttagcatgtatcatgagcattttcctatgttattaaataataaaagttgcttttaaatagctacctaacatttcattttatggatgcactatcatttagccattctcctattacatgtatggtttctgtataacaataatggtatgattaaaatccgtgtgcataaattattattgctatctttatttcctcaggatagattcctagatatggcatttattaggtcagaatacttttaaagttttcaataactgtcaccaaatcatttatcccatctgaatcccccacccccagaaagctgctgctgccttatattcccacagctgttcgaaagtgccagtcacaaggggttttccccagccaatattggatacatgttttttgaatttcaaaattaatcatttgataatgtctaaaaactgtttgacagcgtgatttgtttgattataatctgacatgagtaaaatactgcaatgttttaagatagcgtaaagtaacatccagtgccttgttgtctccatctggtattgctaggagtggttttgagtttttcattcctttatactattcatgctttctcccaatatggtggggagagtttttattttagtagttcatggactccctttgacaaaattactctatttctctaacttttaaaaataattattctatttatataactttttacatactgtattttgctattttgacatttttctttaccattgtttgtggtcataatcatttagtgcttttgaatttctaccttcatctttagatgcctgtcttctttaaaagaacattgcaaacgtctcacaaagcctagcggtatggatctctttttttcatggagcaatgctgtgagttattggccaggggataaaatgttttactactttatatagtttcattattttagagggactctgtggtatgtggttctacctcctagcagaattaaataactatctaaaagataagcaaaagttttgtaatatcagttattcaaatatagtaattaccttaattacccatatgtaaacctttgcccttttttgccaaagtgtctctttctctatgtgaaggcatagatttgatggctttgccaatggcctaaccatccttagaaatctttttagtcctatatttcttgcaattataaatcagtctgtctaagaaacttgacaggccctcttatttacatcagacatgccaacctcttagaaatcagaactgtagtctctaatttagctcttgatgtgttgtgcatatcaatagctttatacatgtgaaattagaaatagttttattttctttataggcttgaagaaaattaacaaacaaatttgacttatgaaaactgaatagaaataaattttatggagtaaaccagactctgcctcaggaatgcattttcagagtagatgttcggaaacagatttataaaaattaaaatactatatgtttggttcatttttagggctacctatagcttgatacaaaaaaaaaaaaacacccccacagactttaaaatactgtttgtatttatgaagattgaatgctttagagtcataaagttgtgattcccatgagaacccttaattctattttctttgtttctttgttgtgctgtagctagtatctgggactctgggaatctgaaagcagtatttttttttttttttttttttttttatggatagggcacttgggaagcagtgtttgctacccttctagaggagcagcaggcatctgtaatttttcagccttccatggacacctgttttagctgattcattctcataccttatctttctgtattttgagtttgagacagttggaaatattgctagttgttttcattatttgtttatttttccagataccttatttggtttccatttacactaacacttaagctttgacccagaagacttgtagccccttatttttctctaaattatgaagattcagaatgagtatagttaacttttgattatccgaagagcttgttaccagaaattacttcaaaaataaaacatctcattatagtaaggaaggcatgtgtgtgttagaatcaaacaggtcagaattggagtgggagctccccaatattgtctttgtattatcaaagcaaacattttttggcacttactgtgtaccgggccttgtgccaaacaccttagatgggttatctctgaacttcacatcagtcatatgaggtgggtaatatcattatctacattttacaagtatggaaactggggattactgaggttatttgcccaaggtaacacagatggtagattctggagccagagttggaaactgggtagtttgctccagacccaatgatctagcatcctagatgtggtccattagggctctctcttttcatccgtttgtaaaagagaagttttcactttcttctcaaaccattgagaaacaacttggaactggaagtgcaaagggagaattctaaagaaagcgttttaaaaaggagaaagaacaagaaagcaggacaccatttcctacctttggtattctccaaatagttggcaccaattctcataaaaaaaaaatggcacaaaatggtgcatatttttacacacacacttttgtaatgttcatttaagatttgactacaatttaattaattaaaatgatataccccaaatattgtatgtcttattgctgtttctccttgtttagcatagactgtggtcttgtgcctttggtccccagggaggacttaccacagtggctgcctcagcaattccagtctctcatcattccttccttaactagagcatttctgagtctgtttgtaatacataaaataagttccccgtaagacttactttgaaaaaagcattcggtaactttacccaagaaaaggctcaaaaacaattgatattgaaagcagagaattaagagttaaatatacttctaaatctatatggaaatattctgcagacttaactattgtttgtcttattggacttacaagttttcttggtgacattgattaggttggggtgaaaccatgtattttacaaaatctggggcttgggctttttgagacttctgttaaccttgaggacttgcaggtgtcaaataccagtctctccctagatttacacaactgctgctgactgcagtcatgaattctaagcccacttacatttgccagcagttcttcctggcataatgcaaaagaacgttgctcaaggctccagggtacaaggagaggagattggcaatgaattggaagttgcgattcatatttaagattttttttccttgtagaattcaggtttgggctttgtttctgagaaaccattttttaaaacaaaattctgcttcctatttgacaagaagaattactaaacttagaattatttagtatggttacattctaaattctttaaaaatacaaaatggttttaaagaggttgggtcatactttcaaatggaatttcgtgaagccagagtattcggcgagtgttttaataaagacgaagatactttttagaaagaaaaatgtataatatgaacttaagtcccacaaacccaggaagccacttggcctaggctttggggctaaacatagcataagagaggttagaaactttctcaccctgacatttgtaccacacagcaggcagctgtgtgggggtttttttgttttttgttgtttttttttttttacccttcctttcatcttgtaatttatttttgccttctctggggaaccctggttctcaacagattcttaagtcatctatttcaaatccatttataattttttagtatccctgacataaggcaccttctgagtgaatttaatctaagtttcttcagataaatctaacaaatatttattaggtatctactccactgtgtttcaaatatatataaaagtgggtaagaccggctgggcgcagtggctcacacctgtaatcccagcactttggaaggccaaggcgggcagatcacgaggtcaggagtttgagacaagcctgaccaacatggtgaaaccatgtctctactaaaaatacaaaaattagccggatgtggtggtgcacacctgtaatcccagctactcgggaggctgaggcaggagaatcgcttgaacccaggcggcagaggttgcagtgagccaagatcgagccgctgcactccagcctgggcgacagagcgagactctgtctcaaaaaaaaaaaaaaatgaggaagaccatggtccttgcctccaaagaactcacagtctggtgggagagaaaggcaaataaatgagtacttagcatatacaatgtagtgaaggcagcaatagcgatgagcgcctagaggtgaggggaccatggagactcagaaagcgggcttctaaacgcacctcactgagaaagcaaaggctcctgagggaaggactcctaagctgaactcacattaagttagcatgagctaaggcaagaagtggggacacagagtagcgtgttccggcacccagcaagcacggtattgctgctggacatgaaatacaatgtggagatgaggcccagttaaactggtttagtagcaagagtgctgacaaggaaacatatatactgttaagaagcttacatctactactcataagtagtaggaagtcatgaagaaataaatgacccttgagactgacagagtcatattgacattttgtaagaatagttgttgataaaaactgaatgattataggatggcagctgaatgattagatgatgggattgagaatggttcaaaagtggaggtcgaaaaccaagttgtccaagcaaaaggtaatactgagccaaagcagaggaaagaatatacatttaagaaatgtttcggaaggaaaaagcagtaagtcttacgattatgtgtttgttgaggggtgtggagtagtgtgagaaagaggagtcaaatttcactcatcaggatgccagtaatctcagcactaaatgaatgatggcttattaactgggcaatgtgggagggtggaaagatttaggaacgagatgataatttagtttatatcagctttgtatatttaaattttggaagggactggttaataaaacaaaaatgaaatgcagctttatgataagttgctgaacccaatgggaggttttagtttttgccaccaaagaagaacttgtggcttagcccagccatgactgcattttgaagaaactatttagattttctcgatggctgtctcacttctcttccaaaaccactttggcacttggttcaactttgcattcatttttaaacaaagtttctgttctctcatgctccatagtctgtatatcttttccctgatgcagtatctctagtactaatctgctatttccatctttcccctgccagtaactgtcatcaccccttttttcctggaaatacccaactaccaaacaacacacactcagacacctgtgttcttctaaatactttttagccatgaagctacaaaaatgaatcataagaaaactccctttgaagcccctttttagctgacgaaaccaacactggtcagttgtacagtatttaaaaataagaagtacacttaaccagttaatggattcatttacattaaggtgctcattatcacattcaaagtaaaatatacacacatatgtgtgtgtgtatgtctatatacacacatatgtgtgtgtgtatgtctatatacacacatatgtgtgtgtgtatgtctatatacacacatatgtgtgtgtgtatgtctatatacacacatatgtgtgtgtgtatgtctatatacacacgtgtgtgtgtatgtctatatacacacgtgtgtgtgtatgtctatatacacacgtgtgtgtgtatgtctatatacacacgtgtgtgtgtatgtctatatacacacgtgtgtgtgtatgtctatatacacacgtgtgtgtgtatgtctatatacacacgtgtgtgtatgtctatatacacacgtgtgtgtatgtctatatacacacgtgtgtgtatgtctatatacacacgtgtgtgtgtatgtctatatacacacgtgtgtgtgtatgtctatatacacacgtgtgtgtatgtctatatatacacacgtgtgtgtgtgtatgtctatatatacacatacacatactgaaacaattccattcttccaggcaaaataccctggagtcatccttgatttctccccttcattccttatatttagtatgtctaggaatcctgctgcctgtacctgcaaaatacatcccagatccatccatttctccctgtcctggtcctaggcatcattatctcgttcctggactttcatacatatgtgccacaatggcaggaatctttgtcagttttattcactactatgtcatagaaacctaaacagtgcctagcacagtagtactcagttaatatgtgtggaataagtgaattaaatgaaagaatcaattaatccatgtcatcttaccagaaacactaacatttagaaggctaatttcatattaatagagaagccatattaagagagccaaaaattactcaaggtagttttttgtaatttcagttatatagcaactgagtgtattgggtgtattttatttttaaaaattagtactttacttccatcgatgttattgtgtatttgtaattaaaattggttttgaaatgttgccgtcgatgatattttctccaaaatggtcataaatttaaaagaatacattagggatgagaatgcagttctcaggaattatttttctaataagactgtatcctacagaaataagagaaataggaaatctcagtattaggctgctatactctttaatccagaactagaaattttaatactggatccaggggaaccatgtgaaaaataacagggaaagcaatttcaccttactttttccttgcttaatatacatcttgctaaagaggaacaatggaaggaaataaatggacttatttttcctgaattatttattaattataattcctgaattattgttatatgacctgaattttggggataactgccaatatttctctttgtgctagaaaaatttggcattttgcactactctcttcagtaaaatagctatcatatggaaatttcagacggctctaatatgtgttggatcctctctaccctctgcccttccctgtcagtaggaatatttagctcttattgatttctctaatacttaactttttctattgccagtgaaggctaccctccccttcctactcctccacccttcagcattggtttgcacatctgggctgatgtgagaggcttttttttttttctcccctcaacccataatgtttgggcctaaagtcataactgcaggtctagtttaaaaaatagcacatgtggctttcaggttgaggtttctattttctgttctgattctagactattctgtccctaaactgtggagcctgaatagtacatgcaaatatatttctctagcttaaagtatattttctagattttaaggaagtcacagaatcaagagtctagaaataatttgagaacaacagagaattctaatgtttaaatgtttgcagtaagtttgtatctaagctaatatatagtctatatatagtcaaataatagattttagataaaattaagagatggactggcttcctgggatgccggaggggaggtgggttctgaggccatacaaattgggaaactattcagtatgaaaagacccacagcaaagaaagttattttgtttaacttggcatttcctaaatttatttgaggaaagaacccctctttcacataaggaaacttttcagcatgcttcagaaatgctggtggaaagaaagcaaacacttcagttctaggcctggctcaggcattaatccaccttttcatttaacaaatatgcattgagtgactactttgtgccacgcaccacttgaggtgctgacaatatattcagggaacacaacagacaaaagcctctgtccttgcagagcttatattctagtgaagggagaaagactataaacataatatgttagtattacaaggtaatgagtgtttcagacagccatggagcaggctcggatttgtagtacaggggttgtcaatctaagtatgactctaacttgaacaaatcactaagcctcattgtccctaatctataaaaaagaaattatagatgatcttggcccgctcagctatatgagtccactttaacaccaggaattgtcatgtcaaaccatggtactgctggttcactgagcatttacaatcaccttatcagaaaaggtgtctgtcaaacaagaattctgtaagtttgaatgatttgtaatcccacagaagaacaaaacacttaaataaatgaagaaaacccttgctggttctatttttaatctaatgtatacctcaatccaatattgagtagaaagtatttgactcaaggacaggaaacctgcagtaaaggtaccaacagcttttcagcagatgttagcattcacatatgagaaagttgcagcagtgtgcacattgtgcttctgccctagatccttatgtaaataggacgtccgtgacttgatgttgaaatgacctttcaggcagtattctgttgccacatgcctgagcttgtatcccagagtaattagacgttttgacttacacatcttggtatacagtgtttatgctaattataaatgtctgaaagtttcctgaaactttttctttgtagctttttatcaaagacagacaggaggttgggaggagggttgtggattgtggtcctaagcctttgattttcagtctctcatttttggaatgaaaattaaaatctgcttttccagttgccgagacatggtggtatatttttatattcttcatcttgaacaagaaactgtttggaatcacagcattttaatactttttaaataatattttattcttaaggcatttagctaaaaattcaagattgtgagtccctaaataaaaattattcccaactgacctgtaggaaaagcttaaaatactaaaattaaaatggagaagtttctatctcacaaaggaatggtcttccaatattgtttcaaaatcagacctcaaaacttatttcctgtggtggttacctcagtcctcaaagctgaccctaggtctaccagtagcagtcagtacattttcacttcctcctcctcgtatttcatgaacctgaaggctagtttttaagaaaatgctttataaccattttggaaaaaagaactgtgtagatacacaatggaataggctcctgcatatcagaggggactgacgcatatccacaggttcctctgaaactctgcctgaatggctctagattagacaaggtctcagacccaccctagctctggccttcaacagtcccacaggttctggtctgctctgaagttgccatagtttagttctaaagcttccctctcaccaacctgccctaattgtcatatattacctgctctttccaataagtctcctgctttcctgtccattggccaaattgttacacagccttaccagccataaacataagtgctaccttatatacccatttcattcttaagagtatacttggatattgatacaattaactttgtgtctaattaatacatcttcaagaaattagatgcactaagtctacaaacccttttgaaattttaaggatgtaaaatttgcctgaaaacatcttgctcttgaaaagcttcagattagctcagaccataccatctgcattgatgctgctctgaaactaccaagaaaaggcaatgtagaactctgattggcctgggcttagctcagaccataccatctgcattgatgctgctctgaaactaccaagaaaaggcaatgtagaactctgattggcctgggctccatgtccctttgttccctaacctctaagctccacttcagctccatagctgcaaagaaactcatgacgtgcatcaagagtcaccctttggtcccaaagtgaacactatttgccctgatgcctgcccctgccgtgtctgcgtactgctcaaatatacccatagtgttacacgcaggtaggagagactgttgagaagttctgctatcagaggtgaggacagaggtggtttgttactgatctttagcagtctgagaatcttatcattgtgtgtggcatatgataagaacaaggaaaaatggtagggattgaaagcactctgcagataagttactctgtatttcttttttttttttcactttattttttatttttatagacacagggtctcattgtgttgcccgggctggtctcgaactcccaggctcaagtgatcctcccacctcagcctcccaaagtgctgggataacaagtgtaagtcaccacacccagcctctgatttcttttctaaggggatgacctatttctgtttataatccaaaatttatcagccttggccctactgatattttgtactgcgtaattggagggaatgtcctgtgcagtgtagggtgtttggcagtatctctggcctcccactacatgccaatagcaccctcccagaccaaatgtcctctgggggacaaaattgccccttgttaagaaccactgttttaatctatgtgtaacacaaatttcaaaacactttggtgagtacatagcatggattatgattttttaaaaactttgtttctttttaagctgattctattctagtcatggtcatattttttaaatctgtagcttttttcctactgaagagacttttaaaaaacaagaatatgaaagtcttctgtgtccaccatcaggccaaactataatgctttaagagaaaaaaatgcatagaaagataattattttaccttaaaaagcataaatgttacttaagaagttaggattgggtggtttggaggatgagaaaggaaaaagctacatttaagtaacaaaggtttgttaagagctttctgtaacactctgtttagtggacatttgaactaaaggactccagccatgaagttaaaagttttcactaaaagaacactgcacatttgcagaatttgagtacagactctaatcactcttgaaaaatagggggaaaaaaactgtacaattcaaccttttaaaaatgcaatttaggctgggcgcagtggctcacgcctgtaatcccagcactttgggaggccaaggccagcagatcacgaggtcaggagatcaagaccgtctgggctagcacagtgaaaccctgtgtctactaaaaatacaaaaaattagccgggcgtggtggcgggtgcctgtagtcccagctacttgggaggctgaggcaggagaatggtgtgaaccaggaggcggagcttgcagtgagttgagatcgtgccactgcactccagcctgggcgacagagagattacgtctcaaaaaaaaaaaatgcaatttagagtctaccagatgggatggtcttacattctctgataggtatggaagtactgctatattcccaaacctgagctatgcagtagggaaaactttagatctaaaccgaagctggagcctcataggaagatgaaatatcatatggagatgagacctctttaaaaccacttttaaaatttctccaaccaggttctgcagatctagatgaagggttaggggagaagatggatggaagttaaatgagtcatgcctagggaggggatttcattcaggtgtccacacctttcttacctatctaggcatatcccttctctgtcagcagaaccctgctcttcccagagaaacaaaagcagacattagtgagtactgttataccagtatgcaggtagccttatgttctcttgtgcctgacgcaagcattcctttggctcctgtttgcctctactgctgtaggattaagaagttgccaatatatgtatgccaactaggcgctgagcgtgcacacccagtaagacagcctgatgaatacctacctacagagtaaattaagacttgttcacaaagttacagcactttagaactggggaaagttttgggaattaaagagtaacgttagggccctcaaaagatatttataaaatagataaaaacacagaaacttgtgccaggagttgtctctaatttcaaatagggagtcaaagatagtttaaattcatggatgatggaggctctatggagtattatctatctatagtatctttggtgaaatttgaccttttaaagctctatacaagtcatctgaatctcctttcaaaaaacatttttctttgatttattacttcttgttcatttattccttcaacaaatatttattatatgtctactatgtgccagatactacaattgtctcccttcttacctttttttctttttacctttttccagggttgggaggaagggaaggcaggaattggtgactgcagttctttcctataggtcaaggtttgggagacttttagattgagcaattcagtggttgcaggttatcttgcagggcagagcaaaggcaggaatcatacatgcctttgcccatgcctgtgcccattcatgagtgtgagtgcatacacgctaagcagcaagttagtgctgtcttcatcttataatggaaaggacagattttttggagaatgaggattataaaacacttttcccttccctacttgtctgctaaattactaagactgtatgtttgggagctgaagttcggttaagtcatattttacattcttgccaactaatccttttttttaattatcacctaacaccatgcagacccaagggaggaaaggtttcagacactaggaagagtggagcagttgaaggacagaagattccaattgcacacaccttttttgagcccctactacatatcaggcaatgtggccaatgcaggacctcagtggtctttaacaactctgtccctttgctcctgggacttctcatctagtagggaagccagcccttgaacaagagtgtagaaaatacatctgcctgtggtgaaaccccgtctctactaaaaatacaaaaaaattagctgggcgtagtggcgggcacctataatcccagctactcaggaggctgaggcagagaattgcttgaaccggggaggtggaggttgcagtgagccaagatcgcgccactgcagtccagcctgggcaacagagcgagactccgtctcaaaaataaataaataaataaataaataaataaataaataaataaataaatattaaaaatttaaaaataaaaataacaacaacaacaaagaaaatacatcttcctgttccacagtgtttcctggggcttagcctaggagtgacctacagaatcatctctgtaggctgcagaccctgtttctgtaaacatgaggatgtataatggcatcttaggacagcagtttttacctgtgaatgcaattatggcattaaccttatgctgttactctaagaagttcaaaaatactgctctaagaagcaagaattaaaatgaaatgtgtttttttattataagagccaaagattcggatatggactcttatctcagagattgcttcaatatatagaagctatttagaagggggtcatgtaagccaaagacaaaacttgtattgctcaaaagaggaagagctttttacaaattcactaataactctttcataagaactgtaaccatttgctactttgaaatgaaaagggttcctcttataaactaatagaaactattgagcagaagtgattactgacacttaaaggtagaaaatggaaataagaatctggtaagttataggcatgtttgccagattccttgaattgtttggtcatttaaatgctgcgaggatgtatatatcaaaagggcttaggtctaaaatgattttcactagaaaaaccagtaagtcagtcttaagacttttctatggcaaatttataatttgaggcgtttctctcttttcccctcattttagcttgtcaaaattcccaaaaatgatcccctcaatgaagttcataactttaacttttatttgtcaaatgtgggcaaagacaaccctcagggcagctttgactgcatccagcaaacattctccaggtaagtacttttcaaggtacactgaaggggaaaaattttttatttaagagggttttagaaaattaaacaatacaatacataatattcatccataaacgtgtattaaattgaattacagagctcatttatttatctgaaaaatattaagcacctactgtgtaatagaaatttcatttgtaatggggatataatcacaacagttcaaagatttttggtctaatggggcttttaaggtacagaagatattttttaacctataaaaatgcagtttttgaaaactaaaggcaatttgaggattttttttagaaatatttaattcattgaatttaagcaagaatcttatagcatatttgaggctcatactccagggtaaagaagttaaaaatatccatcttgcatgctttcttccttcttccctgttcaagccatgttctaaggtagaaggtagatttttaaacatctttattctacagctgcatggaaactagaaattaacccagtaaagcagtctctccttcttcttaaaaaaaaagaaaaaaaaaaaaaggaggaggaagacaagaatatacacacccacaccctagggtaccatgggacgcttatctacttagatcctctgtaaacaataagccacttgtttcactcttcattgctttggttgtttctgattaaagaataggcccttgagcaggagtttgttctgcccctggatatagacaagggaggttagggtctctctcatttcctcctcatgtaaggctttgacattagccccaagtaccctagaccagcgtatctctgtgacttatctgtgcagtacttgaaactatgtaagtacttgctcaatgtgggggaaaagaagaagcaaagttgtgtttccagcaggtacaggaggcagagatacaaaataagacactgacagagttttacctttatcctcccatttaaggtgtctacgtaactttttgttatttaatctgtcattttccccaaggatatattcatgttgctttctgaaaattacccaccttcaaacttaaatgttttggcataaattgctatattgtagattatatagacttttctgtgctgtccactgtgatggccactggccacattggctatttacatttcaactgataaaaaattaaataaaatttaaaacatcattgcacattcacactaaccacattttgtggtctcagtagctacctgttactatcatagtagacagcacagttatataacattttcactcttgcaaaatgttctattgatcagcactatgatagattatagaatcaccaagtattagggtccttagtgattgtgtgagtcaatcccttcatttcacaggtgatttatccagagttatgtagctggttagttagtggctaggctaaatgagaactgagttcttctaattcccaccccagtattctttacacacaacatggtacactaatttttaattgtggtgcttgtctctagattgttgttttattatagtgagcacattttgatatcaaattgaacaatgtccccttaggaattttattaaggagcttaatcctctcttcaaaagcattcatatcattgtaagtaatatggctttactcttacattataaataccctgtgtggttatttctaccttccttgtttggaaaggatttaaggtcacttacaaaactatgtatgatgcagtaagagaatagaaacacttattgtgaaaatattggggcaaatgtatcccctctgtataatccaaggtgccttataaaatgaggtagtaagggtataaattgaagtctgccactaggaaaacaaaagcactagcttttgttctcaggctttcacttcacagcctggcaagctgacctgtccataatctggcttcaccttttccattcaatttaatttccattttccttatggatcttttctctctgaccacagtgcatgctcttcaaggtcagaggctttcttatgccctttttctaatttcacagtgctgactgagctcaaaatacatgcttattgactcaacctggagataaaagggtaaaaacagatgctcagtaaataaatgttcaacaaatacaaattaactagtcttcttatctatatttttaaacttccttgattctcacttttctcatatataaaatgaaatcaatgtcacagtcaaaattgcctttcaaaaattccttaagtctacccattttcagacttagtgaaaaatatatagtctaggacctatagtgtataataatgcacacttaagcgaaggaaatggtgagctaggctagagaaagactaagggagcatttatatacatttgtctaaaatatttaaactttcagggtaactcggttgagaagggatgagtgaagaattctagagagtaccttcttgcctacagcgtttagctccgtttgttttgcataaagatctgttttctgacttcgcatgaggggcagtatgttcagcttattctcactatgtaaattacttagtaaataataggaagagatgttgaaatacaaactttctgccaccagaccttcactctattgcagtcattttctcccactctcccccctctctcccacttcctctgaggattaccttcccctctctcagcattcctctgtcagtgggttttttttttttcctttggcatgcaaacatgctcaagtctgtcttattaaaaaagaaaataaaaaacaaaaacaacctctcttacattcacttctcaacccaaagtctggcttcagtgcccaccattccactgaaactgcttccccaagggagctgtgacctccctgcccccaaaatccagtggatgtgttattggttccttattattctggacttgttgccagtgttgcacactgttgaccactctctcctgcttgaagcgtctgttccagtggcttacattacacagtactcttctggtttccttcctacctctgtagctgtggcttttcagtctcatgtggtcttcttttcttccttttgcttaaatactagtgttcttcacagttggttccctcctgagaccccttctctcctcattccttcaaggtcaccatctccaacactgaacttatgttctttgtcccagtcctgtctcccaacctgtccttcatcttgtgttcagtgtttcagtacatagcagcttccatatacctcgtgacctgggcatgatctttaacttttttcccccacctctctctgagtgtggctaactactgaccacgttttgtcagttccacttcctcactatctctggaagctgtgtactattctacactctcactgccctactctggttcatgccatcactgcttgcctgtaatccttcagtagcatcctaagtggcctcttttctttccttctggtgtcccccttcctctcaatctatcctccatccagattgagctttctgcaatacaaatgagttattttctctcccctgatttcagcctctcgttatcctttggataaggtccaaaacctgtaacacatgaccctcagagccctttgtgatgtatttctcattccctcttcagcttcagctgtaattgtccttcccaactttctttggacaatttgaaaaccttctttttgctcttcctggccctgcacagattagttgtcctccctgaacactttcattcttcttcccccttgcccagtcatctttctagatcacctcaggcatcacctcctctgggaagtccaggtgagattacctttctgggagtcctctgctccctggaatttgtcacactgtgttatgatttccagtttgtccatccttgtcacccattagttccttgaaagagggaccacaactgttagttcttgtcacaacctctctgcttcacacattgctaggcatgcagtccctgcccaataaatatttatgagatgaattaactggtttttgtgtgtgtgtttttcttaaatagcatttgtaaagacagttattagcaatttataaagattttatcagccaggtgcggtggctcacgcctgtaatcccagcactttgggaggccaaggcgagtgttcatgaggtcaagagatcaagaccatcctggccaacatggtgaaaccctgtctctactaaaaatacaaaaattagctgggcatggtggcatgtgcctgtagtcccagctacttgggaggctgaggcaggagaatcacttgaacccgggaggcagagcttgcagtgagccaagattgcaccactgcactccagcctggcaacagagcgagactccatctcaaaaaaaaattatcaacctttatttctttgtattataacaaagttacttctaattaagtttggatatagatgatcagagctgtagtgtcactttcattagttttatattccagtttgttttcaggccatagcaatttctttataaaataccagttatgactgtgaccatgatccccctaatattaacatgttactttgaaacagagccatcttctaggtccatgttaatattcatgattatttcaataaaaagtgttttgttctgttttgtttttttgagatggggtctcattctgttgcccaggctggagtgcagtggcgccatctcagcttactgcaaccttcacatcctgggctcaagagaccctcccacttcagtctcctgactagctggaacttcaggcacacgccaccatgcccagctaatttttgtagagatggggtttctccatgttgcccaggctggtctcaaactcctgaactcaagcaatccacctgccttggcctcccaaagtgttgggattacagggatgagccaccgtgcctggcctttaaaaaaaaattgctataaaaatcatttgccctgtgttttcttcaacatttgctaataagtaggtcatcttatatagagatttaacaaagtaaatacaaattctgcaaatttttaggaactttttggactaataatattaaagtaagctttaatttttgtcagtatgttagccttaaaattaatatattatttaaaataaaaaagaatgtgtggtgagtccgtttcaactagtcagtccagaccatgtatattgtggttttactaaaactaaactttttaactttcctcatatcagtgttagataattctttaaaatagttaacagttaaataaaacaactacaatgcccatcagaactctggtctcactctaaatactgattttttttctttttcaaaattttatggatttggtctctgagagctcacttcatccattatataaagaatatgaaaaaaagtgaagagaaggatcttagatattttaaatagcatttacatttaaaaattaatattagttattttaggattgcaaacttagttgggctgctgattttaggattatataattcttgtttgcctttattgtacaaaatgaaggtcatgtctaacaaagccactgacttacttgacagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtaggtttgtatagatatctttcttcctcttgctgattgattggagtaattcaagatcaccataggtaaataccagtaatattaacttaatgaaaacacagaaactagttttcagaacattttggataacatggtgagaaaaacaaagttatttgttctcttcagactgccagtaaattgaagagcatattttaaagttctatgactttcctaaatcctgaatcttcgttggctacttactattattttatagtactgggatctggtcacattactgcgtgaagttgcaatcgtggtaccgttgtgttttctttgtcactagatgatgtaatttcagtgatggatactatggttcttgttttgcctttttgtagggctatttttatagtaaaatctattagtagaatttatgggttgataatctcattgttgtagattttgcttacattttcagagcatctttgtacaacaaggatttttcattacaaaaatataaaatgtgcttatagcaaagcattacaacagagcattagactgatgtctctttggttcctcagttgtgatcctcatcctcatctatccattaattaagaccctatccgacccccatcatttttatcattagctcactcaagtgtctgtcagattgaagggaagtaagaccagacttgcaagatgagtctctcctttatgagcagtgaccttaacaactttaaggagtcaattcatggtgactattaacagtaatagaattatcaagagtgaggaggagctctttgagtccttggtcaatttaataacacaagtcactctatagtaaatgatgaaaggatattaatttggaaacttaaacgctcacagaaagtctcttgaagaaccaagtcccttaactagcatctttccagggtttggcttcattctacttctgtattttcccactgctgatccagctacagtacattcagctttgagaagctccactagtgtctttaataagtacttctttggaacaaagcaaatgctcctggggcttggtgcttagcttagatacatttagtttggtttaacaacaattcatcccctccccagatatttgtacccatggggcctagttccctgctcagtaagttactagcaatgagacttttcacctctctttcctgctgagtgaggtagcaacttccagcctcctttctttctcctttatccccagaagtaacttaattaactttctgggttagtagactaaatctcaaattgtttttaaaacacacaagatctaccacacttacatttaagtataaactatgaatgatctacccctgttgcttggaaaatgttgttttcctctgcccaataccaccattttataaacagtgaggcaaattgttgtgtttgacaaaggaatagaagactgaaaccatcaaaacaatatttttccttcccgatataactagctgaaaaaaaaaccctccccttgatttattccaaagcttgaaaatcagcgatgatgactgcacttttccattgaatggtccttgggtgtcatctgtgttcatgtgtttttgtttgttttcaaagagtcaagtacagtttgtttatagcttacacaacagacttcaacacccaaaatcccacagtccatacacttcctaatggtactgggaattttagaacttgcaaggtttcttatagatactacaaataatttacatacattttggaggtgaccacaggaaatttgaggttatcagagtttacatgtgaaccaaattatacctcccctctcctaagaagagctggcctccctctgtacaccctcttcctccctgcagaggcttgcatcgatctcggccaatccgggcactctgtaggccttttcctctttgctttgtcctcagtgtcctagccactcaccgtcacagcagtgttcttctgtggtcataaatcttttcttaacctcctcagccttttattctctaggtcaaataaccccagctccttttatcttttcttagtatggcctgtatcccaaccccttgattattttattgctctcctctggactgcctccaattcttcgcctcagagttcaaaactggccacactattcttaaaagtctgagcaaggccgggtgcgatggctcacgcctgtaatcttagcactttgggaggccgaggcgggcagatcacgaggtcaagagatcgagaccatcctggccaacaccaacatggtgaaaccctgtctctactaaaaatacaaaaataaattaactgggcatgatggcgtgcacctgtaatctcagctaagcgggaagctgaggcaggagtatcgcttgaatccgggaggtggaggttgcagtgagccgagattgtgccactgcactccaacttggagacagagcgagactccgtctcaaaaaaaaaaaaagtgtgatcatttctgaatacaggggagcaatggattcaagtatcctgattggcttttttgttttctgttttgatttttttttttactgtattttgttaggtcatgttttgatctttttcttttaaccttatccattgccagctctttctcatatattgttttccttccaggcagctcagtctgtatcttcctgcctctttgggtgtctcaaaactgtctgattcatccagttctttaaaatatcaatcacccttcaatactaacaaaacccagcacttattgagtgcctgctgtgcacaaggcactggttagcactcacatgtagttactcattggaatctcataatcacccaatgaagaatgttattattctctctgtattttacataccaaattgttggtatcagcaaatagcaaattatatgagtgtgatctcattaacaagttctgtgcttttcttaagacagtaagatatacccctttaattaataatagactatatcacataaaatgatgccagaagtttacctatgccagcttcgaggtacctgcaggacaaggtttctttcaacaatgtcagcctgggtagaagaccaatgagaataatgctgatcccactgtggcatggtggtagcgtgatgacggctgacagctagactagggaggaaggccagtttgaggcaatgaagactgtgttcctaggggtcacctggcctcattgcccaggaatatgagtttctgcaaccctctcgtgggcagaagaaaccaaaatctatttgcctagagaggagcaggaaaggctttaacctagaaaacattatcttccagtaatatttttacttgtattcatgacatttatatcagtggtaaacactgatataaaaaaaaaaatcactcgtcaccactgcttctaattcaccgatattttaagtctgctcactgacttctacctaaattttggaagtgtattaaattatgaatttttatatgtactaatatttgtttaggtgtacaaaataaccaatctaatttctaggattctgtttccaatttttccaacttccagcccaccctccttattatttttttcaatttctactctttgtgaacaaacctccttatttttgatgacagacaaatcatttaacatcttacttttctcaaatattaaaaaaaaaggtgggtatttgaactagacaagatctaaggtcctttgtagtgctaacattttgtgaatgttcagtatatatattttggtagtaaactttttgaaaaagtagtcacaaatgccaagtggtggagatttcccttgcaatggattatgtagttaaccatgacagagtcatgtcattgtcatgagcctgcagatgtttttaaagccttgggtctgtgttgccaggcttctggtcaggttccacagaatggaaaaacaactgcagaagatggctgcagtcccttctgtctttgtgatggatgttttaacaccttcctttcagactgtttactcaaagccattagactgaggggtaaatacttttgctatctttattaaatgaagaagctagaattggactccttgttatgaaacagcgatttagttgttgtcccagactacccaaccctgtcggacccactgctgctgtttatataaagagcccagggagttgattagcatttgggtctgggaagagaattaggttctcccataggttttattaaaatggcttttttctgaggcaaatataaaaaataaatcctttcttctgcccactttgaacctgacattttcttgctttactttttcattttttcttttagcatctcaattctgtaagtacctttatcactgatgttttcttcatctgtagcctgtctttccttaaaccagaggattccttccttgtcgaataggcacaaaagggatggggaggtagtgaacaagtgatctttgagtataattcagtggtccagtgtggctgagttgttctttcaagcatttgaatgaaatatgagttaacccctaacttgctgtctaaaagaaaaatgaggtaaaggacaaagtgagtgttttgggggtaggggattcatggggagatgacagtctagcaatgggccccaagtaaaactctagttctgtcttcacttgatcaggctcttactttcttgccaaacatcatacttatatcccttttaagggcaaagttagcctcccttatttgtcttctccatacctgctttggggaagcatggggataaacccagtagaccttggagacctcctgagataaggatcagaggtgaatcagaggtacagaggaggtagggcacctgaaaacagtggcagtactgttagtttctctttttatttttatttgccttgctgcttgaattcatcctaaatgaccagtcctagtgtgtgtagcttagctaacaaacattctctgcccatcccccttcccagaaagaaagaagggcttcactgttagcttggtttggaaaagagttaaacaaatttcttttttgcaagacttgttaagggggagggagtgtggaatttatagcattttctaaacttgtgaacttgactctatttttaaaaaatatttcctattaaaattttaaggaatgctaatgtttgttaacgctgttgcaactgggaaatggtggattaaatggtttccctttgccacattagaaatttcagtgtgtattcacactggcagcctggcaacgtggggaagtatggactgtgttgattcctgctcctctgcttacttgctctctcgctgtcattcatttagtcatcaaatactgatttaaggcatgctagtggacaaagcagccactgccctgccctcatagagcttatagcctaacacaaagcaacagcaaacattaggcatttgttcataaaacctttcccacaaagacttacaggcaggaaaattaggtattaatcaaatcacagaacctcccaaatgctaagtgaggattttaccctttgagcatatcccattaaaagcctcagttttctcatctgtgaaaggggacggtacctgccttttcaggtgaaacctagtgagataatgtgtatgcagctcttagcacagtgtcccccacataattggtgcataagtttccagctgatgtaagaaaaatacagaaaccccaatctaaatctatctctgaaactctaattataacttaagtttttgttatcattaggcagtgtccccttaatgttgagttcctttgttgtgtaatagtttgatatttgcaattggttttgtacagatagtaaagaaacataccagccagtagaggtttcagtttgagagcattcatcttttttcccttactggaggtaggatggaatcaaaacacacaggccttctgaccaggcctggggagcccagcatggacagaattactattcagtaaagctcctgccccagtgagctgttttcaccccagaccacagcttataggagctgcttttacccacccattatttctagttgttagtcttgttcctaatgcacttgtccacatcgtatgtcattacaagttcttccccttctttaaccagagggcatagaattggggcttagtgtgtcctaaacaagctaaaagattccacctgtagaatcataaaatgagagtctcacacagtttcatgctactttttgtctcttcagcaaggaacggttgctgggattgtcagtgaccaggcatgtctggatagcttcacacatacacataatgcccggttcacctcagcccacacatgttctagaagtagccacttgccaagtgtcagtgttcagtctaaacagcaaatgggttaaccacatgaacagcactggcccatgtgagaatggtgtgaaggcctcctttgtaccattttccatttctctaactcacatgtgtagtctcagcactgcagaggacagatttgtttgtgccctctgagactggttggttggttggttggttagttttgttttatgaatcctaaaatttgtcttggcctgtaaaaaaaaaaaatatatatatatatatatatcactaacggatgcctcatgatgttgacctcccccctctttgtggcttctgaacgtgtgaaattactaacgtaatgctcagccaagagtgtgttcttagagaggtctgacaggtatttctgacatttcaccatgttcactgtattatagtttgcttttcagaaatggcatatatttatttaagatataagttatcaagtctgttgttacagtttgtgttactagttattatctttctgtagcaaaatgaccaaaatacatgcattatacatattatttccaagaaatgattttattaaaataatttctaattcaaattttagaccatttatttaaaatgctttctgtttgcatgccttcttaaagattgaaataaagtggcctttattattatttcctctagaaatgaagaggtacctaaatcagaattgtggaaactgaggtgctcatattgtaacccacaaatgtgtaacaatgtcatttccactggactttagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtgaggacagctggagagaggtccttcctgcttaccttcttgttaaaatgttcatttaaaaaagcttgttgtcattattatcattattattgagatagagaaattttaggattattttgatcagtggtatgtgaaatacaactcctgaatattaagttaaatcatctcattttaagcacttaattaaaaactagttgaaatgtgagcattgtctttatttgggaccaacaaattttgttctcaaattccattaaaaagaaagtaagaagtgtttgttatctgtttttagtgttgaatacactaaagtattgccttaatttgtattgattattgtcggtgaaattgtgcaatgtattctattggcctttgattggtataagccagaacattttttgcctactaaatagtttaaaatgtatcttgccccacatactttgtgctgcccttattactctatctttttctgccactaagtgtgccaagatcagtcatttgtctgcataaaagcatatgaaattgtaatgtattagcagtgatcccatactttatcacaagcttacgtgtaagaaagtaggccattgttttttaaagtcagtggtttgttagactataacctcctacatatttttttcttccttccttctgtccatctgtcataaatctttatgagcattcagatccaccataaatggtggtccatcttttttactttttctaaggaaataacatttccaaagaagttattctgaatctcatcatttaaaaaaaaaaaaaaccctacaggttttgatctgttattcaaagagtaacatttcaagtctatttttttatccattatctcttacattcacaacataatactaaatgttatgaaagggtaagaccattgtctccaattcaggttagccagtccccaaggtatctcaatcaatcttaaggatctttattaagtcctttagcactttttggaaataatttaaatccatatgtcacatagcagttttaagagctcaaaagaaagagaataaatgagaatgagggtgtgtgtgttcagtttgatatctggagaagcagtgagagtcaggttacaaatcacaaagcatttggtaactgcatctccagaaaagttgtgaattagcttctcagtttgataatggagaaggcaaaatgactgcagaggcaattcacacatagactactattgatatatggcagtaattatgtgattgtgtatatacatatagatatctaaatatatatatatatacgtgtgtgtgtgtgtgtgcgcgtatctcaaagtgtagataaactttacccccaagcgaggcatgagagttattagtgttgatcatttgatagaatctagagcatcatctcatcctggtaacatattagaatcccttgggtagcctttaaaacatgccagtgcctgaactccacctgagaccaacaaaagccaagtatctgaaggtggggcctaggcactcatattctatatggccctaatgattctaatatacgagctgaaaccactggcctagtgaaaacacagaaaggctaacaacatcgaccattttttgagcatatactatgtgccaggcacagtgctaggcatttcacgtgcacgatctcatttatcctcccaagaaagatatcaggcatattcataactttgacataaaccaattatacctaaattccctttcctgaacattgctagcagctaacaaaaaaaaataaaatgactttgctctaataaaactgaccaaaagtaggcaccagagaaaagaagagccgcaagatacatacaaatcatcccaaaattggttattctgtcccagacaaactagttgggaaacaagttacctaaaataattaatcaggctttgcctgtgccagtagagataatttgcttatttgttacttacacagtagttttcagaaccctgtggacattattaattcatcaaagtaataggtttttaaaataaactaagatgttggctcccggtaaaatttgtacctaaatttaaaagtgcttaacatccaccaggaaatttgtgtattgctgtttattattaaactggtatgtattaataaaacctttttttcttagaatgaccttttatggaaaaactaaattttaacaatcagaaactagataaagttgaataatgtatccagcttaacatttggatatttggctcaagctcaacattcattcattcaattcaacttattaagtacctacagtgtaccagacactgttttaaatgctggaatcccaaagtaaccccaatagaaaccctgccctcatggagcttattcatgagacaatttcaggaccagtgaggagttgaaaggagctggggaaggaatcctctgctttaagtggagagatcagggaaccttttctcagatggctgcattttagactgcatttagactgcatttaagacttctacggcaagaatggcttggaggggcaggagtagaggagagagactacttaaagagcctaatattttgtgataagacttgctaacggttaggtgtagggagacaatgaggggaagaacggaatctgtgattatagctaggtttttggctgagcaattgaatggatattgagccattgactgagatgcggaaggatggaaaagaagtaggattaagggggagaagaggatcaggaattctgtcttatatagactccatttggaagatgtctattagacatatccaagtggagatagatgtcagtagatagttatatgtaagggtgtggttgtcagaggatagttggggctagagttataaatttaggaattagcagcatatatattgggtattgaaagtcttcaaacttaatgaaatcatcttaggaggaaatgaacagaatgaggaaaacagagcagaaaacaggcactaagtactttagcatttcaacatatagaggattgagaaacagagacttaaaaaacaaaggtcctaggccaggcgccgtggctcacccctgtaatcccagcgctttaggaggccgaggtggggggatcacgaggtcaggaattcgagactagcctggccaacatggtgaaacacatggtgaaactctgtctctactaaaaatacaaaaattagctgggcatggtgacaggcgcctataatcccagctactcaggaggctgaggcaggagaattgcctgtatctgggaggcagaggttgcagtgagctgagatcatgccactgcactccagcctgggcgacagagcaagactctgtctcggaaaaaaaaaaaaaaaaaaaaaaaaaaggtcctaagagaggcggaaaccaggagaatgtcctattacaaaaacctagaaaatggattgctgtgggggtgggggtgtcaatgtgtgtagtgctgggggtaaaagaaaatggaagcattgccagtggggcgtagtggctcacacctataatcccagcactttaggaggccaagggaagattgcttgagcccgggagtttgagaccagtctacacaatatggtgaaaccccatctctacaaaaaatacaaaatacaaaaactagccgggcatagtggtgtccacctgtagtcccagctactcaggaggctgaggtgggagtaccacctgagcccaagaagtcaaggctgcagtgagccatgttcctgccactggactccagcctgggtgacagagtgagaccttgtctcaaaaaatgaaaaagagtaagaagaaagaaaaaagaaaattgatggattgtgtttattccacctcaagaaatctgggtgtatactatattaacttatttgcaaatttgaattttgcaaatttgaattttaagataaacctattttctccttaatagaaacattactgttagaatagtgttcagctaagttgtgagaagcataaactatcatatttgttagtacttttaaaagacacagaaagaatgatctattccagtaggaagtcataagcaagagtaattttctcctagccttaaaaattaattacttttggtttggcacgtgaacctgtatgtttgtgtagttagttaatggctaagccgcgaaactctaggaattgcagttaagggataagaaaagattacacttcggaataaactggctgactaataacagtaatttgggggttctctaggcatatgttttcatttattggtttggggaatttcaaggactttgagtaagtggttcttcaggagaactggcagatataaggagcaagcgtggttatccaaagaaagacagacaaggttatcagaattgatactatttatgaagacagtgtttggttgatgactgaaaggaaagtttgtaacccaacatttgggcactgtttggtttctacttaatacaagtgatcaaggatttttattgtgactcaaaagtaatggactcaattgcccagaagtaaataaggatgttggtaatacagtagtccttatccgtggtttcactttctggggtttcagttacctatggtcaaccatgatccaaaaatattaaaaggaaaatttcagaagtaaacattttgttagttttaagtagcacgctgttctgagaaacgtgatgagacctcacattgtcctgctctgtcccgcccaggatgtgaatcatccctttgtttagctttacattgtagatgctacccactcattagtcacttggtagccatcttgggccattattaagtgcagtaagggttacctggacacatgcactgagataccacagcagtggattggataaccctctgtatgtcccccattagtcactagccatctccgttttcaaatcgactgttgtaatatcatagtacttgtgttcaagtaatccttattttacttagtaatggccccaaagcgcaagagtagtgttgccagcatgttggcataattgctctattttattagtagttattgttaatctcttaccatgcctaatttataaattaaactatcaggtatgtatgtataagaaaaaaacagtatatatagggttcgttaccatcggagtttttaggcatcgactgggggtgtttgagtgtatcctttgaagataaggaggggactactgtacaactgttttggattcctttgactaaaataattgatttttttaaaatcttcacttttttcctaatatgggcttattatctgattagaaatattaaaaatgcaatggccattctgggaaaaaaacatttagctgtgtatataaagctttaattcccaaaatgaagttaatggcatttattgagatctggcatataatacaaaactagcagtccctttggggccaattgatgtaattattttcagtgtaaatcctaaaggttgcctgttttaggttaggagatgatagtaaaaatacctaatgctctgtttttatacctcatactaggtagccaatctgaattctaaggacctctcatataccttaaaggattatgtttttaaagagcttcaaagagactggcctggatacagtgaaatagacagacggtcattggagtcagtgctctctaggtgaattctttttttcttgcttttaaaaaaatgtttctttaaaaattatggaaataagtcattattttagtcattgttattttagtgttaaggtgggaagggaagcaaggcaagctttctatcatgaacatttttaaatcatctccttaacacataacatgtgtgtcctttacagaaaactaaatccgtctcagaatgctgcaggcaccagccgttcagaatctcctgtatgttctagtagagacgctgtatcttctcctcaggtatgtcataaacatagaattatagacctgacatagatattaggggcctctaatcaggtcctctgatgtataagtgaaggaaatgagacccggagaagctggacagcttgcctgcccaaagccatctggttatggctgagcttagcctagaatttaggtcttggcttccagcccagaactttctccactacacagcactgcttgtcagagtacttaatgtctaccttgctttccatttttaaagtttacattttgttgtaagattatctactttccaatttggtcactaactagaagacttacccagtcccaaacaattatcagattatatggaaaattgaagatacttaattttgtctgtcaacatgttccagaagaatattttttggggaaaatggatttacaatcaacaaataaacaaaaatgatggcatgtttccatgttttctttttaattggatccttatcagagtactcccaatcagattcttctccagtttagagttttcccccaagagattcagctcatccaagaaaaaggtgagaaggtcctaggcagtactagagtgaagcctgcctgattctcagctgattggccaaactcagaactctctcggtgttctgggtgcttttgacagacagtgggacgcacctccccaccccagtactgctgacacagtgtcttccctctctctctctggaccttactcccaagaattagtgagaagcccacagatgtgtggagaacactaagcataccctgggcaaacagccattcgcacatcagaaaatattagaaacttattgtgaggaacagagggggaacaaaaaagaaaaaggaaaaaaagcaggtctgtccttgcatatatacaatgtctgtggaagtctcacttttaatgccaactattatgaaactacttctactctgatcaaattatatactaggtgccaaataaatggtgttaaattgaaaacaaaataatgagttgattaaccattattttctttcaagccagaatacaagctacagcattacatttaagcataaatgtgaatttatattttatagttttcaactatctaaatttcctttttaacttaaatactattattgttgttgacagattaggctactattaccatgattttttttaaagtacttccacctaattttaatggaccaattattaagacttatcttccaatctggtaaagagatatgtaacggtaaaaaaaaaaattaaatagcatttcaacagtgatagagataattagagaaactattctgaaagtgctggctgttcccactctaagacaggtggaatgataaatgacagccaaaatactcttaactggagcattttagcccattaaagattaaaataagtgcaggctattgccctttacctagctgtgttagttctcacagagtcaaacggcacaaattgctttctcttctcatttaatataactaggtcaaccacagccagcaatggagggtgactgcctctgtttaatactctcctgagtggtataatccacataaatcagcatagtctctcttggaacttagggtaaagctgtatgattagaaagaattcagtaagcacttcaagaaacatttgccagattctgctttttgacattaaacatgaaaatgtatttcacatttggttttgtgttgttgttgttctggtttagtttttgtttgggttttttgtttgtttgttttttgcttaagcatgaagaaagcgtgtaatattacaaccctggtaatattaatagtaagtaaggttacttagttgtttaaccagccatgcatgtattgaatttatttaattttagtgcaaactggctcacttttctccttttccctcccctagaaacggcttttggattcagagtttattgatcctttaatgaataaaaaagcccgaatatctcacctgacgaacagagtaccaccaacactaaatggtcatttgaatcccaccagtgaaaaatctgctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggtattttacctttagatgaaccagaagtgcatgctatcatgagtttgaaattacacagtttataattagtaatttctttagcaaatgacgtttcatttaattattaatcttagtgttgtgcttttgagcagtttttttttttttttttcattttacagcagttgttttccatctctttttggccaactattaaacatgatttctatattaataagaatggcatttgaaaatgactgtcatacttgagactcctttttggaaggtggacctttaacattcttttccatatctgttatgatattgtgcagcctcagcatgacctattatatgccattcttgaactgatttaatcagacacaatttgcaataagaatattcatttccttctttctcaatgaaacagggtcacccttgcttcaattaatattagcacaggggaaaggtcaactttttaataaatcaggccaagataaaatttcatttgcagattcataacatcatctttatttagagtgaaaacactttgtcttttgcaagactgttggctagcgttcgcttaatagatcttaaggtttaggggtttttcccccaattttgagagtcctgttttagtgaactaacatcaattgttatttgtaaaattagccatttcaaagctttaggagcttaaatgctaaatatctagagatccaaagaaacttaaagctttacctctaaagaaaagctaattcataaaaagcttgcttgcctaagatgtcctgagtgttaaaaactgacaaaattagatttttcttatttaaaaaatatgtcctctaaaacttaattccttgcatgccaccacatagaagatccaagttcaccatttggcattgctgccagttttaaaaccagaataactaaggcaaaattccataggaaaatatggctttggaaaaattactttaatgagtagagttataaggagtgttgtctttctgtattttgctcatgattctgaaagtctgtaatccttagatttaattgaccatctttgccatatgagagaagctctattttcttttagtgttacttccaaagaagccgctgtagaatatgatatgatatgtgcttttcttgatctagattggatacattgcatgtcaaagcatttctgtttaaatatttcagtcaatataatactatgtaatggcacaaaaggtaggtgtaagctttttccctcaacactcttatagttgaatttgtcaggtcaggaaaagaaatgaagtagaactctatgttcagagttcataagccactgggtaaactccactctccacactttccaccctcaggtggtgcttctgagtcaaaggctagagacaggaaaactggatttcagtatgttgagatctacatcagagttccaagtgttctcagagttggagacctggagaagcagacttagtctctttgaattctttactgaggatatagtaactttcagaaccagttgcgataattacaaagttaggaaagctctagacccacatcccctgcattttttggaatttatctggtgtctatggcagaagggaagccaggtgacctgcacttgatgcctttctctttaagactcagactatcgtaaaagcatgttcttttacccaagcatgaatttataggtgagcagcatgcactcagagtctatgtattaatatttgtttagggtactttgtcctttaaaatattaaaccgagaaattacctaacattcacttttatatgttttgccagtgggcatgattagggtttgagttatcagtttaaccctactttcaatgataaaaaattaccctgataaagaatctaaacatatcctctggacatggtgcatttaagcaaatggcatactgagggatttacatactttcactgtgtagccacaatgtttagcacttcttttgtccttaaaaaaaaaaaaatctgtttagtgttatgagtgctagagattataggaatataaatcgacattcaataataccttattttaaattactttaaaccaatgggaaaactttctaccaaattccactgtctgcatacaaaaaagggaggcaataaaaatacagtgaccaaagcagtcggctacctgactctattgtctcatccgccttgtttgaatcccatgaaaagtagatgttgatgtaaaatttgtatctcccattgtctggctgcatctgccaccacaatctttgaattgctgggcagatgccacaactgttgttgaaagaatagaagactgaccttgggttaagatggaattcctttattgtgcagacactgcagtagccagggtgctttaaatgcctggcgtcggttctgctggcgctggtcatagggcctctattgttcatgttcaattgtattccttgctcactgttgcttattgagatggaagaatagaatttgaggaaaagtgttccagatgtttctaatctattttagaattacaggcatttgataaccttcgtagttgatgaatgctctgattttgttttttttcttcataggagttaaagaggattgcactgcctccatggaaccttcagcaattgaactcccagattatttgatgtaagttcatatgtctgccaatggagagagcggcttaattttagaaagtttgcaaattcttttcccataatttgcaaatcagaaaagtaagaagttccagaaatagagtcctggagccacccttgcaattgaaaggctgccatttagcctgctcatcccaaatctacccttgtctgcatgagcaggttgtgcctccccccgctctgagctgtattcgttggcctttaagtatagagaatcctgtcctttgttctggggccaggctaagcatttgattatgaaagattttagggatctgactcttcaaagctgacagtcttatcaatgcacagtcattcacttgggtcccccaaagggatggtttactgctgacaaagtgcttgaacctctgcacataataatacaaagtgtaaagatagattgatttttatttaagttctgccctcaaattaatttttagaggagataagagtaaaatctgatcatttcaatttagtaatggttataatgttttcttgttgtgacaacaagttgctaaatgctgagctggggacatttttgtaactggttatcacagaaattataacttggacacataattctagcttttttgcagaataaaaggcctctgtaagaagaaaataattaagttgcaagagcctggaaaaatggagagggaaagagcaaacaaatctgactttggatagctttgaaaatgaacaaatgtgcaaaatagctagaatgtaaaagggaaaatggaatctgggctgtctgaacactttttttctattagtagcatctcatggtggacaatgttaaactatgctgtttagcccttttcatttccagagtaaagatcattttagatttaaaatgtgttacttctgcttaacagtagtgtgaaagctatacttattggggaatgatacagtatgaaaccataatgctggttatcatctcttaactaacaggaacttgagaaaccttgctgagtaccctctcatctgaggtagtgtatggttttagagttctctaggagggccttgaaaggcagctatcacctaccacttagttggcccaggaagggtcagttgtctgcagccagtcttccaggacagcctctggctctgctgctgagggggttcacctctttaactgcaaacgacttctccttagaagtctttaaatgtcagcccccttgagtagcaactgccaatgcagtgctcttgttcttttttgaattcttttttataatagtgacatatacttattatatacgacagaatcatgtggggaaactaaaaaacaatgctaaacttttgcccatggattcaaggctgttgtgttttgccaagttcattagttaatcccccctttttttgtttttgagacggaatttcgctcttgttgcccaggctggagtgcgatggtgcgacctcggctcactgcaacctccacctccagggttcaagcggagcctcccaagtagctgggattacaggcgcccactaccacgcctgggtaattttttgtatttttagtagagatggcgtttcgccatattggccaggctagtctcgaactcctgacctcaggtgatccacccacctcaagcctcacaaagtgctgggattacaggtgtgagcctggccttaatttcatatttaaaaggttttttcaggttacttatctaaggatggttcctggatctgccttggtgcatttctgtatgtttgtcatgtttctagtactatgtgattgttcgcttaatttatttaaataaacacaatttatattaactaaaaactagtcttacatagatatagcaaattttctaaaaatagtgaaaaagcgtggattttcagaaaaattaccaaaactacagaacttaagttgcctcataagaaaactaaagggatatactataaaacctaaatgatcgaggccgggcgcggtggctcacgcctgtaatcccagcactgtgggaggccgaggtgggcggatcacgaggtcaggagatcgagaccatcctggctaacatggtgaaaccccgtctctactaaaaatacaaaaaattagtcgagcgtggtggcgggtgcctgtggttcccagctactgaggaggctgaggcaggagaatggtgtgaacccgggaggcggagtttgcagtgagccaagatggtgccactgcactccagcctgggcgacagagcaagacaccatctcaaaaaaataataaaaaacctaaattatcaacctttgaataattcatacttaacgaaaatatttctaatttttatgtaataagaatacttttacttgtagttaagctatcaaaactgtttaaaattttttccatcaccacataaacagccaactgtagaactacaacaatttttcgtaaaagtaggacaacttttttcttaaaaatgccagtgtaaccaaataatctcttctataatagcaacacagttgttgaccacacaactgtggtcattgaataatttccctaaggaaattattaaataaaatactgaaggtatgcttttgagaaagcacgataaatatataacaaattaagtctaagttttaagatcggtttagctgtgttgctaatatatgcttatccccaggaacctctttttaccccggggctccctctggtgtacagtcaatacagcccatgcctaggaaggactgcttcactgcttggctggcagtgtaccttttatagctaagacaccaggagggcagctttacatcagcagactatcactgtctcaattatacttagaaaattaaacctctacactgtctaattcagcatgaataaaaatattaatgaggacactaagtttgctcactgcatcacttttctcacattttctgctaggcgtctgtgatattagtaatttaaacaaactgatgggcttatataagaccatttggagaggactgaactccaagattttatggcagtgaagaatatatgtgtacccccaaggggcatcctgaatctcctgccacctgcctgaaattgctttgaaatctcaatttttatttcaaaaactcaagggaagtttgcattaatgataggaacacagagtgcaaagaaccaggccagttccttatgtgatcccagttcccagatctacaaataagtaatactgtaatatgtaataggccaggcgcagtggctcacgcctataatcctagcactttgggaggccaaggcgggtggatcacttggggccaggggttcgagaccagactgggcaacatgacgaaaccctgtctctactaaaaatacaaaaattagccgggcatggtggcatgtacctgtaatctcagctactcaggaggctgaggcacgagaatcggttgagcccaggaggtagaggttgcagtgagctgagatcgcgccactgccctctggcctgggcgacagagcaagactccgtctcaaaaaaaaaaaaaaagtaatactgtaattctaagtttaataataaaatgctgttttaatttacttattattgaataaactgatgctctaggaaaatggtcttctcttaccagttaagagtaatttacatcccaaagtaaaacagatttatggcattttattaagaaagtaagttggactaatagtacaacactggcttttgttcaacatagtatgacatttaaatgtttgaaaagaactagagaaatatgcctttttttggtctaaccctcattttacagaatggttggtaatttcccttttgtgtttcatgtatttgcttggtcagaaatatgaggaaagggatagaggaagcaagcctgaggcactttgttgaagatgtctgctagcagcatatctgaaaggccaagcaacagactgcctctcataaagcagtaggtccagagagagctttgactttcagcactcacggactgcgtgacattctcctggtttcacattacccattgagtccttctgtctctctgtgacttgtaacagatgggttagcatccaccattagtgtggtagtgaattatcttggatagagaaaggttcaggaaactagatctgtgtaaatactgttttctttttacttagttgcattttagttccattgccaccatgtctttaccacatttactctccttcgttgaagctctcaaactctgtgtaataattttacctggaagatgtttggaggagtgacctggcagccaaccagtggcagagtggcattaaacattagtgacacatgcatggatctaatctctaaatatttggtttaaatctcagacttgtgcaatcatgtttattgggtagctactctccatttatcttttttcttattagaaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcaggtaaatggatttgtaactagatgggctgactttcatattttaccttctttctttccctgccctgctcaacctcagccatcacagtggcctttagagtaagtactcttgcagaccagcctcgctgctgctttaggaaactaaatatttgaaatagttcttgaaaataaattaacatagtaaacctgtatttctaccagtggaaaaaaaccttgtgccactataatgtatcacatattgagaaaaataccaaacacaactaaataggaaaaaaagttggatcttgagattcagctaactatttgattaattacactgccaacttagactacagctcataggtctggtgctatcccaaaacagtgctatttcaagtatttttctttaaacctcaatctgagatagaatagggaagatacaaacataggaaataaagagggcttaatacacagagatttggggtttaagtaaagaagtttgctgcttctagctacaaagacggatctttgttaaccagtcttactctgttttcactttcctacttgaagtggtaatattactacagctgacaaagagcaggagatgcctgcctgacctgtctcctgattatttttgtagttcttagcaaagggattgatagaaatgagtatttccctcccgtgtgggctagataactttgtcacacttcacggacacaggtggtatagtggtgcctctgtcccagcccactaccagtgttcaggctggagcctacgtgagacaatggatgagttttcccacaacagtaaacagcctgagagcatttgtgtcctcaagattcattatgtcttctactagagggccttaatctttttcaacaagctggcgagagttataggagactgccagaagaatcggtgttcagaggtgcaagaggttggtgacatggtggtttggggtttatttttttttctatatagtcatttatcaatgtatataattatactgaaactagaatataattccaaggattacttggttaggagtggttaatatttgtgtggccttgggcaagttacttaatgcctctttgccttgaattccccatccataaaatgggataatcattgagttatgaggaataaacataagtaagcacagtaaagtgcctggatccatgcctggtacttggtacatacattaggctattatcccccccaggcacctgactccccccctcaccaatccccacagaaaatcactgttactggtttccagtgtattctttcgaagtgtgtttatgtgtgtgatatgtgcatgtatgtacacatggtataaaatgtatgtacatatctacacaagtaatttcaacatatataccgtatttaattgaatctaaggtttcttcatttgtaagctacaccattgttttatgcccaataacttaaattatgatacattattatttgtactggtttcattgaaatggggagaaatgagcatcttacaagtaatggaattcttagaatactattgtgtttttctcttttaaactaatggtatcaagctgtccatattgttcagcactttgctttcttcactaaacaatataatgcatcttagagaatttttttatattggtacataaaacactttggcatgttttaatggcctcttagtatcctttgtatagattgatggacatttcaattttgtttactgtcttttgctttacaaacagcactacagtgaataatcttgtatatgtgtcattcactggggagcaagtgtgtccataggataagtagaattgctgagtcgattttgcatttactattttgatagctgttgccacattgccttccataaagattgtttcaagttacattcccacagtcaatatttcctatactcttgctgaatgcatgttatctatttgtattgccacacacaaaagaagttgttctcttctgatttctaatatttaattttgtagaatgttcatgaagaagtcttacaagaatatcagaagataaagcaggtaggtatcatcactgttgattttctgacctgtggttgaaaaatgttgtaaattctgcaatctcattcctcttttttttttttttttttcatctgcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccag

SEQ ID NO: 38008 - DNA, 39546 bp, Homo sapiens; identical to SEQ ID NO: 37623

SEQ ID NO: 38009 - DNA, 9522 bp, Homo sapiens
gacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatataggaactggagaggggtggggacaagtgttgcagcttagagagggacaaagggtcctgaacccgaaagaagccagccattaaaaatggctttggggtcaattcgttgtgcttaaatttaaaatggagacaagcggccattttgctaactcggcgttcccggaagaaaccgcaggctcgcttaggtttcagacccagctgtctgtccctgtctacgtcgccaggatcaacggttgccgtaatgtcataatttcgccaccagcttctagccaataggctgtcctgtcattttaaatattaaccaatcgagggaaagctgttttgagactctgatttacatagcggaccggagtgggaacctgggcagtaactgcctaaggaaggactccccctctgttttcgtggcgcacaccttcgtagtatactgaagggtgtgtctcctgggtttccaactgccccggtaatagtcttttaacctaatatgcgtcagttttgataacaacactaaggcagtacagaactaaagatgtaagcactgcgccagatgttgcttcatacatcttattctattcaactggtttattcaagattcaaatcaaatcaaattttgcttgaatcccagtgctcagtcagccataaatggtgtgttgcctgattgaaacttaaaatctccgtagggggcttgtaacatgcagacaagtttgaaagttgctttaggagaagccaactcttaactgctgggtaaattgacaagccttcgaacactgaactgaaggccagtaaggactaggcgctgggtgggggagaatgaagaggagacgtcattaaacttagcacatacactgtatctcctagaggactctcccttcctagacaactgcaggccgctttgtggcctgggaaattccacattcccttaagtattttactcatggtcttttccaggtaaagattttaagatgaagggttagacgtagtctacctatctttttattcaagtctagaacacgtttttagcacctagaagtttgctttctccattaaaaaccgggaatatacaataaataaaattagtgttaaagcagatttttacaaacttaaataccatgtaatttaggttacagttatttaacataaggactgtgtgatcttaaatctgcaatttctttcacacctgggaaataaactaaggcctgtctttggtgccagacaaggccttatacttgaacactgctgtgcaatcacaggctgccttgcctagataacttatctgagaaattctgatgagaaatgaaatttccagagtccctcacaagtaaatttttttttcttttttttttttttttttgagacgaagtttctctcttgtttcccaggctggagtgcaatggcgcgatcttggctcacagcaacctccgcctcccgggttcaagccattctcctgcctcagcctccggagtagctgggattacaggcatgcgccacgacaccctggctaattttgtatttttagtagagacgaggtttctccatgtcggtcaggctggtctcgaactccggacatcaggtgatctgcccgccttggcctcccaaagtcctggattacaggcttgagccaccgcgccgggcctaaatggttttttttttttctatgcctctaatggacctggtcacttattcccattcagactgaccgctctcctacctgccaactaactaatcagtgtaaccaaaatctgcaaacaaaattcagtattctttccccgccttttcccctttctcttacatagattatgtttttgcctgtgttagatgaaataattctattgcttgttctctcttctgtacaagtacccagtaagcaaattattaacttcttggtcatttatttctgaattttccaccaagacagtgtttatgtgagtcatacaataagaaccaacagaaatgtgtgtcttggaaacaggttgtctatccctggaccctttgagttttctgttcactttcctttggcttttgcatgctaaaagtttatcgtccgcgtttgtttgttttggttattctaattggacttggctgattggttgcatattggtggcagtagtagaatttgaattctggttttctggtcacatcattaagtgattagtcagtggagaggacaggaaatctggtttatttattaacctttttttggggtgtttttgtttgaagatgttgatattctctgtgaggacacagggttagagttggtgtttttctttctgactttacatgggatttgatgttttgtgcttgtatgcctctttccaccttccaaaacttgtcttttttgagtccaaatagttgtcgatatctgcaaaaccagtattcctgtgttaagatgatatgaatataaaatggctgccctgttataacttttgactttaagaaagtgttaggactaacaggagacaaaaaggaaatcaaggaaaccgaatgtctggtctcaataactgctatggcagaggctctacagcttattattaattttagtaatttcacattattgccccttcacgttctttaagtaaggttagaggacagaagaaacataatgttgttacaaattggactattgagtcagggaaaaaaaagagtgctttcaatatctgaataaaacaaagatttaatattttctaaaccttaacgagtttattgtaagggatgtgatgctggaaactaggaaactagaattttcttctaaactgagaatcagaattattcatattctcagcagtggtgccacctgagggacttctgatcttaattacatacttttatttctttaactgatcaacatgctaaatagataacctatggctctgtttttacccactttaaattctgttctattagcacggttagctttcctaattggcaataagattgagactatcttttttttttttttgagacagaattttgctctgtggcccaggctggggtgcagtggcacaatctcggctcactgcaacctctgcctccagggttctagcaattttcctgcctcagcctccccagtagctgggattacaggtgcaccaccacgcctggctaatttgtgcatttttagtagagatggggtttcgccatgttggccaaactggtctcgaactcaggtgatccacctcggcctcccaaagtgatgagattacaggcgtgagccaccgtgcccagaaaagactatcttattttatgaatttaaataattgtgaaattatccacttaagggaattaataaattataatgtaatcttaaattttagttggcttacataaagacttaaaatacatcaatttaaataaaaactcatttgtctaaaaaaaaatcaaaaattttccttgtgctttaaatgtgctacctctttaagttctaattaagagaaaaaaagtttaactgtgagtttcattagtggtcttagttaacagcttaaagtattttgtaaaaaaaatacttcacaatttttaaataacttaaaaatattaatacctcttttattaggtttttttaataaggaaaatatataatacatctaatcaagattttttttggacaaattggcttaataatttcattttaaaaatggcttctttattcttatactgtaaaaataatattagcagaatattatagtatacacaagtttagggttcatattctaaaaaacaaaaacaaaagctaatttaacttgcatttactaaatttcttccactagttgtactggttacatgagttaacatcactttatttattattctaaaattgtaaattattcattgaaccaaattaaatgataatagataatgtcatttttaaaaatggaattaaattttatgttactaattataaggattcaatgtgtgagcttaagtactgagttcacagtgtatgataactttaagaatttaggtgaatattattaaattgagtaaattaattctcaatctttggatacctggacaatttctaaattggagggtacaaaatacaaatcacaagaaacagtgtagttttatgcaaataacatttttacacagtttagaataaccattgataaacagataagagaacatatgattgccttagaatagatactgttgctttcgccactttagatttgtaaatcacgtactgtatacgtgtgggcgtagaggaccatgcaggttttggatgactgcctctgttttcgtcatgcctatgcgggaacacaattgcctgctttgtttaagggctatggttaatccaaacagctctgactctatcaagtactatagctacagagaaacacaagtaagcattcgagataatgactaccttgagcctttacttatttaaaaagttgttactgtttgttaatgtggtacattcaatttactatggattgtcactctaaaataagacttcaatctttttcttatttttatatagccatgatttatattcatatcttaatgtaataaccaatcttctctgacaacattataacaatgctggaacctccattttcagtacttcaaacaacaaatactgcttttatacttcagagcagatggatatgtgcttcccagtgtaaacacatttggaatctcactgagaaatacactatcactaaaaatacagttctgagattcattaaaagacctccagaattctggaagtaggaagtttcctcttcaaagtctacagaggaagatgaggtctgaaatagacagcttcttccttcttttacctgtggtattattctgttttgtccttttctccattatctgtctttccagtgatgaaattttgatctggccctcccaagtattaaaaaacaagcaaataaacaaatctcagttatattttactaagatattggcatgctaactttttgcaggtttgtaacaaggacctttataacttgactaaaagttcctaaataagaatatttactagaaaatttatttctgcctgtggcccacatttgagtcaaaataatcaattaggaaaaatgaacttgtttaactaaagttgaccaaactgatctttgaccaaactgatctttgagacctattcatctaagacaagccaattaaattcttggagacaatttgtactttaaggaattcttataatatttgtaattaccctcataacttttttttttgccctacttctgtgcttctctaatatgcagattattaaatgttgttacaaagccattgtcaaaaaaacaaaaaacaaaaaactaaacaaactcacatggttagacttgctcctttatgagatatttttaccaaaaatggaggagttgaaaaactctggtgccagaaatcgtgaagacatggcctacctaacatggaaatgttggttgtcagtggaaaatactacacagagatagccatagtgctgcacagccaatcttaagtgtttctagagaatcactaattgtttctagagaatcactaattgttttcttttaacattcttggtttatacaagaagagagtatccatactaaactcttttctactgaaaataatgtgcaaacataacatcctattcctagacagtttgtagtttttttctcccatttctattttataaatcatctttttaaaatactttgttgagtgaaatcagtccattgcttgatataccttgagcacaagtaaatagtatgccaaaaattaaatgtctttcagtcacagtttgacaaactcaactaccctgagcctatagagtggtaataattgccctactcataaagatggggtgaagattaaatgaaatagcacctatagaacactagttccagacgtggtatcatgctagtaaaatggctgcacagcactgctcaatgatgacaaaaagtgaagcttctggagacagactccaagtttgactcccagatcaccacatataagatgtgggactctgaggcaggtcatttaatctctctgtgcattagtatccttctctatacctttacagtgatggtaatagcacctaccttctagaagtatgtgaagattaaagatccttaatgcatataaaccactgtgtttactgctgtttgacaaattttatttataaccatctttacgctcctaaaaggacttgaagcagcttatgactgaagactttggtaggagttggccttctataaattataagaatttcataaattatttgatatgaaaatgccagttgatcatagtatgtttaccggggtccaacaggttgagaaaaaatacactttttttccctgaacatatgaaattagctctctaggcatattcctaaggacttaaagaatgataactatcatttctcttaaatcttccagatttggaaggatatatatattcagcacattgacagacaatcccagtagtcctaaattaaaagacattaaaaattagtgaaacttttcctacctttagcctgtgtaatcctggatgaccaagcataaaattaaattgagtagagtataccactgtaacatttcctgaaaggtattctaggctctgagtaatttctttggggtctgaagatcagtttgacatatcctcaagtatcatgagttcattataattaagaaaaagagagtaaatctggagaatgagccactttcttactactccttgacctcagttctttttttcagagacagggtctcactttgttgcccaggctgccaggctggagtgtagtggcgcaatcgcatctcattgtaacctccaccttctgggctgaagccatcctcctgcctcagcatcctgagtatctggaaccacagcaggtgcacaccaccatgccaagctaattttttaaaaagttttttgtagagatggggtcttactatgttgcccaggctggtctcaaactcctgggcttaagtgatcctcctgcctcagcctcccaaattgttgggattactagtgtgagtcactgtaccccgccccacttcagttctgaggaggaaaaaatatgtaataataatgggactttggtttgctgatttaaagattcatgtaaccttatcatccaatgcgcaatttgtagaataattaatagagacatctggtctcatgtttctacagttgctcatgccttgatagtagatctccttgctgctggctcagaagggtaaaagagcagaaatgatggggcttctctcattctatgaggaaatagacctatgtagaggaggctacctgtggtaaaaccttatcctcatcacttaaaattctaggcttattctctgaccatatcaagttttcaaatggtaaaagaattggattcaagagaaatatgaataaacttttgttttcacttttctccctcctctccccccattctcccttcctttattttcttgtccttagttttcttttcacttttttgtctactattatttgcccaaactcaactgtaggctagaacaaaaaaaaattgaaaattaaaatgtgccccttttgttgttagacttgcttaaacaattggggtaatgaaccttggacactagattttaaaacacacacatttgagcttcagtgcactgaaataaatatatttttaacaattaaaaaataaaattgcatgtttaaaaaatctgcagagaacaatacacgttgtgagatcttgaatggaaggaaaactgctagcctcaagagtggatcaaagatgctcagcaggcaacagagtaagagcatgttggagggtttagagagtgtgctcagggttctaggctctaaaaatcagacagtccccacggcctggccttcgtcgctgtatcttctttatgaaaaacactaagtctttttcctcactggataaatttttatccttcaagtttagatcaaatggaactttaggacactgactaggttacattcatcttttaagagcgtacagacattcaagggctagaggatgtgggtttactgcacaggctcattatccaacagctgtgctacctgggaaacttaacctctctgtgccttaatttcctcatctataacgcagggagaatgacagtaggtatctcataaggttgttggaacaactaaatgcattggtatctattgtgtaaagtgcttaaaacactgcctggcacagagcaaacatccagtgaactttagccatcatcattatcattgttctcagagtcaaatacaatatctcatatctgataaattacagaagtgaatcaatcactctctctcttttctccagggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatggaaattcctgttttatagcactcatatttacaataaattttaaaaatcactgttaacctaatagtccttc

SEQ ID NO: 38010 - DNA, 375 bp, Homo sapiens; identical to SEQ ID NO: 36999

SEQ ID NO: 38011 - DNA, 584281 bp, Homo sapiens
agagagaagattcaaataaatataatagaaaacgacaagggggatattaccactgatgccacagaaatacaaccaatcattagaaaatattatgtatgcctctatgcacataaactagaaaatctagaggaaatggatacattcctggacacacacaccctccccagactgaactaggaataaattcaaaccctgaacagacaaatagtgagctctgaaattgagtaatatcttcccaaccaaaaagcagcacaggacaagacaaattaacagctgaattctaccagatgtacaaagaacagctggttccattcctgctgaaactcttccaaaagcttgaggagaagggactgctccctaacacattctctgaagccagcatcatcctgataccaaaacctggcagaggcagaacaaaagaagaaaacttcaggctgatacttttgatgaacatcaatgcaaaaacctcagcctcaacaaaatactggcaaactgaatccagcagcacatcaaaaagcttatccaccatgatcaagtaggctttatccccgggatgcaagtttagttcaacatatggaaatcaacaaatgtgatctatcacataaacagaactatagacaaaaataacatgattatctcaatagatgcagaaaaggccttcaataaaattcaacaatgcttcatgattaaaactctcaataaactagatattgaaggaacatacctcaaaataataagagccatatacaagaaacccacagccaatatcatactgaatgggcaaaagcttgaagcattccccttgaaaactggcacaagacaaggatgccttctctcaccactcctattcaacatagtaatggaagtcctggccagggcaatcaggcaagagaaaaaaataatgggcatgcaaataggaagacaggaagtcaaactatacctgtttgcagatgacatgatcttatacttaacaaatctcacggtctcgccccaaaatctccctatgctgacaaacaacttcagtaaagtctcaggatacaaaatcaacgtgtgaatataactaacattgccatataccaacaacagccaagccgagagccaaataaagaacacaatcccactcacaactgccacaaaaaagagtaacatccctagaaatacagctaactaggaaggtgaaagatctctacaaggagaactataaaatgctgctcaaaaaattagacaacacaaacaaacggaaaaacattccatgcttaagatagaaaaaaaatcagtattgtaaaaatggccatactgcccaaaaacaatttatagattcaatgctatttctattaaactaccaatgagatgcttcacagaactagagaaaactattttaaaattcatatagaccaaaaaaatagcctgaatagccaaggcaatcccttgcaaaaagaacaaagctggaggcatcatgctacccaacttcaaactatactacagggctacaataaccaaaacagcatggtattggaacaaacacatataccaatggaatagaacagaaaacctagaaataaggctgcacacctacaactatacaactatttgatcttcgacaaacctgataaaaataagcaatgggtgccactgcactccagtctgggcaacagagtgagactatatcacaacaacaacaacaacaaaaaaccccataagcaatggggaaaagattccctatttaataaatgttactgggataactggctagccgtttgcagaagattgaaattggaccccttccttacatcatgcacaaaaattaacttaagatggatagaacacttacatgtaaaacccaaaactataaaaaccccagaagacaacctaggcagtatcattcaggacataaaaatgggccaagaattcatgacaaaggcgccaaaagcaatttcaacaaaagcaaaattggcaaatgggatttgattaaactaaagagcttctacccagaaaagaaaaatatcaacagaggaacagacaacctacagaatgggagaaaactgttgcaaactacgcacctggcaaaggtctaatatccagcatctataaggaacttaaaaaaaaccaaaacacaactccattaaaaagtgggcaaaggaaatgaacagacgcttttcaaaagaaaacatccatgcaaccaaaaatcatatttcaaaatgctcaacataactgatcattagagaaatgcaaatgaaaaccacaatgacataccatctcacaccagtcagaatggctattatcaaaaagtcaaaaagtaacaaatgctggcacggttgcagagaaaaagatccttatacactgttggtgggagtgtaaattagttcagctattgtggaagacagtgtggtgcttcctcaaagaactaaaaacagaaataccatttgacccagctatctcattactgggtattacctgaaggaatataaatcattctattataaagacaaatgcatgtatatgttcactgcagcactattcacaattgcaaagacatggagtcaacctaaatgcccatcaataatagcctgaataaagaaagtgtggtacatatacaccatgaaatcctaggcagccataaaaaagaatgagatcatgccctttgcaggaacctgattggaggtgaaggccattatccttagcaaaataacacaggaacagaaaaacaaatactgcatattctcacttgtaagtggaagctaaatgatgagaacacatggacacatggaaaggaacaaaagacactgggacttatctgatggtagaagtgggaggagggagagaatcagaaaaaataactaatgaatactaggcttaatacctggatgatgaaataatctgtacaacaagctcccatgacacaagcttacctatgtaacaaacctgcacatgtacccctgaacttaaaagttacaaataaaaaataaaaataaaaagcagtactgagtgctaacatttgtattaagaatatggtttactgggaaaaaatagacatttactaaaactgtggaccatttgtgtgagtcaaaaacccttatatatgttaggtataatgtaaagagcaatgctaaaatagctgcattttaagagaaactgtttaattttttaaattcatatttttattaacaagcacacattatgcatgacctgaaatcatatcatgaataaattagtgtatgcattatgagctcaatctgtcaatgggcttttattcgtaagtgctgccgcactcttcccaatataataatagtgctactttcattatttgaggagagcactatgtttgtacatggaattaaaaacagacaatgacacacttgtggggtcctacaaaaaaaattattaaaaggtggcattttcagccctgagaattacgttaatgcaccacccccacgctgtatctccttcaatgaacttctctctactgacaataaataaccatgtgtgtgagttggactgtttccactccctgattgccttcttgtcaccgcacctgggtagttcagaatcacaagaaaccccatgccacgtggcagaatgcacactgttcccacctcaccacactctactctctccatccagcgctagctgtagccaggctgtctcgcagtccagaatgctagccggagatcaagctttctgaagtgccttggctggggcccacagataaggaccgccaggcagtgctctagaagccagcagatgccatcaatcagtttcccacctgccagacactgagaatctctaacaccggaaatgtcctctgttgccagagctgaactctcacatgaagactccagaaggccttgccatgtgggcatgcagcaatcattgcctctctgtggccacaaggaaccaggctctttccatggctagtgagttgtccagcacacttggggctccggaaaggcccctttacaactttaggccttagctgagctctctatttacataaggccaggcagtgcacattatgggagacacccctgggtaccgggatgatgatggcacttggcatgtgagctaggattgggtgcccatcgctcttccccaccaggcagtggccagctagtttctgtccccttaccgacctcctttgctacaattgcatttctggcaggcagtgtatcaaggaagcatccgcagttttggaccatgcagagaaccactactggccaagcattcccaatctgacagcagaacagtacagcactgctgaggtgaacttggcaaagaactttgagaccatgaaggcagccaacacttccaagtcatcacaacctgcttctcccatagatttattgtagaccatctcaaccatctccatgtcaacaagaaatggtcctcactctaagccatcacctttggatttagatcatggggctgtcctttctttagaatggaactgaaaagctttaatttctataaaaacgtaaggttttggaccacagccttattaaaacaaacaaatatgagcatagttgtctacatatggagtatctgggataaactgccacttgaaagtataatcactgtctgtttgtttgtttttgagacggagtctcgctctgttgcccacgctggagtgcagtggtgcgatcttggctcactgcaagctctgcctcccaggttcacgccattctcctgcctcagcctcctgagtagctgggactacaggcacccgccaccacatccagctaattttttgtatttttagtagagacggggtttcaccatgttagccaggatggtctcgatctcctgaccttgtgatccacctgcctcggcctctcaaagtgctgggattacaggcatgagccaccgcgcccggctttttgtttctttagcctgataggacaatatcagaaatttccttggtcacagaggatataaaacatagtttgaacaaaagcagcaataaagctacaaactattattcggtgtatttgcttaagtataagacagctgactggggctttatcatgtaacattagtttgcttagttttcattaactctgttgaacttaaattgaattgtgaatacacatatggctaattcatattgcaattaaactgcaaattgacataaactgtacataaaaagctgcacattgtcatccaaaataatgcttaggtaaaaccaagaatacaataaaccgatgtcaaggaacctaccctaaaataaaaatacagtcaacatggaactgtaaaactagaatgagagaaacatttacccataaaatcttgtttggaacatggatacaacactagaaaagaatttttctaaataactaccatgttcatatgtgactgtgcatctatgaagaccaggcattctgaatcattgccctgtggtgtatggcagtacaattttacagaaaatgtgctacaataattaataaaattctctaatgtcaaaattttaatgaataagtatttacactacaaataactatttatattactaatacattgatactattattttacaaaataaataacctgtaatacagcctttaaaagcaaataatagcctcacatttctaaatttaaaaaatacaaattttgtgaaatatggttaagagtaactgataaaataaaaatttgggcataaactatattatagtttggacagaggttgaaaaaagtggatgaaaatcttaatgagcccttttgtctgcactaaacttaatcttacaggtgaatattataatatatatagagtacctactagctatctaatttactttttacacaatgtataaattctaccatgttgttcttaatgtttgaacctaaaataacacacaaacatacaggagaacaaaataaggcagaaatgtatggagacagtgacattatcaagatgatggaataggagttccctacttttatattcccttgcagtaaaaaaaaaaaaactagtcagccatccattaaccaaagtaactttatgagagagccaggcacagtggctcatgacagtaatcccctccattcagaagactgaggcaggagggctgcttcaggccaggagttcaagaacagcctggacagtatagtgagctttgggatacagggcattaggaaactgtgctaaaacccaagatcaagaagagtcactttgagaagacaggccctttgattaatgaagtgtcatattatccaaagcaatctgtaagttaactcaaatccctatcacaactcctgtgccacttttcatagtaacagaaaaggcaagcctacaatgtacatagaactacaagaaatactgaatggctaaaccaatcatgaggaataagaaaaaagctgagggcatcatactagtgacccacacaaaacagttcaaaagtcactgtttgtagataacctggggaaaccttgctaggtactcagtgggagccacactcatccacgcatctggtattaggcccaccatatagcagaaccctgccctagtgcctgctccacagaaagccctgaagacaatccagtctgcccaaaaacatgataggactcacaaccacatgtgctcctggtaataagcccactaaaggtaaaacccactccagatttggcagcaactttgtgacccagctacaaccctttttactgcaagcccagaaaagatctcatcaggcttgagacccaaaagatgaagatctttacctactgaaaccagttcataaaaatgaaaagaggtgtttgctcctccaaatgcacaaacaccaatgcaagtctatattatgaccattctaatggttctatttgaacatagaactggaagtcctacgtaggataattaagcaagaaaacgtagaagatcaaaattgaaaagaagaaaaaaagtcactgtttgtagatggcataatcttatatatgtaaaatcataaatagtccaccaagaaatagcttaaactaataaatgcattcagtaaagtagcagaatatacaattaacatacaaatatcagttttgtttatacagagtagcaataaaccagtaaaaaaaactaatttacaatagcaacaaaataatagatttcttagcaataaattcaaccaatgtggtgaaagatctattctttgggctcaacttttgcgtgctcttaatcaactttaaaaattttaaaaacaataaatttctgccaaatcaaaaaacaaacaaaaaacaatgcaacagaatccaggtcttagataaagacaaccatgagttaaaaagaatgattcaaatttatttagctggtaaaaaaaatttgcatatatttcaagaagcagaagaaaaaatacatattaagttgtcccgatcaggcatgggggttcacacctataatcttagcaccttggcaggctgaggtagaaagcaaccttgaggccaggagttcaagaccagtctggacaacatactgagaccctgtctctacaaaaactttacaaattagccaggcatggtagtatatgcctgtagtcctagttattccagagggtgaggcaggaagtccttgagcccaagatttccaggttgcagttagctatgattgcactccagcaacacctctaagtcctcagtcccctctcatcttgggaggacacctggaatcacaggacagtgcagtgtgacagcctgtgtacagaacagagcctcccttcgctaagaaagggcatctgcctccagctgccgctcctgcacttttgacaaaacttctgacaccagatgtgtggagtttcctgatcaccaaccagttctccaacaccactggttgctcaataattcaatactgacaccactcagtttgcacagaccttgcaaggccaggcctcagtcccacatcactgcccacacttcaaaggccagtcacatgcaccagggacccacctatacttcttgagtgactgcctgtaactctgggactcccataaccgcatactcaagttcaataatttgacagaactcctcacagaactcagcaaaacatgtaccagtttgtcatgaaagtacatctcaaaacagccaaatgaaagatctgtatacagcaaaggaaagtggcaggagaagattgggtgcgtaggcaatcctggtaaatgcatgtgattgaagaaattccccatcctttatgttctcaaagaacagctgaatgaaaagaaacactcttctcattttgacttagatgatgctccctttttttttaacctattacaaagccagacacggattgcaaattcccatttttgtctcataaacaatcacctgaacaattctctttagtggtaaaaaaaaaaagtacttgttcaccaaccaccacttaacccatttatgctggaggtggcaaatttttttgtgtgtgaaaaatcagaccatggtgatgaccctgagcagtagggtcatctagcagtaggaagtataaataactcccacaagcttagtgctccaataatggaacactaggcataaatgggttagcttctctctttccaacaggcccctgaactttgacacacactcagcctgagccaacaaataattcctctttatgcccctcctaaacacaggctgacctcagggtgaaacattctctgatctaggatctaattttggcacctttcatcctgtcctccccttcccacattctttctagttttgtgtgttcctctttaaataaagcccttttctgcctaacatttcagatgactgcagatatagttggtatttttcccgttgcaatattcctttagaattaagtaacttttcatgtatacatatgtaactaacctgcacattgtgcacatgtaccctaaaacttaaagtataataataattttaaaaaaatcacccaaactacaatggaaaataaagaaaaattctggaggaaaaaaaataaaaaaataaaaataaaaaatcaaaaaaaaaagaattaagtaactttttatgtaaatataaattagctttatttgacaaagtctagaaacagcccaggacaatgaaatttatcctcagaaagagcttctgaacccgtcttccaacccaactacatttgcatctgcctatggatctcccactttccaggagatccgtagcttctctcaatgtaaagggctcttccgtgcttgtgtgagcaggctgggacacctgcagaggaggctcctcaggaagaaccgggccttcaatgaccttcttttgcaggctcaagattggccttaacttagagtcactgggctcagacttctactttccagtcagggctattcatttagttttaaatgagaaaatgcccagtttgaagaattcagcaaaatcactcaaagacagtgtttataaaagggaataaaattgtaagacacttacattttatatttcaaaaggaaaggcaaaagtgtctattcctttcagataacaaaaacgtcaattaaatatttctataacagatcatttaggaaacacttactaaatgtgaacccttctaagaggagccatgtcccatctcctaaaacttagcattgaatttggatgtccagataattaaatacagaacatttaatgtcacaaattatccaccctgtaaaaaagaggaactgatgtttcatgaatctatataatttaccaattaatctaccatactgtcttgtgaaagtgagtttcctataggcataatgaaaaagagacgtttcctatttttctccccgatagaattcccaaacttaagccctgagattctgtttgaaatcacccttaaaatagaacagaactaagaaacttactacactcactctgatgaagaaaaaggtaaatgagttttttaacaaatgaagtatatgactacatatttttttcctagaattcaccacgttcataccctttgtaaatattttctaacctttcaagctctactgataaagtgtaatatatacttaataaaaaactgatgatgaaataagtgaacaaatctttttaaggtgacaaactcagggagaagcagtactacctggaacacagacacatccgactcaagcgtcaagtcaggctatcctataatttgggacattctcccacccctcattctgctcactgaagtgctcactgaccattctgtctggagacactgcactgtgcctcacggtgtgccccagggatgttttgctttgcatgttctcgcaccagctcactggagtagttattgcttgtcctttggactagtttttctcccttcacaagtctgagaatccagagggcaggaattatttctgtcttttcccaacaccactgatgtgtctccaggcaatgaaattgggggttgggggagaatgtctaaggggttagctttttaggtgaagggtgtaccagaagacttctctcagccccaggacatccagctgcttcactgagaggctccatctccatgccataggctgtcctctgggaggaaaaaacccaggaaccaaaattcactagatactccaagagacatagccactgtgggcatcttgggccattcccagacaattctgaaattcaggactaggataagagtggctgaggagccgggcgcggtggctcacgcctgtaatcccagcactttgggaggctgaggtgggcggatcacgaggtcaggagatcaagaccatcctggccaacacggtgaaaccccgtctctactaaaaatacaaaaaaattagctagccgggcatggtggcgggctcctgcagtcccagctactcgggaggctgaggcagaatggcgtgaacacgggaggcggagcttgcagtgagccaagatcaggccactgcgctccagcctgggcgacagagcgagactccgtctcaaaaaataaataaaaataaaaaagagtggctgaggatacaaccagctgtaaagtttccaaagttttcaaagattttgtacaaggcgtctgtgcctaggaaagataaaaagcagagtggcacaaatatttctttacaatagagtgccaagaggttattctctgccttcacaaacagataacaaatctttaaagagttccacaaacatgggtaactagcgaaacccaatctctacaaaaaaataaaataaaaagaattagctgggcatggcagcacacacatttaagcctagccactcaggaggctgaggcagaaaaatcacttgagtccaggagttggaggcttcagtgagctatgacaatgtcactgcattccagcagcctggatgacagagcaagatcctcttaaaaacaacaagtcaggcgtggtggctcgcccctgtaatcccaacgctttgggagggagaggcgggtagatcacgaggtcaagagatcaagacaatcctggccaacatggtgaaaccccgtctctactataaatacaaaaattagccaggtgtagtggcgcacgcctgtagtcccagctacttgggatgctgaggcaggagaatcgcttgaacccaggaggcggaggctgcagtgagccgagatcacgccactgcactccagcctggcaacagagcgagactccaactcaaccaaaaaaaaaaaaaaaaaaaaaaaaaagccgggtagggaaaaaacaacaggccaggcgtggtggctcacgcctgtaatcccagcactttgggaggccaaggcgggggatcacgaggtcaggagttggagaccagcctgaccaacatggtgaaactaaaatacaaaatactaaaaatacaaaaattagccgggggtggtggcgcgggtctgtaatcccagctactcaggaggctgaggcaggagaatcgcttgaacccgggaggcagaggttgcagtgagccaagatcgcgccactgcactacagcctgggctacagagcgagactccttcttaaagaaaaaacaaaaacaaacaaaacaacaacagcaacaacaaagagtgccctccaatgttctgtgaaaaaatgattaattaaaatattgtgcctggagtacgcaataaaagacaaatagctgacagtgttgtgaactgaagaggtgatggtggtttttatgaattttggaaagaaactgaaaatttagtattttattgcaggccagagtcaggctgggagaacagaggagtggatttaagaccctgctttccatgttatttggaaaatgcaggggaaaagcagtctcttgtgcagtgttaaaataattagcaggcaattagactgaggtggctctagtgtcttgcgtttctacatgaaaaagaatattaatagctcaaatgcatttcttgttaatgactgccttaagtagaaacaaaatccaagttcaaccaatcacaaaactccaattaatcagtaattaaataaccaggaaatttccacctggacagtccaaataaggtgactgtaactgtcgtcaattattaaatttggcttgcttcctcatgcaccttacaaaaaagtttttccttcaagcacctcctccataaacccacaagccacacaccatagctgggcgctctcccattcatgaaactccctttcctcaaactcttcaaagctttaaaagtgactccatttttcacaggaaaaaggatggactgcacagctaagataagccccatggaacagctcttcccacgcatgtttcgcacaccgatttggcttctccccgatgaccctcccctctggacaaagcacacagtctgggggacccgcggggctgcggcttcatagccgcccagagaggccggggcggaagccgcggcgcagtgatgggaggagaatcccgcggcggcctggccccgcccctacccagaggtgacagatcccacaggtgccagccgggactccgggccgcggactctagtgctgacgccgggaggccggaccgccatcttggaacaccctcccgggaactctcaccgttttccggctttcggggtgtcctggcatcttagctatgtaactcccagtacctgcaggtcacagggaaaccagacactgcagcagcagagtcaccagggcctcccgcagctggggataaatagccgagaatacgggaccaaagctccagctggagcacaagacaaaggccccgccagatcccggaaaccccctccgcctctcaagctgcgctcctgattggacagttcccacgtcaatgtccctgattggacagggctccaggacccgcctcctttggttatgagtgacaggagatgaggtcagcaaaggggttgaatgagactattaacaaaatgggcaattttttttgtatccttccaaaattgttccatgtctttccatgcataccatctttaataaagggcgcactcttaagccaatctgcaatctctgttcctgagtgtctaaacaacgtcatcatcatcttctgttggagaaaaacctgaagatgagttttcctcccaaagcacagaacagtcagaagccgaggcgtgcttgggaatgctggcgggtggaaaggggaggcgcattccggtgcgcctgtggaactgtccttgcaagcaggacccaggtccagaacagctatgcaatgcatgtgtttctgaccaaagggggcctgctgtccacccgcctcttctgctgggcagggcagcgcatggttggggtatttacacccaggcaggtgtcccaggccagtcccctgtcaacccatcataataaaaaagtcagaatctattttcaaaagtatattcaaaagcatatgtttaggatacctacctgagagcatagactaaagttgccctgattatacattccaactagtaaccattacaagtgggttttaagaaaagaggcagttcctaaaattttcatcaaaaatttacattaaaatccagaagtcactgactggctatacattgttctttgtatcacaaattccagatgagacagctagttaggaacaacatacctttaaacaattgcccctgggaaagggtgtggagatgtgtctcaaatcccatactcaagtctctctgggccagaaaaatcttccgtacctcacagagcttcagctacttagagctattcttttcttatctccatagtcagtacacttggacccttaacaagaaataagttcaaacagaaaatttgccaagccacaggaataatggcctgtcagtgcccttcaggaagctgattgtcactttccttcaacaccctttccacagcttccccccaacacacacaccctggatcccgggagagaggggctgagacgcacccagacacacctcgctgcccctcctgcaaacatacacccacacacagacacacagacaaagacacagacacaggcagcttgaaggagagcaagagagagggatggagacatagaaacggagggagagaaagacagtgatagagaggcagagtgagtcaggattgagagagagagagagagagagaaggctacagaaagagcacgaggtggagggggaagaagaagagagaggatgagggacttacagagccatagagccttggagagggagtgttctgctccggtagacagggcccctttgagcaggacagggtagggtggagggtgcttgggctgggccagaacagggtggaagggctaacggagtgacccaacagagccctgagacgtattttttgttggattggttgctttggtggtgcgtttcataggacttttcctttgttggctcctccctgtcctcttggtgcggtgggccccgagatttgtagagtgcaaccgtccctctagcgagagctgtggcaccgagcatgcccacggggcagaggcctgggtctgtctcgtgtcctccggaatggagtttatacgaagttggtggcaatgggattccgagtgcacagggacggttttcctggtggctggagaaggcaatgtccttcccctggggaaagtagcccatgcgttctggagcggaggtcttggctggtgtcttgtggggcccgcttcccctgcccgccccttcccccggcttggacagtgccagcggcgctggatgagtgaattaaattccctgggcgtcccgggagagggaagacaccctggacggcagggaacccgcccctgagccttcgaggttggccccggcccggccctccccgccccgccccgggcagcgagctgggctactgatggggtggctgccaggcggaagagctgggaagctgctaactggcggtgctgcagtggcggacgccccacgaggaggtcccagggtaccgcgagggcgcaggcgggcggaaaaggaggagcagagtcagggtgcggttgggaggcatcgcgataaaaggaggaaagtgggagggaccgggaaaccaaaaagcctacagcacccgttattcccaggcggtctcccagttaagtactaaccaggcctgaccctacttagcctcgagagatcagacgagattggacgcgttcagggtggtatggccatagacgcctggcagccctaagagctccgctcagtcttgcgcgcccgactccaggcatcccggcaaccccgggtccacggggctcggatcaagtacccctgagctgctcgccggcggccgggctggtctgctctccccctctaccggccgctctccccctctacgcccgagcaccgtccaccgcgcgctgcgccttccgctggcctcccagagcctcccgcagtagctggtggccaggccaagcgtgggacagccacagcgccgccctgctgccgggcgtgggcgccagaggcctctgtctcctgcacaggcttcgggctctcgaggtggcctcccttccgccgaagctccaggcctttccccagctcccgagctcccgagcttccactacatcgggcccgctcaggaccgggtgtgctccgagacgtcagggcccagggcccacggtcctggtatccccgccggtcttctgtcttagcagtgagggattgttttggatccctctgcaaggtcccctcttgccccacccacccagagcctctagggctggccaagggcgatcagccgacccagtcctgcgggccctctttctcaaaacgccttcaaccctgtcccctgtcccgacgaggacccagcccgtgggcaacaagggggccgggtgggttctgctttgccccgcgctggcaccaaagccggcagcctgatcctgggagagaggggctgaggcacacccagacacaactcacgaccaccatgagcaaaaccacccattcacacaggggcgcaagcttgcggccacacacacacacacacacacacacagcttgaaggagagcaagagcaagagggatggagagatagaaacggagggagagagagacagcgatagagaaacatagtgagggaagagagaaagacagagagagagaaggcgacagaaagagcgcaaggtggagggggaaaaagagaaagagagagggtgagggaactagagagcgaaagcgatagagccctggagagagagcgctctccaagccatagagagagagacagggtgagggaggagagagagaaagagagagagagagagaaaaggcgacaaaaaaagcgcgaggtggaggggaagaagagaaagagagggtgagagacctagagagcgagagcaatagagctttggagagggagcgctctgctctggtagatagggcccctttgagcaggcctgggtaggtggagggtgcttgggctgggccagaacaggctttgggctctccaggcagcctcccttccgctgaagctccaggccttcccccggctcccgagctcccgaaaccacatcgggcccgctcaggacggggtgtgctccgaggcgtcagggcccagggcccacggtcctgggtcctgggatcccctctggtcgtccgccttagcgctgagggattgttttggatccctcgctgcccctcctgcaaggccccctcttgccccacccaatcagagccgccagggctgcccaagggcgataagccgacccagccccgcgggccctctttctcacaaagccttcaccaccgttgcctttcccgaggaggaccctgcctgtgggcaacaaggggtccggcggaggggcactgtttgccccgcgctggcaccaaagccggcagtctgatcccgtgagacagggggtgaggcccacccaggcacaactaatgaccaccacgagctaaaccaccgcaccccccccccccacaaagggtgcacgcgcgtgggcaaacacacacacagacacacagacaaagacacatacagagacagcttgaaggagagcaaagaatgagagatggagagatagaaacggcggaagagagagacagcagtagagagagaggcagggtgagggtgaagacagaagggtgagagagagagagagagagaaaaggtgacagaaagagcgcgaggtaaagggggaagaagagaaagagagagggtgaggaacctagaaagcgagagccatagagccttggagaggaagcgttctgctccagtacacagggcccctttgagcaggctggggtagggtggagggtgcttgagctgagccagaacagggcggcagggccgcccacgagggtgggccaatggagccctgaaacgtgttttttcttggattggttggttgcgttggaggtgtgtttcgtagggttttcccttaatttgctccttcctgtccacttgttgcggtgggccccgagatttgtagactgccccagtctgtctggcgagagccctgacgccgagagtgcccatggggcctgaggcctgggtctctcttgtgtccttgggactggagtttacatgaagttgttggcaatgggattccgggtgtacagttacggttttcctggtgactggcgaaggcaatgtccttccccccgggaaagcagcccgctgcccctgcccgccccttcccccagcttggacggtggaggcagcgccggatgagtgaattgaattacctggaggttccgggagcggaaacctctcaggactgcagggaacccgcccctgcgtctttgaggtcaggccctggcccgccgctccccgcacagcaagccaggctcctggtgctgtggcggcggcgaggtggaagaggtgggatgccgctacctggtggtgctacaatcgtggacccccacgaggaggtcccgggctgcagcgggggcgcaggcgtgcagaaaatggggagcagagtcagggggcggttgggaagcagggcgatgaaaggggtaaacagggagggagcaggaagccaaaaagccttcagcacccggtatttctgttgtgggaaactgaggacgagagagacctacatgggaaaacaggaggatgtttatattaaggtacacactgattcagtggattcccattcaaaaaaatgagctttgaacaaaaacaagagtttggtttataaaggctagcatacaagagcaaaacaaaggcagtaaatcatatattgacaggtcacgtaatctatagcataactgatgacttcatataacttgcggctttgtagctgcttcgaaagaaaaaacaagaactgtctaaatacagacatttgtcttttttttttttttccttcacgcttgctccagaggaggggtgtctggagcctattccgttggttttgacttcagggacagcattaccttataactgtctttgaagtgagcttgctaggcagaagaaaacttgttcttttttttttttttttaagctttgccttgtcacattctgggccttggcttttacttctcagactaggtcaccacaaccttcttatagccttgtctgttacttttcttggagtgaatgaatgccgtacttattgtcattattttcaaatttctgcctcagttttcccatttgatgcttttataaacaagattttaatagaaagcatcactattacttgattctttttgaaagaacagtttttcttttttaggcacaggctgatatttacacagagccattagctgagtggtggtctgcctagctacaattgcctctatagttgatttaatgctcttaacaaggaggggtaaaaggcaaggaagtatcaagcaacctcctagtatggctggaactactcctattaaggttttgagtctaccaaaagaggtgaaccagcctccaacgatggaatcaggagtccaccctttccaggtctggactggaacatgggctaattttctcattcttgcagttatttggataatagcttttctattgtcatcgatttctaggcagcagttagttagattaaactttgcacatactcctccttcctgggctaggagataatctaaagccagtctattttgataaatggagtttctaacttttgtggtctgctgggccaataagtctaatgcatttgctgtttcattagtgataatttcaaggactgcttgcaaacttatgatgcagttaagcatgtaaattggggtgcggtacccccatgacctatcttgtgcccaggtagctggtccacagtattgaattattctttcaggtggccaatctgtgtctttctaatctcctgttttatgtcttttttatgtctacatttctttcgtttcttcctttaatttcatcatagacaggataccctaaggtttccttgtgttgcagtggaagcaaaaagaaagatggcctaattgttctgagtacacaagcccctgtccatttggctggtaactgttggtaggcctgtggcccacaaatccaatagagaccagagggtgcctgccaggtatttggagcttcaagctgataccaggtatgatttagagaagagaaacaggagaatggatttggatgaggtaatttggaactatttttacctcgcaagaaagtttttcttagtgtttcattataatattgcagtgctaaacatattaattctcctactgggtctgtaaaagcttttcctcagcgagcaacacagtatcccctgatgaaataagtttttaagagccagacgcttgaacctgtgggcatcggttcgggggaagagtcagtcaaagttatcttgtggcattaactcttttgctttctaagtccattggtctcctatgttagttcctccacaaacataacatgcggaaacgcctaggctgctggcagtgttttcagccagctgagcaaacagtttctcagctaaaggaggaggccctggtaacttctggtctacatgcttatagaatgacttaaagacctggaattgttgctgggccggacgggtctgggttccttttttgataacatataggtagggtatatgataacatataggtaggttgctgggtactttcttatgtagacatgtatggggtaacctgaagtccacgtgggtaagcctggctttagaatggtaaagtttataggggtacaggtttttgtttcacaatctggttttaccatttagtaagcataattttagtaagcataatttagtaaggcattttagtaagcataattggcctctgttgtgtgctagggtgccgtgatatacaatatctacagtctttttctgtggtcccaggggaacaaagtggcgttattcttgatatgcatatgtatttgtagtcatttctatagtatctttcttatattattattattatactttaagttttagggtacatgtgcacaacatgcaggtttgttacatatgtatacatgcgccatgttggtgtgctgcacccattaactcgtcatttaacattaggtatatctcctaatgctatccctccccccaccccacaacagtccctggtgtgtgatgttccccttcctgtgtccatgtgttctcattgttcaattcccacctatgagtgagaacatgcggtgtttggtttttttgtccttgggacagtttgctgagaatgatggtttccagcttcatccatgtccctacagaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgctcctatttctccacatcctctccagcacctgttgtttcctgactttttaatgatcgccattctaactggtgtgagatggtatctcattgtggttttgatttgcatttctctgatggccagtgatgatgagcattttttcatgcgttttttggctgcataaatgtcttcttttgagaagtgtctattcacatcctttgcccactttttgatggggttatttgtttttttcttgtaaatgtgtttgagttcattgtagattctggatattagccctttgtcagatgagtaggttgcaaaaattttctcccattctgtaggttgcctgttcactctgacggtggtttcttttgctgtgcagaagctctttagtttaattagatcccatttgtctattttggcttttgttgctattgcttttggtgttttagacatgaagtatttgcccatgcctatgtcctgaatggtattgcctgggttttcttctaggatttttatcattttaggtcttacgattaagtcttattccatcttgagttaagttttgtataaggtgtagggaaggagtccagtttcagttttctgcgtatagctagtcagttttcccaacaccatttattaaatagagaatcctttccccattgcttgtttgtgtcaggtttgtcaaagattatatggttgtagatgtgtggcgttatttctgaggcctctgttctgttccattggtctatatatttgttttagtgccagttccatgctgttttggttactgtagccttgtagtatagtttgaagtcaggtagcatgatgcttccagctttgttctttttgcttagtattgtcttggctatgcaggcccttttttggttccatatgaagcctaaagtagtgttttccaattctgtgaagaaagtcaatggtagtttgatggggatagcgttgaatctttaaattactttgggtagtatggccattttcatgatactgattcttcctatccatgagcatggaatgtttctccatttgcttgtgtcctctcttatttccttgagcagtggtttgtagttctccttgaagaggtccttcacatcccttgtaagttgtattcctaggtattttattctctttgtagcaattgcgattgggagttcacttgtgatttggctctctgtttgtctgttaatgatgtataggaatgcttgggatttttgcacattgattttgtatcctgagactttgctgaagttgctcatcagcttaacgagattttaggctgagatggtggggttttctaaatatacagtcatgtcatctgcaaacagagacaatttgacttcctcttttcctatttgaataccctttatttctttctcttgcctgattgtcctggccagaacttccaatactatgtggaataggagtggtaagagacagcatctttgtcttgtgctggttttcaaagggaatgcttccagtttttgctcattcagtatgatattggctgtgggtttgtcataaatagctcttattattttgagatacattcaatcaatacctagtttattgagagtttttagcatgaaggggtgttgaactttgtggaaggccttttctgcatctattgagataattatgtagtttttgtcattggttctgtttatatgatggattatatttgttgatttgtgtatattgaaccagtcttgcatcccaggtatgaagccagcttgattgtggtggataagctttttgatgtgctgctggattcagtttgccaatattttactgagggttttcccattgatagtcatcagggatattggcctgaaattttcttttttcgttgtatctcagccaggttttggtgtcagaatgctgctggcctcataaaatgatgtagagaggattccctatttttctgttgtttggaataatttcagaaggaatggtaccagctcctctttgtactgtacctctggtagaattcggctgtgaatccatctggtcctggactttttttatttggtaggctattaattactgcctcaatttcagaacttgttattggtctattcagggattcaacttcttcctggtttagagttgggagggtgtatgtgtccaggaatttacccatttcttctagattttctattttatttgcatagaggtgtttataatattatctgatggtagcttgtatttctgtaggatcagtggtgatatcccctttatcattttttattgcatctatttgattcttcagtattttcttctttattagtctggatggtggtctatctattttgttgatctttttaaaaaaaccagctcctggattcattgatttttttgaggtttttttgtgtctctatctccttcagttctgctctgatcttagttatttcttgtcttctgctggcttttgaatttttttgttctgcttttttagttctttgaattttgatgttaggatgtcgattttagatctttcctgctttctcttgtaagcatttagtgctatacatttctctctacacactgctttaaatgtgttccagagattctgatatgttgtgtctttattctcattggtttcaaagaacatctttatttctgtctttgtttcattatttacccagtagtcattcaggagcaggttgttcagtttccagatagttgggtggttttgagtgagtttcttaatcctgagttctaatatgattgcactgtggtctgagagactgttggttatgatttctgttcttttgtatttgctgaggagtgttttacttcatgtggtcaattttagaacaagtgcgatgaggtgctgagaagaatgtttattctgtcgatttggggtggagagttctgtagaagtctattagatccacttggttcagagctgagttcaagtcctgaatatccttgttaattttctgtctcattgatctgtgtaatattgacagtggggtgttaaagtctcccactattattgtgtgggagtctaagtctcttcttaggtctctaagaacttattttattaatctgaatcctcctatagtgggtgcatatatattcaggatagttagctcttcttggtgcattgatacctttaccattatgtgatggccttgtctcttttgatctttgttggtttgaagtctgttttatcacagattaaaattgcaactcctacttttttttattttttaattttttttgctttccattttcttggtaagtattcctctatccctttattttgagcctcctgccagtctgtgtcttttaattggggaatttaggccatttacatttaaggttaatattcttatgtgtgaatttgatcctgtcattttgacactagctggttattttgcctattagttgatgcagtttcttcttagtgatgatgatctttacaatttggtatgtttttgcagcggctggtacctgttgtttctttccatgtttagtgcttccttcaggagctcttgtaaggcaggcctggtggtgacaaaatctctcagcatttgcttgtctgtaaaggatgttatttctcctttgattatgaagcttagtttggctgggtatgaaattctgggttgaaggggcctgttgtggggtggggggatgggagagggatagcattaggagaaatacttaatgtaaatgatgagttaatgggtgcagcaaaccaacatggcacatgtatacatatgtcacaaacctgcatgttgtgcacatgtaccctacaacttaaagtataataataaaaaaaaaaaaagaaagaaaaattctgggttgaaaattcttttccttaagaatgctgaatattggcccccactctcttctggtttgtagggtttctgccgagagatctgctgttattctgatgggcttccctttgtgagttaacccaacctttctctctggctgcccttaacattttccccttcatttcaaccttgctgaatctgataattatgtgtcttggggttgttcttcttgaggggtatctttgtggtgttctctgtatttcctgaatttgaatgtcaccctgtcttgctaggttggggaagttttcctagataatatcctgaagagtgttttccaacttggttccattctccctgtcactttcaggtacaccaatcaaatgtaaatttggtcttttcacattgtcccatatttcttggaggctctgctcattccttttcattcttttttctctaatcttgtcttcttgctttatttcattaagttgatcttcaatctctgatatcctttcttctgcttaatcgatttggctattgataacttgtgtatgcttcacaaagttctcttgctgtgtttttcagctccatcaggtcatttatattcttctccaaactgtttattctagttagcaatttgtctaatcttttttcaaggttcttagcttccttgcattgggttagaacatgctcctttagctcgaaggagtttgtgattacccaacttctgaagcctacttctgtcaatttgtcaaactcattctcagtccagttttgttcccttgctggtgaggagttttgatccttcggatgagaaggggtgttctggtttttggaattttcagcctttttgccctggtttctccccatcttcatggatttatctacctttggtctttgatgttggtgaccttcgaatgtggtctctgagtggacatgctctcctttctgtttgttagttttccttctaatagtcagtgccctctgttgctggtatgctggaatttgctggaggtccactccaggccctgtttgcctgggtaaaggaggctgcagaacagcaaagattgctgactgttctttcctctggaagcttcgtcccagaggagcacctgccagatactagctagatctctgccatatgaggtgtctgtcggcccctactgggaggtgtctcccaatcaggatacactgggatcagggacccacttaaggaggcagtttgatccttagcagagcttgaacgctgtgctgggaggtacgctgctctcttcggagccatcaggcagggacgtttaagtctgctgaagctgtgcccatagccgccccttcccccaggtgctctgtcccagggagatgggggttttatctataagtccctgatgggctgctgcctttttcgcagagatgccctgcccagagaggaggaatctagagagatagtctggccacagaggccttgctaagctgcagtgagctcttcccagttcaaacttcctggtgactttgtttacactgttgctacaactgaattttacaagaaagtttatagatgggcctagaggaaggtacagaagtctgacaaaagcaataacagaacaggagtcactctgagagagacttgagactaggacctagaatttgaattacttgcttgataaaaaagacacaaattttttctattatgttttacttgaaaatgtgatttaagactgtagagtagtagaagatgagaaaggagacagagcctgcatccatgacaaggagatggccagttaatcattttttgtctagatctgttatataaacataggctcgtggacatcccagttgaatatgcatggtcactgcagcaaaactattgcaagtgccaaagctagcacagctagaaacattagtatcattgggtaaatttagtgccaattaagtagaaaaaaatgaatttaagtaatacatatttatgaaccttaaatggctaataagtgaatatataaattaattttttggagaaatcaggcaaactgagaaagtatacattaaacaaaaatgttagaaatagaaaaaaaattctcaaagatcctgtagacgtagttggagttgctttgttagaagcacttttttgccccagacttacttattctattggtgactgtttatgctggtggctatttatgttttcattacaggtcacatagacattttcttaggcatggttaaatagttagaggaaaattacaggatagaagacccaacttgacactttatgaaaagtgaaataatggaatctgtcactgccatggggcgtatgtatagtgtctcatatatgcagtcccagataagctgaacacgtgattatgttaaaatcgacgtagaaatgcatgtgacatgacaggacaactctgatttgataattttactgctggaaatcaacacaatgaagaggaagaaagatatcaaagaacaatgtagctgagtgtgaacattaaaaagaacatatggaaaagattccatgtatagggaaaagattccatgtatagagtctgaattttacaaaattcagcttcagctacttttgagaggtgaccttcattttcctttctttactgtataagattaaggctgtcctagggaccatcaactggaatcaaagggctgggccactctggcttgaataattatccatgcctagggaaaaagagtaatcttgctgccttatgaagcaaaacatgtcaaaacaatagacacactaaaaagcctgaaaagaaagtcagtatgatgtgataatttggaaaataaggaagcattttgaaaagcttccatatatttctaaaaatctagaatgctacgctcatgccccaacaaaagttttgggaaaggttaagatctcatgtattcttgaaatttattctctgagtaacaggaagtgaagacaaaagtcgagttgtaaactgcgtggctgtgttaaaggcatggtttattacagaggcagagtacaattgcaaagatagaaaatgtgtattctctagacatgtaaaaaatcctctctcaaatcaagagccaacaactaatgaaacataggtatcagtgagcacttatgacaaataatacagctttaaaaataaactgaaatggtcactaaataagcaactgcaactcacaagaaacagccacaaagcctagggagggaggagaatttgctatccagattgactacagtatagtattcaacatgtccacttttcaacaataaaaaatgatgagccaggcaagatgatgtgcagccaggtggctgtagttcactagaatctgagaccctacaccaccctctgcagagctctgtggcctgacaggtgcctgaggccctgccacctcctccttctgatgtccagagctgttatcacccacttcctcacagcccaactgttttctttcccaggacctgagatttggcctgcctttctgaggcagggctcccaggagggaggcagtgccctctcaaagtgacctcctggccatccatccacagagacacacccgtctcttggaggaggaagcttaggtccaggtggaaactgtgaacagaagctgaaaagaggcacctcccagagctgtgagtggccctcctaggcctcttggggtgggtggtggagagagcccagcaggctgtggtgggggctgtttcacaggactgggaggccacatctgcccactgccagatggtgccttctgaaaggtggcctccagtgaccctcacagccccagcccacgtggggtggaaacatcaaacgcctgcctaggacagccaggtaagcagggacatgaagtgactcaggacaagcagggactcagggcaagggaaccaggtgggtgcaggggagacgaggggcaggggctgaacaggaagctggaaaatgttcatcccatcccagattcgatcaactcttgggatcagcttgcttggttttccctgagccctgtccccctggctggtttctcctcacctccttgtctcctccatgccagagggcccaggggctcagccaacacaccatctgtcgccaaattgtaactgtctccacacatctgtcccttgatgaccctcaacaacatttgcacgtctctcagcatttccagaaccagaagccacacctcccagcaaaacccctccacagctgggcaaagtccccctgccactgttccgggccaaatcacccaggcattgtctccctgactgctctctcacacccacagcccatctgtcagaaaaacactgtgggctctccctttgccacccccatcaccaacctccccttccactgggatgtgacagttgccttctgctgcccacaaggccttggtccagcaggcagcctcctgagcccctgtgacctgttgcactcacatctgtgatggcctacctcaccaagagccaacaccaaagtcctcacaggccagccctggcctccttccaaccctggaacccctagagccctgtgtctcagtctccccatctgcagcgtgggtgctcccttcccacccccagcctgaaccccagagccagctcacccagacagtgagctccatgggccaggcatccagagccatgtcagtggcccagcccctcctgcaccctaagggaaccctgactgtcagtgtgaccctagggaggttgtccccaagtccttggtccctcatctgcctgtggagggcaagacttggtgagtgggaagcaggcgttaccccagaccagccccaagtgcctggagtctggtctcatctgtgtcttcagccttggcatcccaacttcctcacctctcgaggtgcaatgcaggagacagggtgtgtgcgctgcggccccgtgatggcccacgtccaagtgcctgctgctactcagctgagggcagcgtccttctgtcctggggctcagcctttgactttccccaggaggaccccagctgtccctcactgatggggttggagcccctcaccccctgggggtgccctcctctctaccaatcatcagacagaccctcacggagaggatgctgtggccatacctcctgagaccctttggccactcctgggccaggtagccactcagtgaacatagccaccaaggcctcctacccacagactggtgcagatccagcaggcaccctctgtcacatgcacacggaaggggcacagcacgcactgggtgagctgctgcagctgttggctctgatttcttcatgggaggaagtcagcgcctgcagtagttggggcccatgcagtccaggacaccagccctgcactacccttgaccccaacagtgagctccatgggacctctgccaggtgggtggcagctcagctccacagagttcccactgccaaggaccagttgttcctgcaggcaggcccacctcaggcccgggacctcagcgggtgagatgagtgactgtgaagcacacacactgaaacctggcacacaaggcctcaacatccccttgggaggcccctggcaccccttctttacaggcataccagtggaggccatcacagctgtgagtggggaaggatctgacccagagtctggggtcctgccagacaacctcaaaccctgggctggaaactgtttctctaaaggggtcagtattatcagctttggcaaccattttctgtgccaaggacttaactgtgccattgtagccagacagcagccttccccaggccacctgtaaataaacaggcatggctggattcctgtacagttttattcatgaaccagcaacattcaaatttcacagcatcgtgaagtataattgttttgatttgtttgaacatttggaaatgtaaaatccactcttaactcacgggcggcacaaaagcaggtggggacaggctacagttggctgacctctggctgagatggagctcagaggagtggatgacagggtgggcaagctcagccccctcatggtggagatttaccccaggaggggtggggtccctctccatccctcctcttggcttcaagagcagctcaggtggagagtgggggaagagaatgggcctcagcaacaaggacagagatgccagctcaggcagccgtgtggacagatccactcaatggtgcacactgcaggcgccatttacaccaagctgagcacagacacaaccagcccaggagatcgtggtgagggctatttggtatgggggttctctggggcagggagcagtctctaccctgcagcttatctggaaatgccatgcaacaaccattacagaaaacacacactgagaaaaagagcaaaatataaataggacagcaggtctggccagttgggtctcacaggccagtggagtgaggaggcccaggtgggcctactagggtggttggtggtgggctccttcctatagggaggttgggacccccaactcacaaatgacccacataaagttcccacaggctcaggggagagtctgtcagtcattaggcaagggggtcagagctggagccacacagcaggtgaggagccctggtcattttgccctgagggctgaggagctggggtgggggcacacacccaggggcagatgcactcaggtggctcccagaccctccccctgcccagtgcctgcccatctccctagggcccaccaaggcctgagacccagagacataacacctgatcatcacacccgggcttccctgccaaggctagacaatgctcagtggaggcaggcagtctgggcttggggccaggacaagggtgggggtcccactgggtaggcctgcttccccagacccagctgggatggttgacccgccacttgtcattctgtcaatgtgcaacctagatgtgaggggctcactgcagactctggccacaccagtcacactccccagccaggcccaattctgcccatcccacctaacctggccccacatgtccagtgcccaccaagatcctgccagccagaaggacccatgctcacctcctaaagcatccacatgtacctgcatcccatagggacccacagctcagggacagcccctgtggacccccatggtcagggggtctcctgacctaacccccagctctccagtcctagccatcatgtcttttggggaccaccaaacactggccgccgatggcccccaagaaggcagagaatgggctggtcatggcagcctcaggcctgggccctgaccccagggaaacagctggttagttctgatttggactgagcattaacaacaggtcaagccatgtgcacaagtattctcctctatccggtccagcagtaggctgggggacccagtgcagccccgggaccagccgtgcacagtggttccagcagtgtggggtggggatcagggaaaggccccgcactcagccaaaagttgacccctgacctgttcacccaccctgcacagggaccccagacttcaggcagaggcaggcagtggagttgccatctcctgggatcccatccagggtccacagaggcctgagaaatcctggcaggggctgagctgggggagtcaggcaggggcggggggggggaaggcaagtaaagggcagcatgcaactgggcatgactggcactaagacttcagggtctagctggccctgaaaaggtgacaacaggacagagtccagacgagcccctccacaccccaaccagctgccaggcacacatggtgcccctcacttccccagaggccccaggaagggctctttcttaatcaacacaatgggggccccacccacacccacacatgcagtggtgtccacacatatcagagaatgaaattcctgctgtgccgatatgggggacgaatttccctgcccccacattccccagcttcatccccacatggcgctgagcttggggtgcccaagccaacagcccattgatgcagcaacccgagggatgctgtgtcttgaagggacctgtgaggcctagggggcatttcacaatcagagcatttccctgactttgtcattcaccggccctctgcctcagtttcctccactatgacacaaggaagaaatcctgccccacagacctggggtctcagcgaggccaccacaccaggttaaatggctggagtgtacaaaagccgggatgagagtccctgcccggggtatctcgccctgggactgagatccaccagtccatggccaggccagcctgtcagggagggctcccagttccaagtccctgcagttgaggcccccagcgcattgggaggcacagggtcgggtggagtggaacaacgccccatcataagagccctgggcagaccttagagaacaagcattaaactgagactcgaatctgaagccagctccgccaaaagacttggctttggggtgatatgagagccggggtcagggaacaaagcgttctggttttaggcccacaggaagatctgtgaagcgctcttgggtagagcacacgttgccgggtatgtgcttgaaaagagcctaagaagagggggcgccaggaaggaaccccgacgcctagggagagtccagccttcccgcttcagcacctggccacattccgcagttacccaagccagaaaaaaaaaaaaaaatccagaggccagggaggctaatggggctttactgggactatttggcctaatcctccaaacaaccctgccatagcagcccatcagtcctctgcgacaggtgaggaacctgaggtcccaggaggacacccagaaagtctaggcggagccccgcaggcctccacacttccccgcgtggcagctccaaccccagctttttaactagtaagtcactcgagcagctgggccacttccgctccccccgcggggaggcagcttcgcgctgccgcctggctggggacagggacgccacctcccgctggctgccaccagggggcgcgcccgcagggtcccggtgccgggcggcgcatgtgcagcggccagcgcaccggctcctgccctcgccgcggcctctgccaggaccccgacaccccgcccgaccctaccctcaagcggggctgcggcctcaccgtctgcaacagccgctccgtccggcatttggcgtgctccccggggcagaggccgcggtgtcctcaggctgtggcaccagcctgcgacccccacgcccggctccggcccaggaggaggagggcgctgctccccgggtagggcgaccggtcacctgggccgggagggcggcgcaggggcggaagcggctgtccgggctgctgctttggacttctccgccctctggccggcccggccgcgtcgcccagggctccagggccgcctggcgccaccctctcccagcgccgcggtccctccggtacctccctggcggctgcggagccctcctgggacagggtccataaactctctagagcgggaagtcgcgcagtcgcggggccgtcacggggaccgctcgagatccgagcccactgggtgccccggacccttctctcgccggcccggccccgcgcccagacctagcggccgctggcgcctggcccgctgcgtgggtcttcggtgagctagctgcccacccagtgctgcggcctcggctcccgcatgcgcgctctggtggttccttgctaggggcgaccctgtgggccagcttcccacgcccggtccccaggccgcgcccaacccggctccctgggctagggtactggctcctcctgggggccgtgggactgggaggcaggggcgttaagggagacggtgggaccgagggcagcccctgctgagtgcaccgcgaggtcgagcgcaggcctctgttgcacagtgcgcggcttttgctgggactgtgctggggctcagagggtggtatcagtgccagaggcgatgtcagggaggcttcaccaagaagaagccgcggagctgacccctggggtgtgagcaggtcttcttcaggtggaagagggcaggaccgaattgcaggtggagtcaactgtgttttcgcacacctggggggtgaaggggacgcagtctgtctacctgacccgtgaaatgtaggagactgtaccccagaagcagcgggtttactgctgcattgattaaccaagtctggaacaaacatgtagctaagctgcgagttctgtgccagtggtcccaacacccactcccccaggaaaacacagctttggaggttgggtgcttgtcaggcctcagaatggagagcaggggccagagacaccaagcagggggaacccaccctaggcctcttgagggacgacgatgtggggagctggtggcagagcctgagctggcccgaggttgcatggtggggacagattcgaggcatagtagggactggtgacctcagttcccagaatgtcccagcctggcctcctggtccagctagcaagtagtgggtgctgccctgcaaagactctgggggtgcctgggccccccctcaccaaacttgactggtgacttctgtgttcatcctcacaagaagagggattttctctcactttcaggcaagcccaggaaagtcaggggcctatgtgagccaaagaggagagaaggcgatgctttagcccattgtttctgccccgcctggtttgtggccttggggacttgatttgcaccacaggataaagggcaatgaaagcccctccctgactggcttctcactccactctgaccagcccattgcacagcgcccaccctgcagctccaggtacagcctgtgcacctgcagctccaggtacagaggctgggctggttctgggctgacctcagggccttctgatggttgcaaccctcaggatgcctcatgctcaccccttggcacccacctgacagctcagcatgtctgctatatgccatcctcaatgcctgctctagacaagcccaagtcccccaggagtggcagagggaactgagctgggaactaagtcccagctcactgaaccccaagtgggcctcccactttaggtcacagccccaggcaagttcccttcagggatgtgatcccaggggccacagcagcacgttctggcctaacctattcactactcaattagttactgaacaggccaggatgggcatgggccctgacattaatcccctttctctgtgagggggctggattgggtttgccatcctgatgtctttgtggaaagagctggcaggtggagcaagtctcaggggccagccataggacagggaacctaggattcgcctctgctggaaccctgtgaggcccctgcaggcaggagggtccaatggaggtccaggcacctctcccagcttggtgttcacagctcctccctggcccactccctctacacttgcacctgctggtctctgggaggagagcatccatccatcttctgcatgtagctttctgctgcatttccatgaggatggtctccttgatagaatgcccagcagggtgtcctgagcctgtgctggctgttctctaagtgccaagtcagtgagagggacttgaaaactcaagacttattaacattattttctggtaaagtgcagaaaaataaaaaaaataaaaataaaaaccctgctttcagggttttttccttaaaatgtgtaaaaacaaatattgaaatttctatcttttatataatttggattctgtcatcacatggacctttcattttcctgaaatttatttttatatatgtatatcaaacattgaatttttattttcttctttactgaaattgttaaccgttttagaggccaattttttttaaaaaaaaatcatacttcacaaacattaataaaatgtaggaatttatttataatgttattatacttttttctttcttttttttttttttttttgagacagtctcgctctgtcacccaggctggagtgcactggcccaatcttggctcactgcaaccactgcctcccaggttcaagcaattcttctgcctcagcctcccaagtagctgggattacaggtgctcaccaccatgcccggctaatttttgtatttttagtagagacagggtttcaccatattgggcaggctggtctcgaactctgacctcgtgatccgcccacctcggcctcccaaagtgctgggattacaggcgtgagcccccgcacccagcctatactttttaaagatgtgaataattgcattaaagactttatattacttgtatgaattaatttacatttttccacaatcttgaaaaatattttagctaggtatgcaattccagattaacacatatttaacctacaacttcaagcttaatatctattgatatatcaatttcatgaagaagttgagagacaagattaaaatctattgttccataatttgcattttatatttcaatgagtttaattcatttcttttattttggtgttaacattttcatttatgatgtttttagatatgtataccttttgtgcttttcttggttgatatttgatgagcctgtatttcatcattctttaaaatgtttaaacatgtcttattttctactattttctctgtttatttaaatgtctgttttgaaaattcattagaaatagccctttcattccattttcaatttattttcacctctattttatattttctattcatttttcttcttgtcctgacacctaagtatagatttcagttcattcttttactcatattttagctcatattttttacattgcctgtatccctctaatctgtaaatgtttctaattacatatatattttctatacctaatacactactttggaattccttgaggcctaattgtatagggtgctctggttttgttgttgttatttctgaatgacattgacttcggtggtcttcattttgcatgtttaaaaatattagattgtgtgattatatttgacaggtcttaactgatgtgccgttcagtgctttgggttgagctttgggttcggttgagttttgggttggagaattttcttccacaggagactgtcttggatttttctgtttctccctcaatatccacctggaaaacatttgaattaatttatagtcacttaaatatttctgtgcaaaaactgtgtacagaagccccaaagtaacaatgggctgccttccttcctgaatcagccaaggcatagcctgaggagcttcactgtttatcttcctttgactgcagtctgagtattctaggccatttttcttagacttgtggaactttgaggcttttcctttagttaggctggtcagtttcttctccccttcactggtgttgctgtagcattgtatccacacccaaatgctgttaaaacccaacaaaggatgcccctattatgactgcaccatcatgggcagccccaccctgccagctttgctgtcatcctccctccttcctgccacctctgcttcttcactttcattccccacttaggaataatttgcccagttgagcacatattctgttgtccagcatttatggtggtttgtagtggaaaagatttttagaatatgtggatttttggaatatttcctccaaaagcccagatagccacactttacctttggaggaattatttctcagaatactgcacacaaccgcctttggaaggagcatatatccccagcaaaagctctgattttttgaagtctgtattgtgtgttatttccaggagaatatagcaatgatgataatgttattaaacaattcaaatatgaaatgctgttatgcctaacataaggattttacgtgatcatgccttttggctgaggagaatactcctgtcttgttggaattattgataatttgaccgtaattgctaatgagtcagaaaaattaggaacaccaagtttcagtcttctcaagagcactcctcttattaaatttgaacttttacctttatcacatgcaaaagaaatatttttagagaagtgtttaatgttttccagatggatatattactgttattagttatcattttattaatttttaaaagcatagagttggaagtatcaatatgtctttcaatataccttagtggaatttattaaattttcatggatatcctgtaggaggttgaggaagttatttctattgctagatttctgggagatttatcaggaatgagtgtcagactttgtcagatgtccattgaaataatcatggttttttcctttattctattaatatggtgtattacattgattgatttttaaatttgtatttgtaagataattccacttggttatattgtctaacattcttttctaattttctttaatttttatcagagttgaggccttactatgtcaccaggttggggtggagtggcagtcatagctcactatagtctcaaactcctaagctcaagttatcctgccacctcagccacttaagtagctgggagtacaggtgtgcaccaccatgccaggcttgtctaacatttttatgtgttgctgaatccagtttgctagagtttttgaagctttctgtcgtcattcatgaggaataatggtctgcacatttattatcttgtgatgcttttgtctgatttgttatctgggtaatactggcctcaaaaatgaatcgatgttttccttctctgttttgcaagtgtttattaaggattggttattcattaagtgtttaatcgaattcactagtgaagctatctgagcctgggcttttctctgtgtgaagagttttcattagcttcatctatttacctgttgtatgagtatgcatatattctatttcttcttgagtttacttttccagtttgtatatagcagcaaatttgtttctaatttgtagtatttcatgcttctaggttttcatggcaattgagatgtaagaataaaaataatgttgggagaagaaagctgtggacaatccatgaataacccaacatctgttataggaaggagaagattgtttttcttgctgtacttaatactcacatttatagtgtgagacaaatgtaatgctgtatctaaatagaactaggaaaatgtgccatttgtcatagtatttaatcaagatggaagtctgagcctacctcctctcttttattaatatgtagacagaacaccaacataaatttgaataaggacaaacaaaatgttagcaaatgaagaatggtatgaatgggttaaaatgtgatgaaacagagtggtgaatatttacatagaatccatgatgtgttaggcgctatttcaagctatttgcacatacagttttaataccaatgactttaaaatgtataacacaaagattcatataaataaaaattacaacattgaaaataatattaggtgacactaaaactgtcatagaaatatacttttctataaaacaaataaattaacatcaagtatgaaataaactttagaaagtttgattactaatcagatgaacaagtgattagcctttttagccaggaaacaaggcatacacattattttcaaattccagagacaaacattttaaatattgaagtttaagacctaaaaatgtatcactgattttgtggaagtagatattcaataggtgacattttctaggctctgtgaaattacatcagaaaatgtgaattagaatataacccataaataatatctagccacatacaaagtaattgaagatcaatttaaataactattggattaagaaatagagactgaggtaaatttacagggtcagtgaggatctaaggaggaagcattgacactggagcccaaggacctcgtattgcagaacagattctaccagtgctaacttcctgctacagagaaaatatcgattatgttcatgtgcaggtgctattcatgaagaaaggaattagaacttcagaaatgtgttcaaaatatatccctactttgacatattaatgaagtaatcacattctacacataactactccatatggaatactggggagggggtgttccaaataaagaaactgaggatttctcatgagtactcaatgtctgctagaaaatatctaagtaaaatatttaccttatgtggacagtgttgatgtttgtgcaataaaagttttgagaatacctaaaatgtacaatggagatgaggagaaaatatcagagttccccaggaccagaaatgaggcaagaaaaaattcagaggagttgtgaatgtgaaaagccaatggctggtcacacagcaacactgaaagtcttgtgccaggccaactagaataaatacataaacatacagattgaaaatatttacagtattagatctctgtgttgtgagaactaaattataaatattgaagcatacaagaaaataagctaccagaatttaagctaccagaatagattacacatacatttctgatattgaaatagtcacaaatatttaagtcaatacagtgggaaaatatgaaaccaaaataatgttgaaaaatcaaaaatctttaaatttgaagagcatatgtgaaaagagccaaggataaattgaatagctgaaaaataaggtatagaatttgaatatacatcatatttgaatattcatcttatgaatatacattgtattaactttgtaggagctgctgagaggaatagtgcactgggagattaagcagaacaaatttatagtgaaaaaggtaaactgacataaaacataaatatagataaataaagactagaataggaaggggtagaacatatacaattacttcactggcatatataaaaggaataaaacacaacaatcagaaagtaataattttataagataaaattaaaaaccagatacaaatcttttaattcagacatgcatagtgttcaaaaagagataaataaatataaatattgatgcagaaataataaactactactgcatagtaaaaaaaaggaagggaaaactacagaaatatatatctgaaaaaaatagattttacatcataaatgttatttactatatggtcaaaattatcacatatgatatcttttttattccattcaatgttttcttgattttttacacttttctattttttaatttttagtttacaagatgtcaaacactcaaaatgttttcttgattaattctatcatgaaattttaaaaatagtcacattattttgtacaccaaattatatatacatatatagatacacacacacacaaacacacacacacacagcacaccagcacattcataatcacccatatagaatgcccattatctatactaccatagtatggggctcagtatttagaaaacactttttgtagttctagatctcttgcctaatatttatcaactagaagagtgatagtcatataaaaatacctcatgagtgtttgtatatctaaactaaattttattttaaagaagagagtcactaaatggaaaaaaaatttaaaaacaaacagactccctcacatcacagcacccagactgcttctcttcttagtctctcttttacaaaggtttaaggacccttgtaattgcattaggccaaacttccaattcaagttaatattcttatttttgagtcagctgattgtcaaactttatttcacctgcagccttaattctgctttgtcacataccatgatatattgctaggccctgggggtgagacataggcatcttttatggcattatttcactttccacagggctaattaactacatctccttaaaataatcctggctctttttgagttttgtttctatcccagagaagtatgtaaaaaaattttttttttaatctcaggaggaaattgctaaaatccagctctcaatgttagaggacacagactacctttttctgctttatgacatcaatgaatttgcattaaattaattccatggcattccttttcttaagactttatacaggaatactttctcatgcctgggaaaaatactaatttctctaacagtaaagataattctccacatcttaagcaagatatctctgtatcagaaccctttatagacatacaatttcactgaataattttgcaattactctctcatgttattgtcacggatacattcacgtaagtaaagtattttaggaaagtgaataatatatggtgaattcatatagattcatatatatatacacacacacacacactgtgtataagtcatatcccataaagaaataatgaaattagataaaataacataggtaaaaattctatttttttcctctccccatggggtaaccagatcatacactctaattcatgttacacagtctctaaatgtttaccacatattgcaaaacaacgtatctggtgaattatcaaacgtgtttttaatgaggtttttgagggcatttatgctacgtcttgaggaaagaaaagtggttttcataaactagaattgaaaaataaaatataaggggattcaggggatcatagtggatgggaggcaagactaaattgcagcttcggacagagcaacatgcagaggcttgcactgtgaattttagctccaggtcaactgcaagaacaaaccatcaattccaagaggatccacagaccctctgaaggaagtggactgcccctgcaggacccaggagataccccaaatactgtgaatgccccaactgtggaagtgggaaagggagaccctcctctcctgaacacatacccccactggagaagctgaagttctgtttgcaggagaagtttccaagtttacctggagctgagtcaaattagagaggtgagcaaaatacaggggtagaagaagcagcagaaagatcctgggagcttgctgggtccccaggcagcccattcctgcctggcaccacagggatccatcaggagggtggccagagaagcagggggtaaaactccacagggagaaggaattctctagctgaactttgtaacaatttgaaccaggcaagaactttgtaagaatttgaaccgtaccctctcctggccagaactcaggggagggtgcgaatctggtgtgcagactccacagttaggggaactaccaaagcccttttctttcacagctgggaggcagatatccttgggcaaattttcaagcccctctaaccctccacctggaaacagactcagggctgttggtggcagggtggtgggtggtgggagtgaggggagtgagaacagcccttcagtttgtgtgggagctgggtgagccctgtgactgctggctttcccccacttccctgacaacctgcatgactcagcagaggcggccataatcttccttggtaaacaactccagtgacctggaaaccacccccattctccacagcagctgcagcaagacctgcccaaggagagtctgagctcagacatgcctagccctgcccccacctgatggtccttccctacccaccctggtagtggaatacaaagaacatataatcttgggagttctaggggccccgcctactactggtccctctccacactacacagctgacactttctggaaagtgccacctcctggcaggaggccaacctgcacaaatatgagtattaaacctcaaaagctaaggaccctcacagagtccattgcaccctccaccacctccactggaacaggcgctggtatccatggctgcaatacccaaagatggttcacatcacaggactctgtgcagacaacccccagtaccagcctgaagccgggtagaccaactgggtggctagacccagaagagagacaacaatcactgcagtttggctcacaggaagccacacccataggaaaagggggagagtactacatcaagggaacaccccatgggacaaaagaatccgaacaacagtctccagccctagaccttttgtttgacagagcctacccaaatgagaaggaaccagaaaaccaacccaaccctggtaatatgacagaacaacgctcttctataccccccaaaaatcacactagttcaccagcaatggatcaaaccaagaagaaatccctgatttatctgaaaaagaattcaggttagttattaagctaatcagggaggggccagagaaaggcaaagcccagtgcaaggaaatccaaaaaatgatgcaagaagtgaagggagaaatattcaaggaaatagatagcttacagaaaacacagtaaaaaattcaggaaagtttggacacactttcagaaacgtgaaatgctctggaaaatctcagcaatagaattgaacaagtagaagaaagaaacgcagagctcgaagacaaggttttcaaattaacccaatccaataaagagaaagaaaaaaagaataagaaaatatgaagaaagccttcaagaagtctgggattatgttaaacaatgaaacctaagaataatcggtgtacctgaggaagaagtcaattctaaaagcctggaaaacatattttgggaaataatcaaggaaaagtttcctggccttgtgagagacctagacatccaaatacaagaagcacaaagaacacctgggaaattcatcacaaaagatcttagcctaggcacattgtcgtcaggttatctgaagttaagacgaaagaaagaatcttaagagatgtgagacagaagcactaggtaatctataaagggaaacttataagattaacagcagatttatcagcagaaaccctacaagctagaagggattggggccctatctttagcctcctcaaacaaaacaattatcagctaagaattttctatccagtgaaactaagcatcatatatgaagaaaagatacagtcattttcagacaaacaaatgctgacagaattcgccattaccaaaccagcactacaagaactgctaaaaggagctataaatcttgaaacaaatcctggaaacacatcaaaacagaacctcattaaagcataactcacacaggacctataaaacaaaaatacaagttaaaaaccaaaaacgaagtacacaggcaacaaagagcatgataaaagcaatggtacctcacacgttcatactaacattgaatgtaaatggcctaaatgctccacttaaaagatacagagctgcagcatggataagaactcaccaaccaactatttgctgccttcaggagactcacctaacacataaggactcacataaacttaaggaaagtggtggaaaaaggcatttcatgcaagtggacaccaaaagtgagcagtggtatctattctcataggagacaaaacaaactttaaagcaacagtggttaaaagtgacagagggacagtatataatggtaaaaggccttatccaacaggaaaatacgacaatcctagacatatacgcacctaacactggagatcccaaatttataaaacaattactaagaaattgagatagagagagatctaagaaatgagataggcagcaacacaataatagtggaggacttcaatactccactgacagcactagacaggtcatcaagatagaaagtcaataaagtaacagcggatttaaactataccttggaacaaacagacttaacagatatatagagaacatttcatccatcaaccacagaacacacattctattcaacagcacatggaactttctccaagatagaccatatgataggccataaaatgagcctcaataaatttaagaaaattgaaattatatcacgcactctctcagatcacagtagaataaaactgaaaatcagctccaaaagaaatcttcaaaaccatgcaaatacatggaaactaaataacctgctcctgaatgagcattggatcaaaaacaaaatcaagatggaaatttaaaaattcttctaactgaatgacaataatgacacaacctatcaagacctctgggatacagcaaaggctgtgctaagaggaaagttcatagccctaaacacctacatcaaaaagtctgaaagaacatgaacagaatatctaaggtcatacctcaaggaactagagaaacaggaacaaaccaaacccaaacccagcagaataaaggaaataaccaagatcagagaagaactaaatgaaatcaaaacaacaacaacaacaacaagtacaaaatataaatgaaacagttggttctttgaaaagataaataaaactgatagaccattagcaagattaaccaagaaaagaagagagaaaatccaaataatttcactaagaaatgaaacaggagataactgacaccactgaaatactaaaaatcattcaagggtactatgatcacctttatgcatataaactagaaaacctagaagagatggatacatttctggaaaaatgtaaccctcctggcttaactcaagaagaattagataccctgaacaggccaataacaaggagcaagattgaaatggtaattttaaaattaccaaaaaaataaagtcaaggaccagacagattcacagcagaattctaccagacatccaaagaatttgtaccaatccttttgacactgttccacaagatagagaaagaaggaaccctccccagttcattgtatgaagccagcatcaccctaatcccaaaaccaggaaaggacataacaaaaaaagaaaactaagactgatatccttgatgaatatagatgccaaaatcctcaataaaatactagctagtcaaatccaacaacatatcaaaaagataatccaccacgatcaagtgggtttcataccagggatgcaggaatagtttaacatatgcaaatcaatggatggaatacaccacataaacagaatttaaaacaaaactcacatgatcatctcaatagatgcagaaaaagcatttgacaaaatctagcatccctttacaattaaagctctcagcaaaataggcatacaagggacatatcttaatgtaataaaagccatctttgaccaacccacagccaacataatactgaatggggaaaatatgaaagcattctctctgagaactagaacaagacaaagatgcccactctcaccactcctcttcaacgtagtactggaagtcctagccagagcaatcagacaaaagaaagaaataaaggacatcaaaatcagtaaaagggaagtcaaactgtcactagttgcggatgatatgatcttttaccttgaaaaccctatagactcctctggaaagctcctagaactgataaaagaattcagcaaagtttccagatacaagattaatttacacaaatcagtagctcttctgtacaccaacagcaaccaagaagagaatcaaatcaagaactcaaccccttttacaatagctgcaaaaaaagaaaatacttaggaatatacttaacaaaggaatcaaaagacctctacaaggaaaattataaaacactcctgaaagaaatcatagatgtagctgagcgtggtggtgcatgcctataattccagctactcaggaggtggaggcaggagaatcacttgaacccaggagacggaggttgcagtaagttgagatcgcaccattgcactctagcctcagtgacaagagcgaaaccctgtctccaaaaaaaaaaaaaaagaaagaaaaaagaaaaagaaatcatagatgacacaaacaagtgaaaacacatcccatgctcatggatgggtagaattaatgttgtgaaaatgaccatactgccaaaggcaatctacaaattcaacgcaatccccatctgaagaccaccatcattcttcacagaattacaaaaacaattctaaaattcatatggaaccaaaagagagcctcatagccaaagcaagactaagcaaaaagaacaaacctataggcatcacactacctgatttcaaactgtactataaggccgtagttaccagaacagcatggtactggtatagaaataggcacatagaccaatggaacagaatagagaacccagaaattaacccaaatacagccaaatgatcttcgacaaagcaaacgaaaacataaagtggggaaaggacaccattttcaacacatggtgttgggataattggcaaacctcatgtaggagaatgaaactggatcctgatctgtcaccttatacaaaaatctattcaagatggattaaggacttaaacctaagtcctgaaactctaaaaattctagaagataacactggataaacccttctagacattggcataggcaagggttttatgaccaacaacccaaaagcaaatgcaataaaaacaaagataaatagctgggacctaattaaactaagagcttttgcatggcaaagggaacagtcagcagagtaaatagacaacccacagagtgggagaaaaatcttcataatctatacatctgacagatgactaatatccagaatctacaacgaactcaaacaaatcagtaagaaaaaaaaaaccatcaaaaaatgggctaaagacatgaatagacagttctcaaaagaagttatacaaatggccaacaaacatgaagaaatgctcaacatcactaatgatcagggaaatgcaaatcaaaaccacacaatgcaataccaccttacctcctgcaagccataataaaaaaaaaaatcaaaagacagtagatgttggcatggatgtggtaaacagggaacacttctacactgctggtgggaatgttaactagtacagccactatggaaaacagagtggagattccttaaagaactaaaagtagaactaccatttgatccagcaatcccactactagtcacccacatagaagaaaataagtcattattcaaaaaagatacttgcacatgcatgtttatagcagcacaattcacaattgcaaaatcatacaaccaacccaaatgcccattaatcaacgagtggataaagaaatatatatgatggaatactacgcagccatagagaggaattagttaacagcatttgaagtgaactggatgaaattggagactattattctaagtgatgtaactcaggaatggaaaattcaacatcatatgttttcactgatatgtgggagataagctatgaggactcaaaggcataagaatgatgcaatggactttggggacttgggtgaaagagtgggagggaggtgagagataaaagacaatgaatatggtgcagtgtatgcttgggtgatgggtgcaccataatctcacaaatcaccactaaggaacttactcatgtaaccaaataccatctgtaacccaataacttatgggaaaataaaataaaataataaatgaacaataaaatataacacaccaagaaagtgaagagacaacccacagaatgggaaaaaataattgcaaactacccatctgacaaaggattaactacccatctgacaaaggattaataaccacaatatataagaagctcaaacaactctacaagaaaaaatctaataatctgatcaaaaatggccaaaaaagatttgaatatatatttcttaaaagaagacatacaaatggcaaacaggcacatgaaaaggtgctcgacgtcaatggagaaatgcaaattgaaactgcagtgcaatatcatctcactggagttaaaatggcttatattcaaatgacaggcaataacaaatgcttgagagaatttggagaaaagggaaccctcatatactgttggtgggaatgtaaattagtacaaccactataaagtacagtttggaggttccttaaaaaactaaaaattgagctaccacgttatccagcaattgtactgttgggtatatacccaaaaggaaggaaatcagtatgttcagatatctgtagtactatgtttgttgcagcactatttacaatagctaaactttggaagcaacctgagtgtccatcaagaatgcgttaaaaaatgtggtacatatacacaatggagtactatccagctttaaaaaagaatgagatccagtcatttgcaagaccatggttggaactggagatcattatgttaagtgaaatagccaggcactgaaagacaaatatcacatgctctcacttatttgtgggatctcaaaatcaacccacttgaactcatgaatatagagagtagaaggatgattaccagggcctgggaaggatagtggggggctagagggatgtgggcatttttcatgggtacaaaaaatagaatgaatgagacctgctgtttgatagcacaatagggtgactatagtcaataacttaattgtacattttaaaataacttagagtgtaattggattgtttgcaactcaaaaactaaatgcttgaggggatggatgtcccattctttgtgatgtgattatttaactttgtatgtctgtatcaaaacatctcatgtatgttataaacatatatacctatgtactcacaaaaattaaaaaattataaaactcttggctcaatttgaatttggggtaagtaatgttattattttgtataaatatcttccaataattgcttaaacatattacacacaaatatgcaaatattcatagctatgctaaaaagttattcattgtttatcctagttttaaactttactgtgtttcttatattttcttttggtgaatctgacacatccattatggaagtatcgtaggatttacaataacattgtacagacgtggggaaaaaagaataaaaggtcatatggattggtaagagtataaaagaaaactgagtttcaaatgataccttgaaaacataaatcaggatgtacatctgagctctcaccaggaaatgtggcaaccagattgtccttgggctgagggtgaagtctctgagcattctcagagacagacaatgcaaatcaagttcattctcattgtgcttgctttaccttcaaaattgtataagtccctaagcgtatatataatcaataattgtgggaaaaataacatcattaaatgtaccaaaacaatagactgatcacaaatactgcaggtgtttaaatcagatgtctgaagcaaagaaagagagtgtaatgaaaaataatttgaagaaaatagagctctataaatctgtttattcatctttataataatgtcaaatttgttgagatttttaaaaaatgacatgatttgtctatagatctttgtactctggcttaagttaaatgtatatacaacttatataataaaatactgtgctgttttattattatttcttggtccccaccactttcaacatattctagaaatggcacagtaagacctatgactggttatcaacaacacaaagtgattatgagagtttcatgtgacagataaaggaaggttggttggttcagtggcaatagttggtaacctgagaaactgagctcacaattttagaaaagtattattctttctaactagatatttccatgaaaataatcttgtgaaatgcagaagtgccaaaagaataattataagataataaccaaataactaaaagacatctcaatttctctggcaatgtaacttaatgcagggtgcagccataatcacgatgtttactaacatagacatttatgatgtcaagacatttaattcttagctcgttgagaaaaaaagtactagaagtgttactgcagagaccaaagacaaaaaacagtggaggggcttgatcacaagtcatatcttacaatttttggaaacctctaaaaatcctgcctggtggtaggtgtttgaatctggagtgagctatgattgtgccactgcactccagcaagaatgacagagctggatcctgtgtacaaatatatacgtattgtatatattgtcaatgaccagtcataggtcttacaatgctgtttatacaatatggtgaaaatgatgttgacaaagaaattatcaaaataataataaaagcccagtatgttattttattatgtaagttgtttataaatttaatataattgaggcagattatgaagatctgtagacaaatcatgtcattttttttaaatctcaacataatagaacatttcttttttaaagtacgcaagctctttgaccatcatgtctctgtgcatgactgtaataagatagccagagcaactgcttccactgtggagttgggaggagataaatacacatgctttgtactttgagtgctctgatcaggatcaggggaggtccctgcactctgactttatctctcctaaatgtgcaaattgcagagatttttaacgtgaactgaatattactgttagatccttttggtctatagctgtttcagttcactattcttttactgattttctgtctggataataaatccattgttgaaagtgtagtattggagtcccctagcattagtgtattgctgtctatttatcccttcagttctgttagtatttgttttatatagttaggtgctcagatgttgggtgcatatatatttacaattgttataatctctcaataagtttacacttttcttgaataaaaaagagacaaatgaaaaattctctaatgttcagggacatgcaggttttctattgctcatgtttcttcttgatatttttatgccatggcaggctgcaaatgaataatctctattatcatccttgtgttcctttgtgttttaacctatccttattccattatcttttatcttgaagaataatagacaccagaaaatcctatccctaccaaatgcaaaaaaaacccaaaattataaatattaacatttacaagtcacatttgtgcgtatatattttaattagaaaattacaatttttaactttcagaggaagtggtagtaatataaaacagaggacatttttataatagggaacttatattcttaatattctgcaaattattattctctcatcaccaaataatcttacctaaagtaatatatcaccaatttaataaatttagtttaaaaaaacacaaaattacaaaacaattaatactatatttgaaatcatgatgtatattgcaagcctcccttcaggtaaagttctattaactctacaaacattttataaatggcagaagttacatttccagatagttttgtggtaaccaaaaaagaatttatttattagcaattttcataacacattgagacaaaatattatttgtgataaatgtcattattgtaaaatatttaaaacacctcatgtattaagaaatcctaatttagatggggccaagctggtggattagaagcagctgtggctcatggcgctcatggagagcaatgaaaactgcgagtgaattctacaccttcaattgaggtatccaggttcttgcattgggactgactaggcagacagctcgacccacagagagtgaggaaaagcaagtagggcgatggcccacccaggtgtggcacagagctaggggagccccactcgcagccaagggaggcggtgagtgattgtgtgactctacccggggaaaccatgcttctgccagggatatttgcaacctgcagatcagaagattccctcgtgagcccagtcaccatggccttgggtctgaagcacagagctgtgtggagtctcaggggagtactcgctggctcactgtggtgtgcttggaaacccaggagttttgcattctctgcccccagaagtccggcaaagcacgagataaatccatgcattcccctaggaagggggctgaatccagggagccaagtggcatcattctgtgggccctacttccacagcgcctcacaagttaagacccattgacttggaattccagctggccagcggcagaaggctggagaggcggagatggaccacgttcccggggggaggggcagtcgctatatctgtggtttgagttggccgctctagtctgctggcaccagggactggggggcagttcaccacaacgcagcacagctgctgtgcctgattgtggtcaggaacttgtgtttgccatcccattcctttttctcctctactgtttctagtcatggggatgttttatttcacaaactagagcaccgacttcttggcaacagataaacttttggctttgtgacacccaccaaccaaacctgaagtataactcaaccctgattataactgccacatttgtgattcttttaattaagaaaaacactcgatgttataatggtagcttttcttttcataaacctatatatcttagcacagagcaccagctcagcctgtttgggtttggcatggtatgttcccacgcgttgtctttgattctataacaaacaagtcttccaattggcctcattcaggacaccctcacccctcagacttctactctctacaaatacaattctgcctgaactctctaactggatctattctatcattagctgccataactacaacctcagtactcattctttgttgtttcttagctcttgatttgttcatttaattgacttatttgaagtttctctatttcttcttttaaaatttccttggccagtgctcacagaaaaaaaaaaaaactgtcaactaagaatcctacacctagcaaagctatgtatcaaaaattgaggattgcttgagtttaggagttcaagacaggcctgggcaacataatgagacctcatctctgctaaaaataaaaaatacatattagctagatgtggtggtgtgcacctgtagtctctaagctacttgggaggctgaggtgagagaactgcttgagctcaagaaatctaggctgcagtgagctatgattgtgccactgaaccctagcctgagtgacagagtgaggtcctgtctcaaacgaacaaacaacaacaacacagaaccttaggcaatctaacaaaaatgtagttttggtcaatttttgctattttaaattcctgatttttctttacattctaatgcaaagggaaatgaaagcactggtgagacctaggctggaggggcctgccctcggcctactgtatgttacctctgggtgacctctgcaaaatctccagaggcatcttgggtgaggaataagccaatgtgagcatctcagaaaaggttttcactttaggccttcctgaagcaagagcctaagagagttgggatagagcaggagcacatcatgctctcttaagcatttcccaccaagtgacctggatacagggctgtctctagggtgtgggtgcttggctaccagagttctaagttttgttggggtctgtcaccaaggtagtaagatggctttttcaaagtttcatcctctgggctcctggcttccataagacctacccaaaggccctgctgggctattgactgctcactatccctgcatgtcaactctttacctgtgcacagttatgcaagtacagcccttctcagttccctggaaagacctgaatgcagccagggcctcaggtgtgagatcacagatccaggtaacaatctactttttcttactagttctgtgacaccagaaaagttattgtgggttttggggcctttcaacatgtacaatggggtaacatgccagcatctccttcctagggaactcatcaggtgtgtatgagataaaacttgtaaaactcatggtgtggcatcccacgtagataacgcacacacttagagataaaagaattataaggaatgggaggtagcataaaatacaattcaaacaagcctgtgtccagcagtgtgttattggaaagtcacttcccctctcagccccatttttcattctgcaccagtaagagtttccgatgaaatgaaattcagatattgtcatcctctgacattactcctttcagtgccttctcattatattcagaatcagacccatgtccttcattttggcctatgtgttgggcagcctataggaagggctcacaacactaaggagttagtgactcacttctgaccaacagaatgcaacgaaaatgatgggataacacttctgtcctaggtcacgctgttatagcaaagatagactgagccgcttatcaacaacagaatgttcttcttcacagttctggaggacagaagttgaagatcagaacgccagcatggatggagtctggtgagaactctcttctgagttgcagactgtagactttacattgtatttttacctgacagatagtggaggaaggagctctctggggtttcttttatagagccagtaatcccgctcatgagggtttcaccttcaggacctaattaccccccacttcctagtactgttatacgggggaccaggatttcaacatatacaatttttggtggggaaatgtttagtctattgcaactctcattatgttattatccaaaaagctgccattttctcctagtcactttcttctgtgtgttcttcctcaatctctctcatctcttctgtttactctgtccagtgttttctccctcattctctttctctgtcaatatgtatttttcttcctgactttctactgcattcctcaaattcagaaagcaagctccagtgttatgagctgccctgtgcagaggcctacacaacagagaatgagggagtgcccaggccaggggagactctcaggctctcagtctacactgaatccagccgatacccacatgagtgtgcctcgaagccaatcctcccacagcccagcttcagctgagaacacagccccagcctcattgcaggcagccagcaaagctgtgtccagattctagtccacctaagtcatgagataagtaagcatttgttgttcgaaggtgctaagtttggggataatgacgtcagagagaagcagatcactatcttcttcttccaggcctcagagtcctccttgcctctctacttctcttccccaggctccctctagccccactggcctctttctcacatcctctgccaaagtcacttctgcctgcatgtctctgcaccaggagtggcatctccctgatacactgttcccagacttgtgcagggctagccctctgttgtcatcctagtcatggcataaatgtcacctcagtgaggcatttgggtccctcaaatgctatggctccccagccctccctcccaacatcctactttaattatagcatttactcttcttttatatgcacttgctttagtgtttttgtccatatatcctcagactgtgggctccttgagtgggggaaagggccactcaatcatttcccagcaccacatgctgggcccaccagggcacttcgcacaggtttagttctgcggcagggttgctgggtgaataaatgagggaatgtctaacctccttacctgattctgatcacctcataatggtatatttcttacaagaaacacagtaattatagttgatagtaaaacataaatgacaaaataaaatttctgaagtttcctgttgagcatttatgatagcttttattatataattatcccagttaagattttaagttttataacttttacatagatttttaataaaaacccgttttaactctgagttctgacaatgttttatagtctatctccaaattcttctataatttaataattttattcatgtttttatgaatgattttgaccctgatatttattctggaaagaggaattctacaaatttcctaccaggtcagacatttcatcatccaggatttagcatctgatgttccaattaacaggtgtacaagttgatatgtcaagtaaccctgggccatgtatgccctaaataattctaaattatttgatgaatatttgactttgtttagtttttaaaaattgttaattataacttgttagttcatgtataacttgttagttcatgtagactctgaactcatgcgctagatttaaattctgcagtcgcttatatatctgggtcatggtaaatgtggatctttagatgtaagaaagttgggaatttatgacagttgggaaaataatttcagaacaaaaagcaagaaggagaagtcagtggtggggcagaggagaagagagatcagaatcctaaggggcaggagggagagctgcacaccaggaagcaacggaaagacaaggaggggaaggatttactaaaaaatgtatctagtttttgttacttctgattgtaaaatttttcatctttagccatctttaaccacagaatattttagtggagcaatgtttaattcagaattatatgtggactcctttgcctaccaactaaaaatactgcccattggacccgaggaatcttggtttttctaacatgcctttcaaaggaacaatgtttctctagtcaatcattaatgtggccattaaagtttcaaataatccttgatgaagtaatgctattcagagaaataagcgtaagaattgtaataaaagtatatataagtaccaatagttttgtcctaaaatgaagagtatttagaggacagtttgtatgtaattctgtgcacctaatgtctaggccctaatgtgatggttggccatatcttaaagcagaaaaaagcctgtgatcctggtgggtataaaaccagagaaaacatgctctatggattaaagatgttttcttaagacaaaaaaagtgaaaggagaatgtaaccagtttcatagtaactgacagcaatatttatccaaattgatgctgatccagggaaaaccactaactgtcctctctgtgaggttggctcaaacaataggctcaaaggtcctatgcctatggcctacccttgggttattcttacaaaaaataactttaggcatcataacacataacagtaacacaaggatagcgcaatgagatgaagatggcctgattctaccaagaatgtcaaagaaatggagtctacaaaatctaggcaccaaactcaggataaatagctgcagaactcaatagaaaaagaacagagttcagctcttatgctggcttaccacatcatcatgcacttgacaagtcaggaaaagcaaggcaaaggggaccttcatgggtggtgcacatagtcaaggctgtcacctatggcagtgggtagtgcagaatatatctcagtggaatcttcatgtgaccatgaaaattagcagaccacctgaggtaagtgccccattcaagtgtatcatttttaaatcttttataccatatttttactgtaccttttctatgtttatatacacaaatgctgacccttgtgttacaattgcctacagtattcagcacagtaacatgctatacaggtttgtagtttaggagcaataagctataccagatagtctaggtgtgtgataggctataccacctaggtatggctataccacctaggtatagctataccacctaggtttgtgtaagtacattctatgatgtccatgcagcaatattacacagtggtgcgtttctcaagatatatctccattattaaaaatgtatgtttgtataaaaaataaaatggatgttgaaagtgtgaaattgctatatatcatttcataacatataaccccaaaactttgtggcataaaatcacaatatttattacctaattgagtttctgtaaatgaggaattcaagaacaatttatcatggtggttgtgcctcaggatatctcatgtggttacagagtttaactggggctgtcatccaaagccttgaccgaaactagaagatccactttcaagtttgctcacattcacggcccacaagttggtggggtttgtaattgaaggcctcaggttctcttcacatggatatttttgtaaggttgcttgactgttctcaccaaataattgctggtttcttccacagtgagtgcttaggaaaaagcaaagcataagtggcaaaatctttatgctctagactcagaaatcacacttgttcacttctgtcacattctattcaccagagaggattattaaacttgacatactttcaagaggaagaaaattaggatcaatgaaaggacttcaataagtttgtaaaaaaaaaaaaaaaaaaaacaaagtaaaacacaaaaacaaaatatatactttatttctcaacataagcttcatcaaatgcaagacacttttataagcaataatacctatccctacaaaaactaaggtcctgggaatttaaccatgtcaagatagtcttttttacatcattaactgaagaaaatgggtgtcctgaaaccatccccccgtctttttctgatttttttaagatcagaaaagaaaatgaagaagttagcaggagccaaatcagggctaaaaggtggatgcccaataatattccattgaaactggcaaaattgtcttttttttgatgagaggaatgaggagaacattgttgtggtggagaattctctggtgaaatttcctggaagtttttcttctaaagctttaactttctcaaaatactctcataatagcacgtgttattggggtttggttttggtcctctagaaagtcaacaaacaaaatgccttgagcatcctaagacactgttgctatgagctttgttctagacagtcaccttttgctgtgactggaccacttttacctcttggtagccattgcttttatagtgttttgtcttgaggatttcactagaacagctgtgtttgacctcctcttacaattatttgaagaaatgcttcaggatcttgattccacttatgtaaaatttcagttgaaagccctgctcttgtctgcagctgatgtggaaacaagagttttttaatctattgagtggaaaagttttcaaaattgtgtatatttaaccagttgagatggctatgatgttagctgttgtttatgctgttgtcattcctaaagcagggcatgaacaagtttttttttttttctggtgaattaatgtgaattgtctgccactgcaggctttatcttcaacatcgtatcccttcttcaaatgagttattcatttgtaaacttgtgaatgttggggggcagtgttctcataaacttgtcataaaagaatcagtgattttactattcacccaaaattgccatattgctataaattttatgtttattcttgctttaattttagcagaattcatgttgctctaatgggacctcttttcaaattggtgtcttagttttcttattataattcctcaaattagatcctgttcagacatgttataagaagttagtacaagtttatttaggtgcaaaatatttttgaaatctatgcatagtttcttcataatatgcacttcctatgaactttttgaagatgcctcatactttttgaagactttcaaataatttttgaacatatttttaaactaccacaaaaaaattatctatagcaccgaatttcagatttaccaagtttgtgataagtataataaccaatggaaataccagatgggcagtttagctattgaaatagaattggagttaaatgattatagaggtattcagtaaagacctgcaggcattgaaaagcattaaaaaatttagaaatcaaagaacaggattatatgtaccatttaagaggaggaagatgagaggaaatatatcagaaaaaaaaagagcacagaggaggatcaataacagcaaatgttatgtaaaacttaaggacagtgtagccattgctattctccacagagcactgacatttccttgtcaatagtatcactgaaatgcctgcttccatttccaacatcctgtctttgtgaagcagggttttttgcagtgacagcaaccaaaacaaggttacagagtagattggacataagcaccacattttgggtgtcactgtctcccatcatcccctgatggaactgtctagttgcaggaaaacaagctcaggtctcccactgattctatattatgatgagttgtataattatttcattttataatacagtaataatggaaataaaatatgcaataaatgtaatgtacttgaatcatcctgaaaccatccccctgtccagtccatggaaaagttgtttttcacaaaaccagtccctggtgccaaaaagactggggactgctgcaatataggaataacaatataaagagaggaaaacacgaaacctatcacatctttaatagtatatgtactgatggtgtacagaatacactaattacattcattcatttaatatcaaccaatacctacaaatcacatacaaatgcctggaattattttaggagaacggtgaacaaaaaagcaagagagacagcaaattaaaaatatacatgtatgattatcagagcaagaccccatctctacaaaaaaaattctacacacatacgccaggtagtaatgagtactaattaaaaaaatgaagagtgagaggagaaagagacagataagttaattcatgtagaacaatcaaggaaggttttctgcgatgacagtagttaccagcgcaggttttagaatcagatgccagttttaatcgtggctccatgtcttatagctgggtattccatggacaatttagtctacttttaaatctcacttttctttttttttttttttttgagttggagtttcactcttgttgcccaggctggagtgcaatggcatgatctcagctcaccacaacctccgcctcccaggttcaagcgattctcctgtctcagcctccctagcagctgggattataggcatgtgccaccacgcccggctaattttgtatttttagtagagatgggtttctccatgttgatcaggctggtttcgaactcccgacctcaggtgatccgcccacctcagcctcccaaagtgctgggattacaggcgtgagccactgcgcccagccaggtcttttaataatttatgatagctttatatatatattacccaaattagctttttgtctgtcatgtatgttgcagatctatttccccagtctgttgacttttgactttgaggcatttttctctcatagaaagttttaatttttacagagtcaaatgcatcaatcttctatacaatgacttcatgggtatggtgtttcagtttagaataaaaaagttgtagatatgaataaaggagatggctgtacaacactgtgaatatactggatgtgactgaactgtacatttgaacatggttaaaattgtaagttttatgatatgtacattttaccaccaaaaaaaggacaggcttagatgtttattatatattaggggtttggagtacctgtaatatttattcccctccagggctctaatttataaaacacccaaacaagaaaagtagatattgacttcacaaatccccatggcaccttacaagccccacagcacgggctgtctgggaaagtagaggtagaaaaagtcacataaacttgaggtcaatgtgagacctcccctactctggaaccagatggaggaaggcatgcatgcaggctgacctggagagatggggtgggcagaacagtcctcccatgagcccagatcttaagtgctctcacatgctctcaggcatgtatcaaaccaagaaagcaggctaagagggtaacacatctacctgtatacagggagctatgaaatatctgagctgagcaagtgatgcacaagaggacagaatcagtatgacctttatacagtgacctggctcaaataattccaggctgtcattaaccaggtgagctcctctagagggggtgaagtgggagttggggatcatggaaaagaaagcatggtagcatttcttctaactctatcataaataaaaaggccaggcaaggtgactcacacctgtaatcccagcactttgggaggccaaggcaggtggatcatgaggtcaggagattaagaccatcctggctagcacaatgaaaccccgtctctactaaaaatgcaaaaaattagctgggcctggtggcatgcacctatagtcccagctacttgggaggctgagcaagagaatcacttgaacctgggaggcggaggttgcagtgagccaatattgtaccactgcactccagcctgggtgacaaagcaagactctatctaaaaaaaaaaaaaaaaaagtaacacatcaatgccctttctcaggacccaaatgtcaggtgaaaaaaatttttgtcatctcagtcatgtaatatggactttagcagagcagtatacacatggtcatttactcttttctctctgcatgttatatgctttttcaattttacaaggtaactgatccatttgtttcattatactagctgtgaacaaggctgctgaatgtcacaccagatggccagcatgtctgtgaagggcagaaactgggtcagccaaacagctggcagaggccagctagtaagtacctggtgcccactccacagagggctccacacttaaaagacaagacgagcaaatgccaggctgcctcactagttatcccccaaataaaaaaataaaagtaacccctccagggaacaggtgtatgtctacacctaagtacgtgtacacagctgcatgcaaaggggaaaggcttggaaggaatcaaacccatctctgaacagcagttacttctggggaaggagcaggtgctgaacagcagttacttctggggaaggggcaggtgaagccgactctcagccttattcaccttttcaactgatgagctgcatcaattttagcaattttttttaaaaaaggcaatttgtactccttgggtgatcacacaggccttgcaaaactgaaccaccaacaaccacctgcaccacttcccatgaggccaaataatggcttccctcgaagctcagccctcccacgcacttttcagtcctggtcccgtgcagagggctactgacatcctggggtacaggggactaggctgaacccaccccacagattcctggtgaaaccaacatgtatccaatggcctttccccaacctgggccatgtgcctactgcataaatatgcctgttcttgctcccctaggacagaggctcccttttcctacagttggaatgagggatggggagatttgatggtgtcctgtacaagttggatgttaatttgacgtggtgctgctggagaagcttgcctgagtcaggcacattctcagcacgtggtatgtgctgccccttcaaagctgcaggagtctcagaaggtaggtgctaccacaacccccatttactggtgagcagaggtcaggtgacctgcagccagccaagcagctgctaagtggccaacaggctggatctgcatctcacttgcagaggccctgcctggctgctggggctgccctggagactcaccctgcctcctcctcctcttccctccacagttatgctggcttctatccacagctgcactccaggtggggaatacctatggatgcaccagggtgcaactactcaaagactccagtgtgcagaagggcccctgctccatgttgttcccatatccaagcccaagctcatctaggacttcagcaaacccaagcttccctgaattccctgctgagaccaaactgagccctgtgacccacactactacactggttagctgccagtcccagcccctgctccctcctgggcccctgtctgtacagttctgaagtcctacaagaatgttaagatcctaagccgactctcacccagggtggtaaacaaccaggagccaccaggggtagagaacatacccagataggttgtgctgcctgtaggcttaatgtccttccctgactacccaccatgcttgccaggctggaagggggactccagaaacttgggaaacccaggcttacagctggcatatggaaaacaggcctggaagagcaccactcctgtccatgaagccccccagatgaaaccaggtaattatgaaatacatgagtaccatgcctgacccccactcagactcaggtgggaaccgcagcagtgacttgccccttctgccactccggctctaccattgcaggagggaggaacatctgaccccacgcacaagtggagacactaggtgtgggcaggtcccagtggttgctgcaggtgaaccttcccaaccaaccacacaaggccatctcaggtgggtgcacacctgggctgggctgggcaaggacacccctcagagggtaagagccactgaggagggctgtcacagaggccccttttcctgctctgagaataggttcggggagtagggggacctctcccactccttccaggagccacgtctttcaagatgaggcactctgcctccctgttcccatttggccccaataggccattgccaacattcagagaacaaaaagaaaggagcctcacccgttttccctgacacatcggaggcaggtgggtatgcccaggggacctggaatagaacccgttcatctgcccagcccgaggctgtgctggcttcatcttgtctatctgtgtgatgcagggaggagataccaagaggtcatcacacaggccatggacgagttctacaagagccaggtagaagagaactgtccaggcatgctgcccagcacccagctcacacacgcatctcttatttgaagcttccccaaagcaggtcttgaagtccagcctccctgagaagctgcggaggagactcggctgagctaaagggcctatcaccaaatgtgccacccttgcttgtctcatcctggcaatcttggattatttttgccctgaaattttggagcaggggacagggaagacagaagacagtgtgtatcagccctccagactgaggcaggtcagacctccactcgggtacttttctcctcactagttgccagctgggggaagcagcacttgtgagcacctgcctgtctccccaggtcctgttgagaaaccccatctgtgcctttagagactgcccagattacacagacccagcaaccgcatctacagcccccagggcctatccctttctacatgggtttcactgcatgtgagtacacggtgggcttgattcctgcccactactccctgccagataccccatgccctcctcatgaagaaaatgaggccacacggacacactcaacccatcatggtgagagggtggctgaggctctacttgcctacccttcattgctggttcagggccagctgtctggccatatccctacccagaggtgggactttggggacattgtccaccgggatcactggccacttttaaagttccaaaaacagaagatcagctagtcccctcagagttcagtacatgggataagctgcagcttgccttcaggaacaggtttcccaccaagtagatgcccaaggcccagggcacgcccaagtttgtgtgaagcctgtctgccatgtccaaagcccatgctgacccccccaaccctggagccactggaatgcttgttcctgggcatataagaccaagatagctgcagccttgcaggaccactatgcccatctggcagcagcacccagagggcctagagaaagaagttggaggtgaaaccagatgctgttaggatgttttatcaggcaaaaccacatactataaaaaggctttaaaatgcaacagaaggagatgtgaagacacaaacaagtgcctagtgacacatggctatcagaacacattagagaatccacaccacttcccccctttaaccagaaagggcaggctttaggccacctcctcctcctcggctgtggcgtcctggtactgctgatactcagacagcaggtcgttcatgttgctctccgcctcggtgaactccatcacgtccatgccctcgcccgtgtaccagtgcaggaaggcctggaacacacttgaacagctcccggatggccgtgttgttgccaatgcaggtggccatttttagccccttgggtgggatggcacagatagccattttcacattgtgagggagccaatcagcagagtacctgctgttcttattttgaatattgaacatttgctcatccacctccctcatgggcatgcaacctctgaaaacggcagccactgtcaggtagtggccatgacggggctcacaggcaaccatcattcttagcatcaaacatctgctgggtgaactcagccatggtcagggccgagtactactggctggctgccccggctggacagtggagcaaagcgaagcatgaagaagtgtagccaggcaactaggatcacgttcgtggccagcctttgcagatcagtattcagctggcctgggaagaacaggcacgtggtgaccccacttgtggtagcagaaaccaggtgattcaggtcaccgtaggtgggtgtgggcagttttagggttctggaacagatgtcacacagaactacagagcttcactatcaatgcaaaaggtctcatctgcattttccatgagctggtggactgagagggtggcattgtagggctccaccacggtgtctgacaccttgggcaaaggcagaacactgaatgtgtttatgatcctgtctgggtactcccagatcttactgatgagaagagtatccatcagagacccggtacccctacccagggagtgggtaagctggaaaccctgcaggcagtcacagctctcagattctttttcacaacatccatcagcgtctccttcagctctgcaccttctgtgtagtgccccttggcccagttgttcccggccccacactgacctgtaagacaacacagcaagtcgctggatggccagatatacagtcatcaggggtcaccacaatgcaaaaaagggccaagtgtcacgtgtgaggtgaaagcaccattcaccctgcaggtggagcaggtggacctccctcccccaaagctgaaggacagcagcctcccctgttagaagttaagtcaggagccgaacctgagacagcctaacacaacagacctggctgcaggtggctcctgcccatccccaagaaaagcagcagccactgcccccagcccagctccctgcagaaagattgcatcagcagctcctctcaggcagacagctgggccttcctcccaaagcccgtttaggagaaggagattgcgtgactcaggatgggagggtgttcaggggccctagctccacagttcccacagcgatgactttggggcactccttgaatttgagcggccctggctaaggagcctcaccccagtcctcacccgcagctcaccgaagatgaagtcgtccggcctgaagatcctcccgaatggcgctgagcacacagagccgatggtgcccggctccacatccacaagcacagggcggggcacgtacctgccacctgacgggggcgggagggcatcagcgaggagagggccgccattcccaggagggcggctggggaaggacaggggtctcaccgctggcctcgttgtagtacatgttgatgcgctccagctgcaggtccctgtccccgtggcaggtgccagcagagtcgatggcatgttcatcagagatcacctcccagaactgcgagagacacgaggggccaaacaggccagggctgagtcacggaggccagggagcccgaggctccccagcccctctcctatccccacccccaggccgctggatccctgggggtccgccctggctgcctagccagccacccagctccaccgcgtcccaggcgcggagacggggggccgcaatacagccccagccgctgccaacatcttctcgggccacccggcaggcccgcgctgggccctcagagccccggccaccaaccttggcaccgatctggttcccgcactgcccggtctgccatagcacgatctccctcatggccactgctggactagggcggcaggagaaacgcgaggaggagcaggagcgcagcgacagggccagtgctccgccaacgctaaaataaccccgcgcccacctcccccagcctcagattgggctcccagaataagcaacagctttacttccacacaggtgtacccacctgtgaatcccttggcgttcaaggtctgttggagagctcaggtggccttgctgtggtcctttccacgttggggaaagctggtcagctggagaacttcctcccatgtctttagtaagactaaatccctagctgagctgaaatggaattttcctcccgtgtggaggggaagccttttgtttccgtgttcacagagtgcctttgcacctgtcccacattgatgacatatttttgtaattgatgagtccctttctattaggagatctgtggttaggagaggcctcccctatgttaactcgacaggaagtaattgtaagttttcctttggagcagctcaaacccggagtaagctatgggtgttagagatagtcaggcctctgacttagctagggtcttctttagagtatgattaaccctttcacctttccagaggactgcggtctccatgcagagtgaaggtgatattggattcctaaagctgaggatagctgttgggagacgcctgctgtgaaagatgggccattgtcactttgcaggcctttggatgacccaaaaggaggaattatttcttctggtaaacacttgtcagatagggtggggaatgcctggatctaaccagtgaatgtaacagtaagcattagcaaatacctgaatctcctacagaaaggcatctgagtaaattagagttgccagtcctcacctggataggttcctcaatgttggacaggtttaactggaggaggtgaaaattgctgggtctttgggttatgtcagacacagcgctcacagggctgagtcacctgttttagcgtcttgaaaagatttatccccataaacaaatgagacattaactgaagcaaagaatcccttctagggtggaaagaatcatgaaagtgcttaattattttcctacaatgggtgctcggcattagtaacttattaccatcagccagccagccagagggatcctggactgaactgcaatccctggcccatttttgttctcttcagagtgttctggcccagctctgtgtacgctgagcagtatgcccagaagcttcactggccctttcagtgcagtggccttggctgacacatctgtgagggcatttccttttacacggtcagtctctcttttgatgtcctctgcaatgaattacagccacttttttttttaatggcggcaaagcagcattctaacaagctcaaaatctgagtaatgtatggaaaagcccttcgtggtcaggagtccctacccattccaaattgcagcataagcatgaagcactaagaaatcatacttggaatcagtgtaaatgttaacttttaagtcctttcccaactgcagggctctggtaagtttaattgactcagcttttggagctgaggtagaggccagcaaggcttgtgccttgattatcttgtgccgactaataatagcatacctacccttcctgttttcctgatgcataagacaacctgcatctcttaaccactcttccttgggatggtcaaggggctcatctctcttaagtctggcctgctagaataactttgtttcataacccgtgatgcggtttggctgttaaatcttatcttgaattgtagctcccataattcccgtgtgtcgtgggagggacccagtgggaggtaattgaatcagggggcgggtctttcccatgctgttcttgtgacggtgaataagcccatgagatctgatggttttatttttatttttattttttattttttgagacataatcttgctctgttgcccaggctgcactgcagtggcgtgatctcggctcactgcaacctctgtctcctgggttcaagcgatcctcctgtctcagcctcccgagtagctgggattagaggcgcccaccaccaagcctggctaatttttgtatttttagtagagacggggtttcaccatgttggccaggctggtctccaactcctgacctcaggcgatccacccgcctcggcctcccaatgtgctgggattacagctgatgtttttataaatgggagtttccctacacaagctctttttgcctgctgccatgtaagagaagtgattttgctcctcatttgccttctgccatgattgtgaggcctccctagccatgtggaactgtcagtcaattgaacccctttcctttataagttacccagcctcaggcatgtctttgttagcagcaggagaacagactaatacaacctgtatgccagaaaggttgggagcacttgtggaccctggcagataagtaactgggtttatggtttggcagactttaagggttatgtctggagtgtctagcaataaggcctgatactttaataaatgttctcctattatccactggtgccctttagcttctaggaccaccttcccttgatgtggggtcaaaaacctttaggtgctgtcctcatgctagttcattagctttgcctactagaaaagttgcagcagcaacagctctaagacatccaggccaccctgaggccacctgacctatctgcttagaaaagtatgttacagcccttggaacgttccccagttttgggacaagattacccagggcctatgccttgctttttggccacataaagataaaatgattcatccaacttggggactcccacagctgcagcagagcccaatttctctttgagagtattgaagatttgcttgcagttctcattacattcaaggagctctaaatctttcccttttagtgcatcccgtaaatgcttggctacacgtccaaatctgggcacccgtaagcagcagtacccagccatcccctaaaaaggcccacagtcatttgttggactgcgactcttgaatgactaaaagagcttttttacttctagggatgttgatcagttccagaggtgaatacagattccaaatattggagccgttgagtcaaaatctgagctctgtatggtgataccctatatctgctagttcccaggaaatttatcagtttaacagtattattatccgagtcttctttagttgggctagcaatgagtaagtcacctagatactgaataatggtgcctgtttgcaactgtaaatttcttaagtccttagctagggcattttcaaataagtgggggctatcctagaacccttcagagaggaccatccaggttagttttgaggttgaatgagtatctggatcagtccattcaaaggcaaacatattgcgaatctggatacattgagatgcagaaaaatgcatctttcagaactaagaatgtaaaccagcttggatcccctgggacttgggtaaggattggggacaatggggtgtatggagacaacagctgcatttattaatgctctaaggtttctgacaaatctgtacttgccagattaggcttttgatctggtaacatgggagtattgtaaggagactctcatggccttaacaagtcatacggcaagaatttggcaataaggggttgaatttcccctcatgcttcttgccttaaagtgtattgtctcttccaagggcgaggagcactaggccaaagttggatttgaatgggggaagtgtttagtgtgtttcccagagcctgtgtggcccaaacctcaggatttacttgtgagaacacctcaggtggtaaatgtgacagctcatccttaacttctttttttccccgaggggtcaggaataaaagtcacactttctctgctttatgatctgtgaaggtcaccatggcttggtcactggagtcaataaagctctccccagtgagaggtcaggcattcagacaatactagaaaggcaggtgagaagcccagaggccctggagaacaacttagaagataagaaaagcagtgttttccgacttgtccatcatgagaagacgggagcccatcgtattgaatcaggacagagtcatctgcccccatatctaataagaagttaatactcctacctgccacttcaagagtaacctgagtttcctccacctctcaatggctaatagtccagtgggagcggaggcaggaagtatcaggccctaccacttttgggtctgctgggctctgatgatggctctcttagaagcacagtgcattccctttggtagtggctgaccttcttacagagggcacattgatttatacccaaggcacagtggcccagaggcccagactgggactttaaccttctcacttcctctgtgaggaccaggggttaaggggctggctctgaagtggtggagagcacaaggctacagctagaagctggtcctttggggaggtttgttttattttatgttttctctgccctattcctgtgattaaagactgcaaaagccaagtctaaaagcggattcttgggagtctggaggcctaatgctgctttttgcagcttcctgcagatatcggaagcagactggattataaaatgaactcctagcaatgcctgtcccttcttggagtcaggggcagtgttagtgtatttcctcaaagtctaaattattcacccttgtaataaggctaggttttcatcttttctctgagtaattttcctgactttataaaaattaaaaagcttcatcacacatcacactttttttattccttcaaggagtcaagtgatcataatttttttctctatatatcctactctcttcctaattcattcctcttttctaggtcctaattctcttttgggtcctggtcaggcactgctgtgcctcctacttgataggtgtcatgtccctggatgcaggctgccactctattagcatgtgctcttgccaatcccataatacactgcttttctaccatgcagcaggtagacataaatatatgcaaattttgcctggtcaaatcatacatcaaggttagcctcttcaacttgtctatgaatttttctggatcctctgaaaactgtttaagtttttccttgcatatggctaattcagacacagaaaaaggtacatatacctatatggtgtccccatcatcatctgccacttcccagagcaggcaaagattcaactttgccagctgataagaggctccactgcaagttgttctggtgaggctcgggtctttgagagtgggtatgtatgtaagacaggactcgaaggtcagggaggagatgatgaccggacactagattaccctggaaaaccagaaggacttaacatgttgcacatctcaccggaactggaaggagtctgtgttcttacggggtgcttggacttgcaggggagagttcagccccagctaagaaaagcctaatattaagaggcacttgcattaaagggtaatcaattatgtccagttcctcttttgtcttttcctccatcaaacaaatacaagcccattttaattttttatcctgactaagcatcagagaagcctgtacatagtgtatttcctcccatttagtttctcttctataagacaaattaagctgcaaaaagaggagtcagaccaaacaggggaaatgggaaggctgtaacttgtgtattgtaatgtattagcccattttctcacagctatgacaaaactgacaaaactctttcagggaaaaagtgacatgctggctttagaaagtagggtccaactgtcctatagcagcccatcaaagatgaccttctggttaagaaatgacaggaaactgttaaggaaaagtctcatgttcttcatcttgaggctaattgtttccagggggttgttggaaaagaggctgtcgctaaacaggtatagctgatcttgtcatgcagggctgttaaataccacatttcaacttctaatcatatgatggagaggttattgctgatcttttctgataattaaggtgcaaaaatactaggttccaagacatctgttttttccagtgaccctgggaccagtggcaaattaaacaagccatcaactgaaagtcaggatcgttgaggaaggcaaaagcttaactgcttgggcctccttcctgtggcagcctccgggctgctacaaaacagaggtggtgagcagacaggcgacaagatgcagagcactcaggtgagggacagagagcacaaggtggacagcccaaaaagacaaagtggcaaacatcttgtttagtcaaattcattcttctcaatataccccagggcctctaaccctgtgagcttggcctctaatctgagtatgatacccccgggcctctaactttttgggctgagtctctcaccctaacattataccctggggcctctcgcttaagtaatagtggataatcattcttgtccaccagaatggcttcacaactctaaaagatggcccacttgcccaatcaatcagtgtcagcagattgattctgtgtggattgttttccttggagtggggatcttgtcttggtgtcccttcatggtgttactgaaagatgttgctggaaaagagggtcctgatacagaccacaaaggaggattcttagatcttgtgcaggaaaacatctgaggtgagtcagagaccacagtgcaagaagcaagtttattagaaatgactccattacagagttgggcatcctcagaaaacaaaagcaggaatgcaatgtcttttgttagtgtctctacttataagtaactgtaaagagaaagagttacaattaaacttggaaggtgcagatgtactcactaaaggcaggggttattggttttaacaatgaccattaaccctttgacctaagctagctcattaaatttatctttaagaaaaaatgctgcactcctaggacatttatacatttttaaggctggatggaagatgtcttgtatggccttaaattatacgatgggctcccgtcttccatgatggacaagtcggaaaacactgcttttcttatcttctaagttgttctccagggcctctgggcttctcacctgcctttctagtattgtctgaatgcctgacctctcactggggagagctttattgactccagtgaccaagccatggtgaccttcacagatcataaagcagagaaagtgtgacttttattcctgacccctcggggaaaaaaagaagttaaggatgagctgtcacatttaccacctgaggtgttctcacaagtaaatcctgaggtttgggccacacaggctctgggaaacacactaaacacttcccccattcaaatccaactttggcctagtgctcctcgcccttggaagagacaatacactttaaggcaagaagcatgaggggaaattcaaccccttattgccaaattcttgccgtatgacttgttaaggccatgagagtctccttacaatactcccatgttaccagatcaaaagcctaatctggcaagtacagatttgtcagaaaccttagagcattaataaatgcagctgttgtctccatacaccccattgtccccaatccttacccaagtcccaggggatccaagctggtttacattcttagttctgaaagatgcatttttctgcatctcaatgtatccagattcacaatatgtttgcctttgaatggactgatccagatactcattcaacctcaaaactaacctggatggtcctctctgaagggttctaggatagcccccacttatttgaaaatgccctagctaaggacttaagaaatttacagttgcaaacaggcaccattattcagtatctaggtgacttactcattgctagcccaactaaagaagactcggataataatactgttaaactgataaatttcctgggaactagcagatatagggtatcaccatacagagctcagattttgactcaacggctccaatatttggaatctgtattcacctctggaactgatcaacatccctagaagtaaaaaagctcttttagtcattcaagagtcgcagtccaacaaatgactgtgggcctttttaggggatggctgggtactgctgcttacgggtgcccagatttggacgtgtagccaagcatttacgggatgcactaaaagggaaagatttagagctccttgaatgtaatgagaactgcaagcaaatcttcaatactctcaaagagaaattgggctctgctgcagctgtgggagtccccaagttggatgaatcattttatctttatgtggccaaaaagcaaggcataggccctgggtaatcttgtcccaaaactggggaacgttccaagggctgtaacatacttttctaagcagataggtcaggtggcctcagggtggcctggatgtcttagagctgttgctgctgcaacttttctagtaggcaaagctaatgaactagcatgaggacagcacctaaaggtttttgaccccacatcaagggaaggtggtcctagaagctaaagggcaccagtggataataggagaacatttattaaagtatcaggccttattgctagacactccagacataacccttaaagtctgccaaaccataaacccagttacttatctgccagggtccacaagtgctcccaacctttctggcatacaggttgtattagtctgttctcctgctgctaacaaagacatgcctgaggctgggtaatttataaaggaaaggggttcaattgactgacagttccacatggctagggaggcctcacaatcatggcagaaggcaaatgaggagcaaaatcacttctcttacatggcagcaggcaaaaagagcttgtgtagggaaactcccatttataaaaccatcagctgtaatcccagcacattgggaggccgaggcgggtggatcgcctgaggtcaggagttggagaccagcctggccaacatggtgaaaccccgtctctactaaaaatacaaaaattagccaggcttggtggtgggcgcctctaatcccagctactcgggaggctgagacaggaggatcgcttgaacccaggagacagaggttgcagtgagccgagatcacgccactgcagtgcagcctgggcaacagagcaagattatgtctcaaaaaataaaaaataaaaataaaaataaaaccatcagatctcatgggcttattcaccgtcacaagaacagcatgggaaagacccgccccgtgattcaattacctcccactgggtccctcccacgacacacgggaattatgggagctacaattcaagataagatttaacagccaaaccgcatcacgggttatgaaacaaagttattctagcaggccagacttaagagagatgagccccttgaccatcccaaggaagagtggttaagagatgcaggttgtcttatgcatcaggaaaacaggaagggtaggtatgctattattagtcggcacaagataatcaaggcacaagccttgctggcctctacctcagctcaaaaagctgagtcaattaaacttaccagagccctgcagttgggaaaggacttaaaagttaacatttacactgattccaagtatgatttcttagtgcttcatgcttatgctgcaatttggaatgggtagggactcctgaccacgaagggcttttccatacattactcagattttgagcttgttagaatgctgctttgccgccattaaaaaaaaaagtggctgtaattcattgcagaggacatcaaaagagagactgaccgtgtaaaaggaaatgccctcacagatgtgtcagccaaggccactgcactgaaagggccagtgaagcttctgggcatactgctcagcgtacacagagctgggccagaacactctgaagagaacaaaaatgggccagggattgcagttcagtccaggatccctctggctggctgactgatggtaataagttactaatgccgagcaccaattgtaggaaaataattaagcactttcatgattctttccaccctagaagggattctttgcttcagttaatgtctcatttgtttatggggataaatcttttcaagacgctaaaacaggtgactcagccctgtgagcgctgtgtctgacataacccaaagacccagcaattttcacctcctccagttaaacctgtccaacattgaggaacctatccaggtgaggactggcaactctaatttactcagatgcctttctgtaggagattcaggtatttgctaatgcttactgttacattcactggttagatccaggcattccccaccctatctgacaagtgtttaccagaagaaataattcctccttttgggtcatccaaaggcctgcaaagtgacaatggcccatctttcacagcaggcgtctcccaacagctatcctcagctttaggaatccaatatcaccttcactctgcatggagaccgcagtcctctggaaaggtgaaagggttaatcatactctaaagaagaccctagctaagtcagaggcctgactatctctaacacccatagcttactccgggtttgagctgctccaaaggaaaacttacaattacttcctgtcgagttaacataggggaggcctctcctaaccacagatctcctaatagaaaaggactcatcaattacaaaaatatgtcatcaatgtgggacaggtgcaaaggcactctgtgaacacggaaacaaaaggcttcccctccacacgggaggaaaattccatttcagctcagctagggatttagtcttactaaagacatgggaggaagttctccagctgaccagctttccccaacgtggaaaggaccacagcaaggccacctgagctctccaacagaccttgaacgccaagggattcacaggtgggtacacctgtgtggaagtaaagctgttgcttattctgggagcccaatctgaggctgggggaggtgggcgcggggttattttagcgttggcggagcactggccctgtcgctgcgctcctgctcctcctcgcgtttctcctgccgccctagtccagcagtggccatgagggagatcgtgctatggcagaccgggcagtgcgggaaccagatcggtgccaaggttggtggccggggctctgagggcccagcgcgggcctgccgggtggcccgagaagatgttggcagcggctggggctgtattgcggccccccgtctccgcgcctgggacgcggtggagctgggtggctggctaggcagccagggcggacccccagggatccagcggcctgggggtggggataggagaggggctggggagcctcgggctccctggcctccgtgactcagccctggcctgtttggcccctcgtgtctctcgcagttctgggaggtgatctctgatgaacatgccatcgactctgctggcacctgccacggggacagggacctgcagctggagcgcatcaacatgtactacaacgaggccagcggtgagacccctgtccttccccagccgccctcctgggaatggcggccctctcctcgctgatgtcctcccgcccccgtcaggtggcaggtacgtgccccgccctgtgcttgtggatgtggagccgggcaccatcggctctgtgtgctcagcgccattcgggaggatcttcaggccggacgacttcatcttcggtgagctgcgggtgaggactggggtgaggctccttagccagggccgctcaaattcaaggagtgccccaaagtcatcgctgtgggaactgtggagctagggcccctgaacaccctcccatcctgagtcacgcaatctccttctcctaaacgggctttgggaggaaggcccagctgtctgcctgagaggagctgctgatgcaatctttctgcagggagctgggctgggggcagtggctgctgcttttcttggggatgggcaggagccacctgcagccaggtctgttgtgttaggctgtctcaggttcggctcctgacttaacttctaacaggggaggctgctgtccttcagctttgggggagggaggtccacctgctccacctgcagggtgaatggtgctttcacctcacacgtgacacttggcccttttttgcattgtggtgacccctgatgactgtatatctggccatccagcgacttgctgtgttgtcttacaggtcagtgtggggccgggaacaactgggccaaggggcactacacagaaggtgcagagctgaaggagacgctgatggatgttgtgaaaaagaatctgagagctgtgactgcctgcagggtttccagcttacccactccctgggtgggggtaccgggtctctgatggatactcttctcatcagtaagatctgggaggagtacccagacaggatcataaacacattcagtgttctgcctttgcccaaggtgtcagacaccatggtggagccctacaatgccaccctctcagtccaccagctcatggaaaatgcagatgagaccttttgcattgatagtgaagctctgtagttctgtgtgacatctgttccagaaccctaaaactgcccacacccacctacggtgacctgaatcacctggtttctgctaccacaagtggggtcaccacgtgcctgttcttcccaggccagctgaatactgatctgcaaaggctggccacgaacgtgatcctagttgcctggctacacttcttcatgcttcgctttgctccactgtccagccggggcagccagccagtagtactcggccctgaccatggctgagttcacccagcagatgtttgatgctaagaatgatggttgcctgtgagccccgtcatggccactacctgacagtggctgccgttttcagaggttgcatgcccatgagggaggtggatgagcaaatgttcaatattcaaaataagaacagcaggtactctgctgattggctccctcacaatgtgaaaatggctatctgtgccatcccacccaaggggctaaaaatggccacctgcattggcaacaacacggccatccgggagctgttcaagtgtgttccaggccttcctgcactggtacacgggcgagggcatggacgtgatggagttcaccgaggccaagagcaacatgaacaacctgctgtctgagtatcagcagtaccaggacgccacagccgaggaggaggaggtggcctagagcctgccttttctgggtaaagtggggaagcggtgtgggttcttatagtgtgttctgatagccatgtgtcactaggcacttgtttgtgtcttcacatctcctcctgttgtgttttaaagccttttcatagtatgcggttttgcctaatggagcattctcttagcatctgctttcacctgcactttctataggccctctgggtactgctggcagatgtgtgtaattgtgctgcaaggttgcagctgacttgggcttctatgccaaggaacaagcattccagtggttcctggcgggatcagtatggattatggacatggcaggcatgctccacaggaacttgaggctgccctgggccttggttatctgcttagtagggaaactgcttcctgaaggaaagcctggctgctcctccccaggaccagctgacctctgtaacttaaaagtggccagtgctgcccaccgctcccccaacttccaaaagggttgggcaattctaccccaaggtgggaccttggagacaatgtagtaacacagctggtcctgaaccagcaataaagggtggtgaaatagagccccagctaccccttccccatgatagcctgggtgtgtcagtgtgacctcttccccctaatcatgttggcacacggatatctggcagggtcggatactagttggcaggaatcaagcccactgtgtactcacatgcatgcagaagggaattaggtcccatatagaagggaattaggccctgggggctgtacatgtggttgctgggcctgtgtgctcagtgcagtctctccagggcataggtgcagtttctgaacaggaactgggaatctggcaaccagtgaggaaaatgcccatgcaggggtctgtcctgccccaggttggagggatggcactctggaaaagtgattaatgtacactgcctcttgtctcccctatcccctgcttcaaagcagggggagaatacaaggctgtcaggatgagagaggtggaagtcgtacctttggggtcaggcccttgagccacagcctctttcccaggcctctcagggagcctggacttcaaggcctgcctcactgaagctgtcaaataagatggatgtgagctgggtgctcgggagcacacccaggacagtgctcttctacctggctcttgtagaactcatccatggcctgtatgataccctcttggtaactcacaccctcacacaagtggattgggaggatgaagccagcatagcctggggttgggcatatgtttaggtcctaccccagatccccttggccttcccctaggcctacccacctgcctcagatgcgtcagggaaggcaggtgaggctcatttccctcaatgctggcaactgcctcttgaagccaaattggaacaggcaagcaggggagtgtctcatcttcagaaaagatgggctcctggaagcagctaggaagtgagagaagtcccccttactgccccaacctgttctcagagcaggaaaatgggcctctgtgacagctctcctcactggctctcaccctctgaggggtgtccttgcccagcgcagcccaggcctgcacccacctgagatggccttacatggatccggttgggaaggttcagctgcagcaaccactggaagctgcccacacctagtgtctccactcatgggtggtgtcagatgttcctccctcctgcagtggtacagccagagtggcagaaggggcaagtcactgctgcagttcccacctgggtctgagtggggcccaggcttggctcctgtgtatttcccaatcacctggttccacctggggcttcatggctgggagtggtcctcttaggggcctttttttcatatgccacctgcaggtctgggtttctcaagtctcaggagtcccccttccagcctggctagcatggtgggccataggggaaggggcatgaagcttccagaaagcagaacctagtggctgctggtggttttcctccttcagtgggagtcagctcagaatctcaacatccttgtagagtttcaaaacagtacagacagggtagcatgtaagcaattgaggcagaatggtggggccaggagggagcagggccaaggcctggtggcttacccatgtacaggggattgtaggggattatctactatcagggaattcagtgtagcttggtcttgctaaagccctagatgaacttgggcttggacatgggagacagcatgaagcaggggctctactacatgctgcggtttttgagcagctgtgccatggtgtgcccatagatgttccccacctggagcacagccgtggttagaagctggtgtagctgcagagggaagaggaggaggcaggaggagtctcaagagcagcctcaggcagccaggcaggggcctctgcaagcgaaatgcagatccagcctgttggcctcttagcttcttggcctgctgtagatcacctgagctctgcttagctataaatgggggttgcagtagcacccgccttctgggattctcgcagcttgaaggggcagcacacaccacgtgctgagaatgcacctgactccggggagcttttctgacagcacatcagattcagcatacctaacctctaccagacaccatgaaatcttccctacccctcattccaactgaaggaaaagggagcctgtcctaggggagcaagcacagacatatttctgtggtaggcacatggcccaggcttgggaaaaccccttggacacatgctggtttcaccaggaatctgtggggtggatttagcctggaaccctgtaccccaggaggccagtggccccctacatgggaccaggactgcaccctaggaggccagtagccccctgcatgggaggcaggtggtgggactgaactttgagggaagtcatcatttggcgtcaggaaaagctgtgcaagtggttgttggtggttcagttctgcagggcttgtgtaataacccaaagcgtgcaaagttaccataggctcatcagtttaaaaggtaatggggacagttggcttcacctgcccctttcccagaagtaactggtgttcagaggtggatttggtttcttccaagccctttcccttcgcatgtagctgtgtgtgtgtatttaggtgtgtacacacacattctgtagaggagttttgtctttctatttgggggcatgactagtgaggcagcctggcatttgcttatcttgtcttttaagtgttgagtcctctgtgaagtgggcactgcgtccttactagctggcctctgccagctgtttgttcctccagtttctgcccttcacagacatgctagccacctgttgtgacattcagcagtctggtccccagttagtaacatgagaggacttaatcagctacatcataaaactgaaaaagctcacactatgcagaaagtataaattaacatttgtatactactcggctggggtccacagtacatgactgagatgacaaagaggttttttcacctaatatttggaccctgaaagagggcatttatggttttcttatttagaacacagaataaatactacccaaaattatccccaactcccacttcacccctctagtttacctacctcggagagaaagaggaactcacctggttaatgcaagccggaaattttgagccaggtcactgtgtaaaggtcatactgcctctgacctctcatgtgtcacattctcagctcagatatttcatagctccctgtatacaggtagatacagtaccctcctagcctcctttcttggtatgatacatgcctgacagcatgtgagagggctcaaggtccaggcttatgggatgatttgggcaagactgttctgcttgccccatctcatgtctccaggtgaacctgcatgcgtatgttcctccatctagttccagaataggggatagggttatatggtttggctctgtgtccccacacaaatcttaccttaatttgtgataaagcccatgtgtcaaggatgggacgaggtggaggtaattgaatcatggggcagtttcccccatactgttctcatggtagtgactgagttgtcccaagagctgatgattttataaggggcttcccccttcacttggctctcacttctctcacgcctgctgccatgtaaggtgtgactttgctcctctttcaccttctgccatgattgtggggcctcgtcagccatgtggaactgtgagtccattaaacctcctttcctttataaattacccagtctcaggttgtctttattagcagtgtgaggacagactaatacagtaaattggtcccaggagtagggtgctgctgtaaagacaccccaaaatgtggaagtgactttggagttgggtaacaggcagaggttggaacagtttggagagcttagaaaacaggaagatgttggaaggtttggaacttcctagagacttgttgaatggctttgaccaagttgctgatagtgatgtgaacaataaggtccagactgaagtggtctgagttggagatgaggatcttgttgggaactgcagtaaaggtcactcttgctatgcaaagagactggtggcactttgcccctgccctagagatttgtggaacttttaatgagagagatgatttagggtatcttgcagaagaaatttctaaacagcaaaacattcaagaggacacagagggaccaggcacggtggcttatgcctgtaatcctagcactttgggaggccaaggtgggcagattacttgaggtcaggagttcaagaccagcttcaccaacaaggggaaaccctgtctctactaataatataaaaattagccaggcatggtggcaggcacctgtaatcccagctactcaggaggctgaggcaggagaatcacttaaacccaggaggcggaggttgcagtgagccgagatcacaccattgtactccattctgggggacaagagtgaaactccatctcaaaataaagaggaagcagagcataaaagtttgaaaaatttgcagcctgatgatgcagtagaaaagaaaaaactcattttctgggaagaaattcaagcccacagcagaaatttgcataagcaacagggagctgaatgttaatcaccaagacaatggggaaaatgtctccaaggcatgtcagagaccttcacagcagcccctcccatcacaggcctaaaggcctgggaggagaaaatggtttcctgggccaggcctagaggccccctgcagtgtgcagccttgggacatggtgccctgcatcccagtcactccaaccatgactaaaagggaccaaggtacagttcaggccattgcttcagaggtacaagcctcaagccttggtggcttacacatggtgttgggcctgcaggtgtgtagaagtcaagaattgaggtttaggaacctgtgcctagatttcagaggatgtatggaaatgcctggatgtccaggcagagatttgctgcaggggtacagcccttctggataacctctgctagagcagtgtggaaggaaaatgtgaggttcgagcccccacacagagtccccactggggcactgcctagtggagctgtgagcagagggccactatcttccagatcccagaatggtagatccacctacagcttgcactgtgcacctgaaaaagccccagacacacaatgccagcctgtgaaagcagctgagggggcaaggctgtaccctgcaaagccacagggacagatctgccccaggctgtgggcagccttgcatcagcaagacctggacatgagacatggagtcaaaggagatcatttcagagctttaagaattgactgccccactggattttggaattgcatggggcctgtagccccttcattttggccagcttctcacatttggaacaggtgtatttatccaatatctgtacccccactgtatctaggaagtaactaactttcttttgactttacaggctcataggtggaagggacttgtctcagatgagactttagagtatggacttttgagttaatgcttaaatgagttaagactttgggaaagcaaaattggttttgaaatgtgagaacatgagatttgggaggggctgtggatggaataagatggtttggctctgtgtccccacccacatctcaccttgaattgtgatattccctatgtgtcaagggtgggaccaggcggagagaaatgaatcatggggggtggttcccccataccgttattatgttgagtgagtcctcatgagatctgatggttttataagggacttcccacttaacttggctctcacttccctcttgcctgccacaatgtaagacacgactttgctccttctttaccttccattgtgatcttgaggcctccctagccatgtggaactgtgaaaccattaaaccttctttcctttataaattacccttataaattacccagtttcaagtatgtctttattagcagcatgagaagagacaagaagtctcatattgacctcaagtttatgccagtttttccacatcagctttccaagacagtccctggtgtggggcttataagatgccatggagatttgtgaagttaatatctacttttattgtgtgggtgctttataaattagagccctggagaggaataggtgtcaaagctactccaaacctctaacatataaacatctaagcctggcccttttttggtggtgaaatatatataacattaatcttaccattttaatcatgtttaaatgtacagttcagtggcattcagtatactcacattattgtacgaccatctcctttattcatatctacaactttattattatcctaaaatgaaacaccatccccatgaagaagtcattgaatagaagactgatgcatttgactccataaaaattaaaactttctatgagagaaaaatgcctcaaagtcaaaagtcaacagactggggaaatctctaacatatataacagacaaagagctaatttgggtaatgtatatataaagctatcataaattattaaaagaccagcagcaaaattgaaaaatggacaaagaatgttgtattagtgcattttcatgctgatgataaagacatacccaagactcagcaatttacaagaaagaggtttactggacttagtttcacaaggctgaggaggcctcacaatcatggtggaaattgaaaggcacgtctcacatggtggcagcaggagagagaataatagccaagtgaaacaggtttccccttatcaaaccatcagatctgatgagacttattcactaccacgagaacagcagaggggaaactgtccccatgatccaagaatctcccaccaggtcactcccacaacatgtgggaaatatgggagtacaattcaagatgcgatttgggtggggacaccaagccaaaccatatcagatataaagagacagttcaaagaaaaatgtagatttttaaatacttgctaatttttttactgtggtaaaataggcataacaaagttgaccactttaactattttgaggtgtataatttagtggcattaagtacaaatacattgttgtgcaaccatcaccactatccattttcaaaactattttatcatcccaaactgaaactctatccatggaacaataactccccatttcccttcttctcatcccctgacccccactattttattttctatgtctataaatttgactactctaggtacttcatataagtggaagcatacagtatttgcttttttgtctgacttattttacttagcaaaatcttctcaaggtttgttgtagcatttatcaaaatttatttttaaggttgaatataatatatcattgtatgtattgactatatttgcttacccattcatctatagatggacattttggtggtttctacactttggctattgtgagtgctgctataaacatgggtgtgcaaatatctgtgcaaattcctgctttcagttcttttaggtatatacccagaagtagaattgctagatcatatggtgattactgttttccatagtagctctgccattttactttcccaccagtagtatgcaagagttctgacttctccacatctagcatttgctgttctctgggtttttgttgtttgttttggtttgttgttggttgttttttttatggtagctatacttatatgtgtcagttggtattgcattgtgcttttgatttacattgttctcatgataattgatgctgagcacctcacctgtgcttactggtcatttgtatatcttctttaaagaaatgtgtattttaaaacctttgctcatttttaaatttgattttgttgttgttgttgctgaggtctttatatagcctggatattaattacttatcagatatataatgtgtggatattttctccccctctgtgaattgtattttcaatctattgattgtatcttcagacacacaaaaggtcttaactttaataaagttatttttatgtattttgttgttgttgcctgcactttcactgtcatatccaagaaattgttgccagattctatgttatgaaactttttccctatgctttcttctaagggttttatagttttagctcttacaattagatgtttgatccatttttaattgttttgtacatggtgtaaagtaagggttcaacatcattcttttccatgtaaatatccagtttttctagcactatttaaaaaatactgtcctttctcattgaatagttttggctcccttgttgaaaattatgaccaatattgccttggtctttatgtctgtctctatgctggtacaacattttttgggtactgaagcattgtagtaagttcaaaaccacgaggcgttaatcctctaacttcatttattttaatatagattgggactcttgggtttttttgagatttcgtctgaattttagaataggtttttctacttttgcaaatgttgggatttttaaaggaatttcattgaatctgtagatgactatagataacaatgacatcttgacaaggttttgtcttccaatccataaacacatagtgtcttttcatttgagtcatctttaatatctttctgcaatgtttatagttttcactgtacaggtttttcattaccttggttaagttggtttctaagtattattttgatggtatcataaatgatatagtttattgttattgtagaaatacaaatgattttatgtattaattttgtatcctgcagctttgttgaattttatttattgcttctgacagtttctttcacaaaaactataggatttttaatatacaagtttatatcatctgcaaacagatacttttaccttttctttttagttggaattttttattctttttcttgccttattgctctaactagaatcttccatactatgttaaatagaagtggtaaaagcaggcatccttgtttttgctcttaggataaaagctttcaccattatgttaaccgtgtgttttttttttttaatgtataacatgttaaggtctttcctttctgtttatagtttcttgagtattttttatgaaagtgggttaaattttgataaatacttttttctgctttggttaaaataatcacatttttctttacgtttttttcttttcttctttacgttaatgtgatattacattgatttttatgtgttggagcatacttttacttcaggagtcaattatactcattcatgttgtataatccttttaatgtactgctaaatttaaattgctagtattttgttgaggattttcgcatcagcatttgtaagtgatgtttgtctgtagttttctcgtgtttggtgtctgggtaatactggcctcatagaatgagttagaaaatgttacctcctcttcaaatttttgaaagagtttgagaaaaactggtattaattctgctttaaatgttgggtagaattcaacagtgaagccatctggtctagggcttttctttgttgctgggtttttggttactgatgcaatgttcatactgaatctccttgatgaataggtttattaagctattctattcctgattctgtcttagtaggttttttgtttctaaaaatttgttcattttatttaggttattcaatttttttggtgtacagttgcttatggtactctcttatatcctttttcactctgtaagtttggtataactcattgaagttataacttctccagtagccaattatttcaaaggccagacatgtactccttaaaaaatgactaaaactgacagcttgtagaaagccataaaaatctttattgtactgtgttgttctggtaatacacttgtaagatgcttgccaaaaataaatactggaaaatacttttcaatttctcaagcagattactgcaacagtaacacatcaagacttattcattaataatgaaaaaatatgaattgttatactgaatctggatagaaaaactaggtagttttatacctatcttcattatctgtacaatgttacctttcaaaatatttttaaagtgttaactttatgggaaaaaatgaggtatttgaaaacggttagaaagtttaacaaaaccttataaactcacatgtcttttactgggatatccttgaagatctgacagttttccactttgtacagcttgatcatgcataatcttggaggcaaaaagaatgactcccaaggaaatccttttccagttagatggacaaatgtcaatttcagcataagtcaagatcctttccaggtaaatttgcaaagagagcactgatgttttattttagttcaatttagctgctgtgataagaatgcatgaatgatagattacttctgtttttggccagaaaataaatgccttttatttttatattcttcagattttgcttagtcagccaaagcaagagatcaaatcacagttgtaagtcagatgtctctgccatctactctgtccttagaaatttccagtccaattttgatcacaggaatgactggacatctcagccaagggtatcatgaagacagaaggagtcattaccttcacacccataaaaggcagcacatgcataggcccagtgtgcattaaagttgttaaatgaatacttcagtgcccaccttgtgcaatgtgttgctatatctagtttgcaggtagataggaatttcacaggtatgtcatgcttgattgtataaaacccaggggatactgagtacattgctatcttctccttttcacaataactaatccttctgtggcgctagcttgaacagctagccaagagagcctcccagtggctgctgtgcagaacagcatgacacgttcaggtctttggggccataagatgtttccatattcagtgccttgataaggaacacccgcgtagagaagggcccttctcacagcccctagttttcctatccccacaatcacttcatgaaaatttattttctgatttgttttgttttgtctttagaaggagtctagctctgtctccaggctggagtgcagtggtgcgatctcagctcactgcaacctctgcctcccaggttcaagaggttctcctgcctcagcctcccgagtagctgggattacaggcatgtgccaccatgcccagctaatttttgtatttttagcagagacatggtttcatcttgttggccaggatggccttgatctcctcacctcgtgatccacccacctcagcctcccaaagtgctgggattacaggcgtgagccactgcacccagcttattttctgtcttacatcatctgcaacattgtcaattctgttggcttaaaggcagtaacagctgtcagtctctgatccttgggattccctaaacttgccaagcagtttgtgagaaaatctcatgaagtattttacatctatcaaacatctacctgcaaagaatttggtaaagtgaacagttgagtaaaggttatggaggtaagccgtgaggtgttgttacctcaaagggtgctctgcagaagcatatggtctatatatcatttgaactatgtatcaagacaaaaggaaaacagttcattttatgagagcttattgtctgaaggttatcagattggcagctcagatctgacaacgttctccaaacccaactgtgttttcaaaacagttcattttaagagtttgtttagtatctgaaagttaggttggcaactcagatccggcagtgttccccaaactcaacagtgttttcaaaaacaaaatggctcttgaacacaatgtattcttagattcttctcccttgcacccaaactccacactctcaagtatcctaagaatgaacctcctgccccaggttaatgttctatagatattagagagcattgaaacagcactggcaagccctcaactgcctgttgcctttactgctaagctggtaacctgtggacactcattgataccacttgccttcctgggtcaatgagagagagttcctttttcccactatgccaactctcttatcagtgtggttgatcctgtcccacttccgcagaacactgttcccgcaatcacctctttttgaagactttccctctgcccgaaatcttccccaatatgactgtgtttcctttattctcatcccactctccaaaactcccccagagatgtcctcatttgctcacagcatcatgccctggtgcccgcttctcacctcccatctctccttaaccaaacccacctggcccctgccaccatcactttccagagactcctcatgccaaggtgcccaaccttcacatctgcaaaccagagctcttcatcccaatgctccactccccaagccttccctaatcttgtacagggcatttttattttccccacttgtgaggccagatacatacatttgaattggcttgttccaatctgtgtgcaactcctgctatgtctactttcactggtaggctgcatatttttgattctgtgctgccatttttcactgctcacctgtatcatcctagttgcttctttttattattatactttaagttctgggatacatgtgcagaacgtgcaggtttgttacataggtatacacgtgccatggtggtttgctgcacccgtcaacttgtcatctacatcaggtatttatcctaatgctatccctcccctagccccccaccccatgacaggccctgatgtgtgatgttcccctccctgtgtccatgtgatctcattgttcaactcccacttatgagtgagaacatgcggtgtttggttttctgttcctgtgttagtttgctgagaatgatggtttccaccttcatccatgtccctgcaaaggatatgaaatcatccctttttatggctgcatagtattccatggtgtatatgtgccacattatctttatccagtctatcattgatgggcatttgggttggttccaagtctttgctattgtgaacagtgctgcaacaaacatgtgtgcatgtatctttatagaatgatttataatcctttgggtatatacccagtaatgggatttctgggttcaaatggtatttctggttctggatccttgaggaattgccacacggtcttccacaatggttgaactaatttgcactcccaccaacagtgtaaaagtgttcctatttctccacatcctctccagcatctgttgtttcctgaccttttaacgatcaccattctaactgctataagatggtatctcattgtggttttgatttgcatttctctgatggccagtgatgatgagattttttttcatgtgtctgttggctgcataaatgtcttcttttgagaagtgtccatatcctttgcccactttttgatggggattttttcttgtaaatttgtttaagtttttgtagattctggatgttagccctttgtcagatggatagattgcaaaaattttctcccattctgtaggttgcctgttctctctgatgatagtttcttttgctgtgcagaagctctttagtttaatcagatcccatttgtcaattttggcttttttttgccattgcttttggtgttttatcatgaagtctttgcccatgcctatgctgaatggtattgcccaggttttcttctagggtttttatggttttaggtcttatgtttaggtctttaatccaccttgagttaagttttgtataaggtgtaagaaagggatccagtttcagttttctgcatatggctagccagttttcccaacaccatttattaaatagggaatcttttccccattgctggtttttgtcaggtttgtcaaagatcagatgattgtagatgtgtggcattatttctgaggtctctgttctgttcctttggtctatatctctgttttggtaccagtaccatgctgttttggttactgtagccttgtagtattgtttgaagtcaggtagcatgatgcctccagcttcaatctttttgcctaggattgtcttggctacatgggctctttttggttccatatgaaatttaaagtagttttttctaattctgtgaagaatgtcaatggtatcttgatggggataacattgaatccataaattacttggggcagtatagcaattttcatgatatttattcttcctatccatgagcgtggaatgtttttctatttgtgtcctcccttatttccttgagcagtggtttgtcgttctccttgaagaggtccttcacatcccttgtaagttggactcctaggtattttattctctttgtagcaattgtaattgggagttcactcatgatttggctctctgtttgtctattattggtgtataggaatgcttgtaatttttgcacattgattttgtatcctgagactttgctgaagttgcttgtcaacttaaggagattttgggctgagatgatggggttttctaaatatacaatcatgttatctgcaaacagagataattttacttcctctctttctatttgaataccctttatttatttctcttgcctgattgccttggccagaacttgcaatactatgtgaaggcatccttgtcttgtgccgattttcaaagggaatatgtttccagcttttgcccattcgtatgatattggccatggatttgtcataaatagttattattttgagaaatgttccatcaatacctagtttattcagagtttttagcatgaaggggtgttgaattttatcaaaggccttttctgcatctattgagataatcgtggtttttgtcatcggttctgtttatgtgatggattacgtttattgatttgcgtatgttgaaccagccttgtatcccagggatgaagccaaattgatcatggtaaataagctttttgatgtgctgctggattcggtttgccagtatattattgaggatttttgcatcgatgttcatcagggatattgacctgaaattttctttgttgttgttgttgttgttgttgtgtctctgctaggttttggtatcaggatgatgctggcctcataaaatgagttagggaggagtctctctttttctgttgtttggaatagtttcagaaggataccagcttctctttgtacctctggtagaatttggctgtgaatctgcctggtcctgggcttcttttggttggtaggctattaattactgcctcaatttcataacttattattggtctattcaaggattcaacttcttcctggtttagtcttgggactaaacacataaaactagtatgtgtccaggaatttatccatttcttctagattttctagtttatttgcatagagctgttgatagtattctctgatggtagtttgtatttctgtaggatcagtggtgatatcccctttatcattttttattttgtctatttcagtcttctctcttttcttctttattaacctggttagtggtctatttatattgttaatcttttcaaaatccagctcctgtattcattgatttttttgaagagttttttgtgtctctatctccttcagttctgctctgatcttagttatttcttgtcttctgctaacttttgaattcatttgctattgattctctagttcttttaattgtgatgttagggtgtcgattttagatctttcccactttctcctgtgggcatttaatgctataattttccctctaaacactgcagtagctgtgtcccagagattctggtatgttgtttctttgttctcattggtttcaaagaacttatttatttctgcctgaatttcgttatttacccagtagtcattcaggagcacattgttcagtttccatgtagttgtgtggttttgagtgagtttattaatcctgagttctaattttattgcactttggtctgagagactttttgttacgatttctgttcttttgcatttggtgaggagtgttttacttccaattatgtggtcaatcttagaataagtgcaatgaggtgctgagaagaatgtatactctgttgatttggggtggagagttctgtagatgtctattaggtctgcttggtccagcgctgagttcaagtcctgaatatccttgttaattttctgtctcattgatctaatattgacagtgaggtgttaaactcccacacaataatactgggagactttaagtctcttcttaggtctctaagaacttgatttatgaatctgggtgctcctgaattgggtgagtatatatttagaatagttagctcttctcgttgcattgatccccttctttttgttgttgttgttgttgttttaatctttgttggtttaaagtctgttttatcagagactaggactgtaacccctgcttttttttttttttttttcatttgcttggtaaatattcctccatccctttattttgagcctatgtgtttctttgtacgtgagatgggtctcctgaatacagcacatcgatgggtcttgactctttatccaatttgccagtctatgtcttttaattggggcatttagcctgtttatgtttcagattaatattgttatgtgtgaatttgatcctgtcatgatgctagctggttattttgcccattagttgatgtagtttctacagagtgtcaacagtctttacaatttggtatgtttttgccgtggctggtaccagttttttttttccatatttagtgcttccttcaggaactcttgtaaggcaagcctggtggtgacaaaatctctcagcatttactggtctgtaaagggttttatttctttttcacttatgaagcttagtttggctggatatgcagttctgggttgaaaattcttttctttaagaatgttgaatattggccctcactctcttctggcttgtagggtttctgcagagagatccactgttagtctgatgggcttccctttgtgggtaactcgacctttctctctggctgcccttaacattttttccttcatttcaaccttggcgaatctgacaattatgtgtcttggagttactcttcttgaggagtatctttgtggtgttctctgtatttcctgaatttgaatgttggcctgtcttgctagattggggaagttttcctgtataatatcctgaagaagatttcacttcattcttcccgacactttcaggtacaccagtcaaatgtagatttggtcttttcacatagttctatatttcttggagcctttgttcgttccttttcattctttttttctctaatcttgtcttcataatttattttattaagctgatcctcaacctctgatatcctttcttcctcttgattgattcagctgttgatacttgtgtatgcttcatgaagttctcttgctgtgtttttcacctccgtcaggccatttttgttcttctctaaactgattattctagttagcaattcatctaaccttttttcaaggttcttagcttccttgcattgggttggaacatgctcctttagcttggaggagtttgttgttacctaacttctgaagcctacttctgtcagtttgtcaaactcattctccatccagttttgctcccttgctggtgaggagttgtgatcctttggaggagaagaggtgttcttgtgtttggaattttcagcttttttgtgctagttttgcctcatcttcctggatgtatctacgtttggtctttgacgttggtgaccttcagatggggtttctgtgtggatgtcctttttgttgatgttgatgctatttcttagcttttttctaacagtcagtcccctctgctgcaggtctgctggagtttgctggaggtccactccagaccctgtttgcctggatatcaccagcagaggctgcagaacagcaaagattgctgcttgttccttcctctggaagcttcatcacagagggacacctaccagatgccagccagagctctcctgtatgagaggggtctgtcatcctctgctgggaggtgtcttccagtcaggaggcacaaggatcagggacccctttaaggaggcatctgtcccttagtagagctcgagtgccgtactgggagatctgcttctctctttagagctggcaggcaggaatgtttaagtctgctgaagctgtgcccacagctacccattcccccgggtgctctgtcccagggagatgggagttttatctataagcccctggttgggactgctgcctttctttcagagatgccctgcccagagaggaggaatctagagaggcagtctgtctacagcagctttgccgagctgcagtgggctctgcccagttcaaacttccctgcggctttgtttacactgtgatgggaaaactgcctactcaagcctcagtaatggcagacgcccctccccccaccaagctccagcatcccaggtcaacttcagactgctgtgctggcaatgagaatttcaagccagtggatcttagcttgctgggctctgtggcgggggtggggggatctgctgagctagaccacttggctccctggcttcagccccctttccaggggagtgaacagctctgtctcgctggcattccaggtaccactagggtatgaaaaaaaaaactcctgcagctaactcaatgtctgcccaaatggctgcccagttttgtgcttgaaacccaggtccctggtggtgtaggcacccaagggaatctcctagtctgtgggttgcaaagaccatgggaaaagcatagtatctaggccagagtgcaccattcctcatggcacaattcctcatggcttcccttggctaagggagggagttccccaacctcttgtgcttcccaggtgaggtgacaccccaccctcctttggcttgctctccatgggctgtacccactgtctaactagtcccaatgagatgagccaggtacctcagttggaaatgcagaaatcacccaccttctctgttggtctcgttgggagctgcagaccagggctgttcctatttggccattttgccagccacccctagttgcttcttaactttctactctgcctctactttgcctccctgctatggtctactccccccaaagcagtcagcataacttcttaaattgagagcactgcactcccctgctcaagatatgacaaaagttacccataaaactggaataaaaacttgacttcttcccatggcctgcaagacaaaaggccctgtgagttatggcattgcctgtgtgatctcatcttctccattacttccctcatttctcactctgaccatgctggcccccttgctatatgttcactgaacacatatgaaacacatttctgtcccagtcttggcactcacctcagtgcctgtaatgtccgtgctccttcccttcctcacttttgtcaggtcacttttcaaatgttacttctctagagaggctccttctcattcgatctaaaattaagaactcctccaatcactctgtttccttttatcccaatttcttttcttgctatttgccactacctgaaaaaaaaaaatgtcttcttcattaggccataagctcataaaggcaaaaactgtgttcaacctgtcctctctactccagcacttagaagagtggcagagtcagcattcagtgtttacagagtgaacaacttcctggcagcatttagcactgtatcacagcctctattatcttgaattctttgttcttttagtaacctatcctgcttttcctcctccaattctacctacatatctgagggcttgttccttacatcctgatagtccttacaggcctatcttctattcactttctctctcttttttttttttaagagatggggtctcaccatgttgcacaggccacacaaaaattcctgggctcaagcaatcctcccacctcagcctcccaagcagctgggactagagacatttgctaccatgcccagcatgtccactttcactctacacactttctccacatttaagtagctactcatactgctcattcattacctctagctcacattcaggttccagtccggtatatccacatgatgactgaacactaccactctgctatctcacagggacattaaacctaattcatctacaatgaactccttctcttctgatccagctttccctccagcatcacctatctctctacatctggaaacaccattcctgttttcctccatcatgtgctaagctttctgaatggcttgaagcttcatgaaaaggcctgtgtcttatccagtgcccatagacaggtttcttttcaagtgcacagcaaaagtgttctctcctaaactctagctggttgctaacaaatcatgtattgacctaagtgttcttctcctccagcccaagcagttgatctttttctataggcttgctgttgaaaggaataaaacccaactgtattagtctgttctcacactgctataaagaaccacagaaccacttgagactgggtaatttatgaagaaaagaggtttaattgactcacagttctgtatgctgtacaggaatcatggctgggaggcctcaggaaacttacgatcatggcagaaggtgaaggggaagcaagcacgtcttaacatggtgaagcaggagggagagagtaaagggggaagtgctacacacgtttaaataactagatttcatgagaactcattcaatatcatgagaacaacaaggaagaaatgtccctatgatccaatcacctcctaccagatccctcccccaacattaggaattacaatttgacatgagatttagatggtgacacagagccaaactatatcatcctaccctggaccctcccaaatctcatgtctttctaacattgcaaaacacagtcatgctatcccagcggtcccccaaagttttaactaatttcagcattaactcaaaagtccacctccaacatctcatctgagacaaggcaaatcccttttacctatgagcctgcaaataaacagttacaagatataatgggggtagagtcactggatgaataaacccattccgaatgggagacattggccaaaatgaaggggctacaggccccatacaagtctaaaatgcagcagggcagccattaagtctcaaagctctgaaataatctcctttgactccatagctcacatccaggccatattgatgcaaggggtgggctcccatggccttgggaagctctgaccctatggctctgcagagtagagccaccatagctgttttcacagtctggcattcagtgcctgaagctttccaggtacacagtgcaagctgtcaatggatctactattctggggtctggaggatggtggccctcttctcacggctccactaggcagtgccccaatggggactttgtacaggggcttcaacaccacatttcccctctgaactgtactagtagaggttctccacaagggctccacccctgcagcagaattctacctcaacatccaggcattttcatacatcctgtgaaatctaggcagagactcaaaaacctcagctcttgccttatgcacacctgcaggcccaacactacatgaaaaacaccaaggcttgggtcttgcaccctcagaagcaatggtctgagctgtaccttggccccttttagctatggctggagctggagcagcatggacagagggtgccatgtcctgaggctgcagagagctgcaagaccctgagcctggcccatgaaattattcttccctcctaggcctccaggcctgtgatgtggggggggctaccacaaaggtctctgaaatgtcctggaggcattttccccattgtctttgctattaacattcagttaatctttacttacgcaaatttctgcagccttgaattcctctccagaaaacgggttttcttttctaccacatgggtaagctgcaaatgttccaaacttttccactcttcttctcttttaaatgtaagttctagtttcaggtaatttctttgtttatgaaaatgaatgtaagcttttagaagcagccaggccatatcttgaatgctttgcttcttagaaatttcttccaccagataccctaaatcatctctctcaagttcaaagttccacagatctctgtaacaggggcacaaagccaccagtctttttgctaaagcacagtaagagtgacctttactccagttcccaataagttcctcatctccatctgagaccagctcagcttggacttcactgtccatatcactatcagtattgtggtcaaaaccattcaacaagtctctatgaagttctaaaccttccctcatctttctatcttcttctgagccctccaaactgttccaacctctgtttgttacccagttccaaagctgctgccacattttcaagtatctttccagcaatgccccccttctctgtattagttctttctcacactgctataaagaactacctgagactgggtaatttataaagaaaagaagtttaattgacccacagttccacaggctgtacaggaagcatggctcagtggcctcaggaaacttacaattatggtggaaagtgaagggaaagcaagcatgtcttgcagtggtgaagcaggagagagagaacaaaggggggaagtgttgcacactttcaaagcatcagatataataagaactcactattgtgagaacagcaaagggggaatacgcccccatgatccaatcacctcccacgagatccctcccccaacactgggaattatgcaatccaacgtgagatttggctggggacacacagccaaaccatataactgtttaaataaaggcaaggtagtagaaaatgtctgtgggactatctgaaaaaaggttcttaggaatatctctgtgaagtggcttggagaaatcacattattctgaaatgattcagaagaacaaagtacactatttacgtctgatttttttctaagtaaccaaaataattccattcttcattgtagtaaaactaaaatgttttacatctaagtaggaatttctcagtttccaagtaaactgatataaaattgtccaaactaaagatattaacagcaaattgttaatgtcctgcctcagtttctatggaaacttaggaattgtaggcaaatgctgaaattgaggtttcgcttatcactttattgaatgccagaaaaataaatttcaagaggcaaattgaaatgaaaatttaagtgtcatgcaaataaacataaaatgttaaattctgtgctcacaaactatttttttaacttttctgatttaacactccttattattgttctatgcttaaggcatgataccttacctctcctgtctccagcttctcttgtccaggaaattctcagcttcaatttacagtgacaagagaaaactctttaaaaattattaacctgcttgattggtaaatttgggtaattttattacctctacttttatccgtatctgttgaaattaatgtatagacataagatggagccaggcaagatggaatatatcagtaattccagctactcaggaggctgaggcaggaggatcacttgagccctggccagaagactgaggccagtatgggcaacacagttaagacccctttccctttagaaaaaaaaatggacaggtaaatgttgcctctgagttgtataaaataagcttttaattgaactaatcaaggtggagtaagttctaagagataagtttactttataggtaaaacatacaatgtattccacagttttaaagtttaggaactgaattaggcatcgctaccatctccatgtcagtttcagggtacttactatagaaccttagttctgttcagtagctgtcttacatagtcatttcagatctcaaagtctttgttttttcatcatcaatacagggagaatatacacaggccttatttgtgtttggaagggccaaataagatgtacattaaaatgtgttgtacatactaaaaaaagacatgaagagcctattttgggatctcatccagcactacccatctaccaactggtgtgtaaagtcactgaggtttaccttacaccaccaaacagagcataaatattcacaagtacttccatactttgtgcataaagttacaatctattaacacaatctattcgttctttcactattattgaatattctgaaaattgaatatggtactttccagttataaaggcacatacatcatgagctttaattcttcttcttcttttttttttttttttttgagacggagttttgctcttgttgcccagtttggagtgcagtggcgcgatctcggctcactacaacctccacctcccaggttcaagtgattctcctgcctcagtctcctgagtagctgagattacaggcatgcaccaccatgaccagataattttttgtatttttactagtgatggggtttcctcatgttggccaggctggtctcaaactcctgacctcagctgatccacctgctttggcctcccaaagtgcagtgattacaggcgtaagccaccatgctaggcctaagttttctaacttttaaagaaattaagagcccaatcaaagtttaaacagaagagctataagacattttctctatactaatgaaatatctggcatttattaaaacaaatgagacaaccagatttaactatctttatgatacaatgttttctatttcaaagaacttagtttttattcaagaaccatattattcaaaaccatttctacttaaattcgttctttttctgatggtaaaatattaaaaattttctttcatctcccccctttccatccctatcagagattagagtttgaactctaacactctcatctttgaacataattctgttgacatgaggagggagctatggaaacaaacacttgaacaggcagcatctggcattttaaactcccaaacctttacatcacaaatgtaactctgaatttatgttccagctcttgaaatttttttactatgaaccacccctccacttttagaacaaggaggaaaatgaagtccagtaagtcaccagagtagatctgaagatatatttgggttaaagaggaaatcttaaagcaatcaaaacactgtgggtaagctttgggtttaaaaaaccatcaactattctgcagccctggcagtaacattttacaccattcataatcattttaagcacttctccaattttcttcccttcagtgttcaaattatagttggaggaataaagccatttctatcgaggtgacttaaaacaacttattaaaaactccatacgccaacctctattctgaatttaagcaagaaatccctaaacattgggtctaaattttcccaagtatcagctaccttaacacataagagaaagggaacaatcagactcttacctggctccttcatttaggtaccatctagatagataaggagaatgggatgggtactcagaagttggagtatttgagttctcattaagaaaaggcaaagaagatatgaagaaagcttcgaaaaagtctcatagaatgataaattgtagggctcagactgatgtcctttggcagaccagcttggagctggcattgggggacacacaagtcagcatgctttccatggagtggttctgctcctcttcaccaccatgtcaacctttgcttgctgctgcctgctcacagatctcagacctgaagtaggaccccgctgtccccctgatccagcccagtttggtgctagcattgggtgacacacaataggtcggcatggtccccatggtgcacttctgctcttctctactgccatatgttcctttgctcactgctgcctgcttgcagatctcagacctgtgggtagggctccactgatctcctgtgccagaccagcttccactcttctctgccactgcctgcatttttgcttgctgccacctgctcatagatctcagccctacaatcgggctccaccagccctgtgcagcagccccacacagggctggcattggggaagatgcaagagttcagcatgttaccaatggggcacctccactcctctccaccactgcctgtgcctttgttcaatgctgcatgctcatagatctcaaactcataatagggctccactgacctcctgcaccagctctattgggggctggcagcatgggacacgcaagaggtcatcatgttacccatgtggcacctgcacttctctccaccgtggcctgcacctttactcactgctgcatgcttatagatctcagacccacaatagggctccacaaatctcctgtgccagccctacttggggctgggattgagggacatacaagtagtcagcatgttccccagagggttcttccagtcctatccactgccatctgtacctttgatcattgcctcctgttcctcataaatctcagacccccagtagagctccgccaacctcttgtaccagcaccgctcatggctggcatttcaagacacataaatgatcagcatattactcttggggcacttctgcccctctcctctgccatctgcatgtttgctcactacagcctgctcgtagatctcagatctgaggtagagttccactgacctcctgcaccagctctggttgtgactggttttggggaacatgcaagacgccaatgcattacccaaggggtgcctttgtttctttccactaccacctacaccttcactcgctgccgcttgctcatacatctgaaactcacagtagggctccaccgacttcctatgcctgtcctgtttggggctggcactaggggacatgcaagaaatcagagtgttacccatggggcatctttgctcctctctgctgctgcctgtgcccttgcttgctgctggctgctccttgatctcagatttgcagtagtcccccaccaacctcctgtgccaaccccactcggggctggcactttgggacatacaagaggccagcctgttacccatagagcagctctgttcctctcttccaccatctgcatgtttgctctctgcagcctgctcggagatctcagacccacagtagaattctgtcgatctcctgcactgacattgcttggagctggaaccccgggacatgcaagaggttagcctgtgacccatggggcgcctccactcctctcctctgccatctgcttgtatgcctcctgcaggctgcttggagaatgcagcctcacagtagtgttcccgccgaagtcttgggtcagcctggttggggctggcactctaggacatgagaagttagcctgtgatccacagggcacctccacttcttctgtcatctgcatgtttgcagctgctgtctgctcctaggtctcagcctcgcagtaagattctgcctacctcctacactggtcctgcttgggcctggcactgaaggacacggaagaggtcagcatgttacctttggtgtgcctttgctcctttccactgccatctgcaccattctttgtttctgcctgctggtagatctgacccatggtagggctctgccaacttcctgtgcttgtgctgcttggggctggcataagacacaaggggtcagcctgttacccgtggtgcgcttctgctcatcgtcactactgcctgagtcctcactggctgctgcctgctcgtagatctcagacccacagtagggccctgccaacctcctgcacctgtcctgcttggggctggcaatgggggacatgcaagaggtcaatgtcttacccaaggtgtgcctctactcctctctgtcgctacctgcgctatcttttgcttttgcctgctggtagatttcagaactgaagtgagactctgcagtcctcctgcaccggcccttttggggctggcattaggggacatgaaagaggtcagcctggtacctatggggctccttctctcctcgcctctaccatctgcatgtttgctctctgcagcctgcttatagatctcaaactcgcagtagggcttctctgagctcctgcagcaatactgcttggggccagcactgggggacatgcaagaggtcagtgtcttgcccatgcggtgcttctgctcctttcctctgccatctgcgtgtttgctcattgcagcttgctcagagatctcacacccttagtaggactccgtcaactttctgtgccagccctgcttggaaccaccactcggacacacgagagctcagcctgctacccatggggcgactctgctcctctccactgctgccagtgtcctctcttgctgccatctgcttgttgatctcacatatgcagtaggggtccactgacctcctgcactggccctgcttggggttggcactctcggtcaccaagaggtcagtgtgttatgcatggggtgcttttgcccctctctgctgccatctgtgccttcactcactgccactggctcatagttctgagacaggtcagagggccctcccgaccttctgtgcctgtcctgcttggggctggcattgggagacacacaagtggtcagccttttacacccatgatgtgcatctgctcctctttgccgccaccttggcccttgctggctgctgcctactcgtagatctcagacccgcagaagggttccactgacctcctgcccctgtcctgcttggggttgacgctgggggacatgctagaactctgtgtcttacccataggtaaggcgtgagccatcacacacatccaaaacaaagttttaaagagactcaagaggatcaacttgttctataagtaacttaagtgcctaacaaaacaaagttttatactctttaaaggaagatagtaccagcctgagcaacatagtgagaactgatatctacaaaaaaaaaaaaaatcaaaaattagccgggtattgtggcacatgcctatagtctcagctactcaggaggctgaggcaggagaatcagcccaggatgttaaggctgcagtgagctgtggttgtgccactgtactccagcctgggcaacagagcaaaaccctatctcaaaaaaagaaaagaaaagacagtaaaagccaatcactcaaaacataacacttacaatactaggtatttaaaatagtgcccaaaaccatgaaatatttaggaatatatccaatgtgtattggaactggctcacacaacaatttattgtcatctcttccaaactcattaatgacattacattgatagcctgaaattgatcatagtgtatctacatcacagaaattggcaaatagcgcaaattagggctttctaaccaccgtcaccccaaagagcaggttcaccagtacaccaccagataaatttaacaaaatatgagctgacctctataacaaaacattgctaagataaattaaaggagatctaaataatagtgagatataatttgtctatggattgaaagattcaatatatttaaaaatgtcagttatctcccaaattactccacagattcagtggaatcctaattaaaatcccaacagacagggtcaggcacagtggctcacacctgtaatcccagcactttgggaggatgaggtgggcagatcacttgaggtcaggagttcgagaccagcctggccaacatggtaaaaccctgactctactgaaaaaaaaaaaagctgtgtggtggcagccacctgtttccagctactcaggaggctgaggcaggagaatcacttgaactgggaggtggaggttgcagtgagctgaggttgcgccactacactccaatctgggtgacagagcaagactccatctcaaaaaaaaaaaaaaaacccacagataggctgatactaaaatttataaggaaatgcaaagttttagaataatcaaaagttgaataagaaatgtgttagaggacatacactacaacattttattatttactataaatctagattaagtcataaaagatatcagacctatataaaatatagagatcaatggaacagaatagaatctagaaattcacctggacatatatagccaattagttttgtttagatgttctatggctactttactgagactctatagtgtttgcttaagcatttattaatgctcatatttttaaaatctaaacaaaagtcatcattaccaagtctcatgacatagaaatttggacttcaatcatccatttgttccatgcagaacagacttagaactattttctaaaatatgtgttttgcctgtgaacactcccttggcccttctttgtgcattggacttgaatttactcaagtggcctacctctcattaaagcacaaaggtatgttcttaatcagtaacataaaataactctcactcattcaagaaatatttactgaacaactatatgccaggcaattcagatattacttggaaagaataacctctaagactacgtatcaaaagtttgattgcaaaaataatatttaccagaatagcctgaaatatatgtagtcaaattatttccctacttaatctagaattgttttttgttatttttcagacagggtctcagtatgttgcccaggctggccttgaacttctgggttcaagggctcctcccacctcagcttcctgcgtagctgggactacaggtgcccaccactgcacccagttttgttcttttgattaaggcagactctcagattcatacatacctggacctcacagttatgtttcttcacagttaactctgctctagtactatgttctatggcctaagccaagcagtgttataagaagcaattgcagcttagctagcatcaacccaccgaaatttcttcgaaactacattaagctaatacagctctttggctgtccccgggttctcatgaggttaggctgtgggctaaatttctcatctttattttcatgagcatgatgacaaaagaaaacactgattatttgaatcaatctgaatgaacgtctattatctgcaactggaagagcctatgtaacacctgcagttttacaacaaaaatattccacaaagcaagtccagggggttcctctagtattctgcctggattagatattgtcatcagctctgggttccaggatctcttctatactttatcttccgagtaatctcagtaattccagtgctggggcccagccatttccttagctttgaaatccaactcatatcaaactacctgatgatagctcccggggttatctgatgggcatattgaaatgtaatgtggtccaaaatggaattctttattcccttctcttaattcctcttccaagacttcctatctccataaatgacattagcatccaattcacccacaaacccaggtgtgtccttcattcctccctttcctgcaggctccacagctaatctacaggcaagtcctgtcagttctacatctccaggcttgccactcccctgcatctccaaccctctagttcaagccatcatcatgtttcatttgagtcactgctagagcctcctgattggtcttctcaattctgcccctgcccttctctactttctattatacatagtagcgggagtgatattctcaaaagataaatctaatcatatgaagctcctactaaaactaaccagtggctaggtgcagtggctcacacctgtaatctcaacattttggaggccagtgtgggaggatcatttgaggccaggagttcaagactagcctgggcaacatggagagaccctcattactacaaaaattaaaaaattatccgggcatggtggcacatatctctagtcccagctatgtgggaggctgaggtgggaagagcacttgaactcaggaatctgaggctgcagtgaactatgattgcgcctctgcactccagcctgggcaacagagtgagactctgtcactaaaaatacatttaaaaaatacaataagggctgggggcagtggctcaaacctgtaaacctagcactttgggaggccgagacaggtggatcacttgagcccagaattttgagaccaagctgggcaacatggcaaaaccccatctccacaaaaaatatgaaaaaaatagccaggtgtggtggtgcatacctgtagtcccaggtactcaggaggctgaggcaggaggattggttgagcacagaagggcgagctgcaatgagaccctgatcacatcactgcactccagcctgggccagagtgagaccctgtctcaaaaaaactaaaacaaaataactgggagtatttctttctttcagctaaaccatgatcaatataaaggccttcatgatctgtctccaactaatttaccaatcttatctacacaactcccctcctcaccactgttcttcagctgtactactctaatttttgttaatagaaaaccctttcctgtctcctgggcattaaatctttttttcttctgcctggaatgctctcctcctggagtttaatgaggcctggcccttctcacctatgatctcatcttcctcattaggtagcacttacatgccacctactcagagacagccttggttgccagccaaatggctctttcttttctttttttgacatagggcctcaccccatcacccaggctggaatgcagtggcatgatcatggctctctgtagccatgaccttctaagctcaagcgatcctcccacttcagcttcccaagtagctgggaccactggtgtgtgccaccccacctggctaaatttgtttttgtagagatgaggttttgccacgttgtccaggctggtcccgaactcctgggctcaagtgatccacctgcttcggcctcccaaagtgctgggattacaagtgtgagccaccattcctggcccctaatggctctttctaaagcactcctgttcaccttccccagctcaccatctctttctttatagtgcttaacaagatgggtaattatcttctttttaattgtttgtctgtttccttgttaattttctttcttcccactagactataatttccatgctttcacattccttacttgcatttagcatattttctggcacatagttggtgctcaataaattcttttttgtttttttttagagacatggtcttggtatgtcacccaggctggaatgcagtggctattcaacaggcatgctcacaactcactgcagcctcaaactcctgggcttgagcaatcctcctgcctcaggatcctaagcagctgagactacaggcataccaccacatctggctgattaaaaaaaaaattagagatggagtcttgctatgttgctcaggctggtcttaaactcctggactcaagggctcctccagcctcagcctcccaaagtgctgggactacaggtgtgagcccctgcacccagcctcaatacattcttgttgaataaataaacaaatagcattcagttggagagagatctgcatgaagaaaagggctcaactatttatgccatgcactggatcaggggctgcataatgtggtgcaacagagatgccactaagggtcagacactccaccatcgggctctgtcctctgtgattgacagaagctccaaaagcttgtcattgtgggagctgcaatatcctgggtccttggctcttcagtctactttccatgtttgtgctatctgcctcctaatctttctcagataactcatacatttacagtttccccagctctacccacagacattaattttcagaaaaaggtctgagcaaacaccaagtaagagtgacagcctctagcattaactgtccttaaggtggttgttttttacctggcaaaaattcttagctaagcccaggacgctttagagcaggggttctaagtttttgtaactctttttttttctttttttttgagacggattctcactctgttgtccaggctggagtgcagtggtgtgatctcagctcactgcaacctccacctcccaggttcaagcaattctccagcctcagcctcccaagtagctgggattacaggcacctgccaccacgcccagctaatttttgtagttttagtagagatgggatttcactgtgttggccaggctggtctagaactcctgacctcaggtgatccacccacctcagcctcccaaagtcctgggattacaggcacgagccactgtgcctggccaattttttggaacttttgaatattttgtggtaactgcatttattattttgtaaataactatacaatttgtaaaggccagttttggtggaaaaacaattaaaataaggatggaaattattacacatgctggaaatggctaatctttgtcctcaaacaaatgtttattggctgtaaacaaacttattatatgttagttctgaaagaaaaaaacataatgaaataacttgtgcaaaatgctggagatacatcttcaaagatttttgtctaacaattaaggaagaaatgaagattacatgtaaattataaactgagaattaaacaaatgcattgacacacatgccaagtctttggaattattgataagaatacagcttattacagatcctttcatcaagagaagatactggggtttgattttcctttgacaacattttcaaaaaagttgatggtacaaaaccatcaaagtcaccatcactatctcctgctgaaaccccagccaaatcttcaccccaccccacttagtcacttgcaaaaatcactcaacattaaaaccaagttcttacacatcattcaggtaagagagataattagaaattgaggaaagaaagaaatcgctttagagtaataaggaattggccaggcaccttggctcacgcctgtaatcccagcactttgggaggccaaggcaggtggaccacgaggtcaggagtttgagactagcctggccaacatggtgaaaccccatctctactaaaaatacaaaaattagctggtgacagtggcaggcgcctgtaatcccagctacttgggaggttgaggcaggagaatcgcttgaacaagagcgaaactccatctcaaaaaaaaaaaaaaaaaaatagccaagcatggtgcacacctgtaatcccagctacttgggaggctgaggcagaattgcttgaccccaggaggtggaggttgcagtgagccaggatcacactattgcactccagcctgggcaacagagcaaggctccatctcagaaaaaaaataaagaaagaaagaataataaggagttggctcgtgcctgtggtcccagctactctggaggctgagacaggaggatcacttgggccagagagatcacagctacagtgagctatgatcgtgcctgtgaatagccactgcactccagcctgggtgacatagcaagacactgtctgaaaaaaaagaataagaaggagctttgtaggtaaattagaacagacttgtatttgagaccttgccttcactgctgccatgaagtagggcatggagggaccctcaaggaggaaaagcagagatctccaaccccaaccctattctattttgaattgtctgatgaattgggatgattccaaccaaggtccactggcatttaagaacactaaaaataccagagggagactcacctgagtgaaagaggagtccagtcagttgacctgattgcaaatgtgggcagagaggggacaagaaaatacagtaagtttcctgtctcctttatatggggctgggtgctgggaataatgaaggtcatagaggtggtggtgtgcaggcagaggcagacacatttttgatggagtaattggtgaggtcctccctggagactgagatctaaatgatgaggcaaagaatgggggcaggagaatgcaagactgagggaatgaggacctgagtcttttttttttttttttttttttttgagacagagtttcagagtttcactcttgttgcccaggctggagcacagtggcgcgctcactgcaatttccacctcttgggttcaagcgattctcctgcctcagcctcctgagtagctgggattacaggtgcccactaccacccccgactaattttttgtaattttggtagagacagggttccatcatgttggccaggctggtctggaactccacctcaggtgacccacccaccgcagcctcccaaagtgcaggaattacaggcacgagccaccatgcccggccagaggccctgaggctttaaatggcttagtgtggttgaggagatgaaagaagaccacttgatagaacacagatgaagaaggaggagagcacagattggaaaaatgggcaggggccacctcacaccagcctctaaggtgtggttaggagttcactctttgctttaagaacaatgaaagccctgaaaggttttaagcaagggtatgacttggtcggatcactctggatgttctcaagagaagggactagagagaagatgggagctttgaggtccattagaggcgaggctgctgcaatggaagagctggataaagcgttcttggaaattctgaaggaggatggcccgaagaggaaaacactggatttctgctaataaaatcaagcttgatgggattaggtggggcggctcaatgccaagaatttaagaccagcctgggcaacatagcgaaaccccagtatttacaaaaaataaaaattatctgggtgcgttggtgcgtgcctgtagtcccagctactttggatgctgaagtgggagaatcacttgatcctaggagttggaggctgcagtggaatgattgcaccactgcctaaaatgaaagaaataaaaagttggggctcagaaaattcatcaaaaaataaaaggggctgggtgcggcagctcacacctgtaatcccagcactttgggaggctgaagcaggtggatcacttgaagtcaggagttcgagaccagcctggccaacatggtgaaacccatctcaaccaaaaaatacaaaaattagccaggcgtggtggtgcgggcctgtagtcccagctactcaggaggctgaggcatgagaattgcttgagccccagaggcagaggctacagtgagccgagatttcaccactgcactccagcctgggcaacagggtgagaccctgtctgaaaaacaaacaaataaataaaagggatacatgcatgttggtgaggcaagtcatatttgttattcctgtagacaggtgctttctagccatagttgaactagggtagttgcatcactagactttcagggccatttttttctctataaagaacttctttagcgtgaaggaaattatttcctccaggtgacaaatggcatttgagtatttcagagtcacaattcagaatatttatgtaagccagatggtagcaagaagaggataaaccaggactggcagaggtggaacttattccaaatacaagagggacactgctaccctgttcttcccaggatgtcacccccatctgccacccccctgcccttccttccacagctcttccctctctttccctcctcaccctttcatcatctcaccctgattcaaaccaaatatacagagccaatcttggagggaaatctgttgtcatccaagacaactggtcggttgcaaaacatatcggacggtcagccacacatgctgagcaagcacacgtaggtaacactagagaagactgtcctggctctagaggaaagccgaggtctggggtagagcctgccctggtgtctcccagcatttcctacaatccctgcagttaggagaaccaaaaattcagatgtcacccttaacaactccctctcttcccctagccctcgcataaaatccatcaccaaatcttgtcagtgttcctcctaaagatctcccaaatctgccccctccctccactgccacccccaccataccaccccagccaagctctttctctgctttcccctgagctctacaaaagccttctccctggcttaccccatgggcccctttcaaatccattctccacattgcagccagagaaatctctcaaaacgcaaacttgtcactttacccttctcccgtgggcataaaacttttcattgcttccttttgttttacaatacagaccagattccttacaaagccaaggctgcctgttctggtccctgcccagccccgcagcctatgagtgctgccagcctttgatttctctgccccaattacactggcatcgcatggtctcttaccctctgcatattccctcccgtgtgtggttcctctgccacaaatgctctactctccccactttatatttttactcattttctgaacaccagctcatcgatttcacggagaagctttccctgacctcctaactaggtcaaacccccttacacagcagcacacacctgtccttcacaagggtgatcacactcacacccctgcattcatttgcacgattattgggttaaaacctgtctccctggcaccagtcacaagactccagcttctctctgcctgtctgcccaggaagcagaagatgagacacattagatgatcaggctcagaatagaaggcagagagagtacgataatgatcctgacagcaaagctgtgcctgagacctggttgtctagaagcagagcccgagaccagggagcacagctgcttctgatcactgtagcactgttctcaggaaagatctgtgagggaggaagggaagtgcagcggagggctctggaccccaacctacctggagacaaggggccagcttttgtaccccgatatcagccagtcattggctggagctgcccccactcttcctgggggaaatgggctcataatttccataacttcccagcagggcagctcttctcagccaagagcaattttcctgaaacacaggaaaaggagagcagctgtgatgtgttagtggctcacactcacagcagctgggtatggggatctgggcaaggcaccaccgcacctgctacaggatggtagctaagagttctttatatatatatatatacacacacacacacatacacataccgagacacacacatatatatgtgtatatatatatttttgagacggagtctcgctctgttgcccaggcttgtgtgcaatggcaggatctcagctcactgcaacctctgcctcccgagttcaaatgattctcctgcctcagcctcccgagtagctggggttacaggtgcataccaccacacctggctaatttttgtattggggtttcaccatgttggccaggctagtcttgaactcctgacctcaagtgatttgcccaccttggcctcccatagtgctgggattacaggtgtgagctaccatgctggcctattattattatttttgagacatggtcttgctctgtcacccaggctgaagtgcagtggcaccatcatggcttatgcagcctccacctcctgcactcaaacgatcctcccacttcagcctcttgagtagctgggaccataggtgtgcaccaccacacctggctaattttttgttgagacagggtttcaccatgttcaccaggctggtcttgaactcctgggctcaatcagttctcccacctcaacctcccaaagttctgggattacaggcatgagccactgtgcccagctaagggttcttcttttaaaaatacatatggtaggctgggtgtggtggtttatgcctgtaatcccagtacttcgggagtcttaaatggaggatcgcttgagcccaggagttagagaccagcctacgcaatatagggagacttatctctacaaaaaatacaaaaattaacggggtgtagtggcccatgcctgtagtcccagctactccagagactgaggtgggaggattgtgtgtagtagcccatgcctgtagtccaagctactccagaggctaaggtgggagattgcttaagcccagaaggttgaggctgctgtgggttgcgattgcacaattgcgctacagcctaggtgacagagcaagacctatctcaaaacgtatatataaaataaaataaataaaatatgtaaaggccaggtgcagtggcttacacctgtaatcccagtgctttgggaggccaagtggggaggatcacttgaggccaggagttccagaccagcctcagcagtgtaataagatgctcatctctacaaaaaattagcggggtataatgacttgcctatacttctagcctctggggaggctgaggcaggaggatcatgtgagtccgggagtgcaaggctgcagtgagctatgattgcaccactgcactctagcttgggtggcagagcatgaccctgtctctttaaaaaaaaaagggggggggagaattctgatgataaaagaaggtaagttaaagaataagattaaatgaaggtagaggggagttctactggacatctttccttcttttttcccagccaatcagaagcactgcaccaaagtcagaaatggaagtcagtgaaacaaacaagcaaggggatcctgtcagattataaaaggattacagcaacatcccacttccagtgctgcaagcattagcagggtggctgtgatgtctgctgtccagcatacaagcaatgatgtctgcactgaacccttcctgcagtgggctgggtctttgtttctgtttgtgtctcctccagatcttgtttttccagtccttctagcaattctgtgaggtacccaatgtctttttggtgtacttgttttccattctaaattactataattagtttctgttgcttacaactaagatccctgtagtatgcctcatcctggcccctgctacataaccctcggctcccctccacctgctgactgcagaggataggatgggccaaatgccagccgcatttttcctgaccccagccaccaggctgcagccacagtggagggctcctcagtcttctggagctctgagggcaggttgggggaaaggaagggcagggttctgcctttagatcaaagcactatggattcagaacatggggaggctgtggagcaagcctcggtctatcagagcaagcctccagcatgatccaggactgctcaggtgaagatggacacagccaacacatatcctctgcagaagaggtgtgactcacaagctcttccccaaccagctgctcatggaggaacatgtcaagagcttagcattgtcatccactgcctcagcttcctattgaggggcagccatgtcctcgagccatgtccagacttctcaccacacttcagactcccatctccagcactaccaagtacccaccacctctgcagtcatcccaactcatcttgaccaagcccagcctcacattgttgagaacagaagacttcagcagaggaaggggcctccccggtgcctatttttctcagaatccggctgcagcagaggtcagagagcccttttagaaaggggcatttttctcacttgctttcttgtattgtgacatcacctctgacatctgtgccttgggtaatctgaggatcattgcacaatcttcagtcctaaatttccatggaatatgaattttctatgcttcacctcttacattccttgcttatatatccctggctcattcctactggtaagagcaaatttcagcaagttggtgcacttaattcttccagctatttcccatatcctcaccaattagtgcttacctgtttagcctcccaggactattctggactacatttcagatgcttccagccacctcctcttttagcagctgctatccaagtctttgtagtattgctcaccatctgaggttcatgaaatggaaattatgaaccagatgataatttatcatggttccttggttgcaagcaacagaaaccaacttcagctaatcaaacaaaaggataacttgttgaaaggttatcaggtagctcacagaggagacaggctggagagccagtcttgaaatagaactggaaccaacagaaactggccaactattttgtctgagagttgctgaggagacaagtgtcatccaagtgttcatttctgatgatgcaagatcctgtctcaggagacagtctgagtgctccagcctaggtcacgtgcccatctcttggctatgaggaaaagccccttgatttactgtcctaccaagagtccacacaaggagagagggttaagtccacaaatcagaaattggggtgctgtatccaataaaagggaaatggaggctgagcaattaaaaaaatagccactacaagtacctatgttgctgtacgttccatcagctcacctcaccgctgcagagaccacacaggaaagctctcccacatatcctgcctggcctgctccataatcatatggctttgaccccgttacagtaggtagctagtcaggcatgagcccggcagatgagagctcccccatcgaccccaccaggaatatcaggtgaccatcagatgatgatcaggcagttgtcacactgtctcgctaaaataataactggttgcagctggttccagagaaaggcagtttcccaatatgtagaaacgcctgaagctggtaatcagcagcttcccgataagatctcgggagttgtacgagtgggctcatgcatgtgaactgaggcaaaatggcagagtttaactggtatatgttctcctagagacattccactggtaagggaagaatgcttcaagtgagcatgcagacaactccagtaaacacactgtacatgctcccctcccaagtgctagcaggccactgtgcctgtggacagcccaccccaagggaggaatcagtggagaagggacacaagacgccagaagcatgcgaatgtataaaaccccaagtcaaaaggtcaaaccacacacttgtctttcagattgcccacttggccctcttccaagtgtactttccttctttttgtttctgctttagagcttttttttttttgagccagagtctccctctgtcacccaggctggagtgcagtggcacgatctcagctcactgcaacctctgcctcccgggttcaagcgattctcctgcttcagcctcctgagtagctggaattacaggcacccacaaccatgcccagctaatttttgtatttttagtagagacagggtttcaccatgttggccaggctggtctcgaacccctgacctcaggcgatctacccaccttggcctcccaaagtgctgggattacaggcgtgagccactgctcctggcctttgctctagagctttttaataaactttcactcctgctctaaaacttgcctcagtctctccttctgccttctgcccgtcagtcaaattctttcttctgaggaggcaagaattgaagttgctgcagacctgtatgaatttgtcgccagtaactcggatacccaacaccggtaacaaccccagctgcttttacatcaagttccactgaccctggaagctgaccagtaatggtgctcaacaggctgctagaagagtctccagggtgccctctgggggtcaagagcatgtataacctcttagaggtcaggaactttaatgtaaaggttactgaatgaacgaatccaaccaggctgagtctcagggtatgacactcaagtaggtgtctgatcttccccattgtacagacagcatcatccgctcaggaacctggagaaagtacctgggggcgtcaagatttcagaggtcatcaatccaatggccttctgatttgaatgatctccctccactatctttccccattctctgcttcattcagctcactgggccattagcttcccctccctctagcagtgatagccccttgcccccagggtccaaggatggaacagatgttggacttctagtgatacagtccaggaaggctcaagaggagatgccactgtggttaaagcatcccataaaagtggctgggaaatcctggtcctgttctacttctgtggtggaaactttacttctacacccactcagcaaaccagattgttctcctcttgcttgtaagaagtccacaggtcctttcaaatttattccacaaatacttcttcagcatctaccatatgtcaggtaccatgctaggtactagtgatattgcatctacagcttcgggggaaggagacattaattaaactaatgcacacagatgtaattaaactgtgatgtttgctatgagggaagagcatgagaagttttagaatagatgactggaggatctgttacctgcaggtcagggaagctttccctgaagaactgatgctgagccgctatccaagggtcaatagaatgaaatgaataggggggagataaggaagagtatgcttggtagaaggagctgtgaagaagcaaagtcccgaaggcgagaagagcttgtggtgtttggagtacggaaagacctgggtgctgatgtgagagagggtcggggagaagggctctggatgaaggacctgctggacctggcggggctgggactgtggtggggatttaagctaaatggatttaagcaggctgctaagtggagaatggattgagggaggagaaagcattcagagaggagacagaggagtggtttggacctggagaaagggaagtggatggatctaagggacgtgctggatttggaattgagaggacttgataatggattggaggccgaggattcccgggattctgacttgcacacttctctctttcgcatttacaacaacgacccgttacagacacctcccgtcccgagtgtagcctcattatggtcggggacgttgtctagtcctctctgttctaggtgcacagtaaatgaatccatcctcggtgcatgaacagctgctctcctccacccgggagaaggcctgcaggtctcacatcccccgggaggtggcagagcaggaaaaccagccgtccagtggccggaaccccgcttcctgccgcgggcgactttgactccctggggaaatttttcccacattccaaattcccagaaaacagctctttccccagccttttggaactgcttcagtggagggtgtgacatgaccagggaacttctcttggggccgaggcctgaactgactgagtcattttgcggcgagggcctctttcttttcgacggcgacagttctgcaggagcttccgtgtcgcatggccggcctttcgcagggcgccgcgcggagccgacagggccaccggggcctttctccctgctctgtggctgcagcccaggcaccaaagagacagagagcctaagggagcccttcccagtcaagtcccggggaggttgcggggagcccagagaatgcctcaccagtaatcaaaaaataggtttagacgtgggaaagctgggttagaatatgagaaagagacgggcatggcccgggagggggagaccggttctgaaaggccaggggcaacaggctcaaaatacctctggaggatgtaggtaaaggactgggatttaccggctgggcgctgtggctcacgcctgtaatcctaacactttgggaggccgaggtgggcagatcacttgaggtcaggagtttgagaccagcctggcaacatggtgaaacctcctttttattaaaaatacaaaaattagccgggcgcctgtaatcccagctactcgggaggctggggcaagagaatagcttaaacccgggagtcacgggttgcagtgagccgagatcgcaccactgcactccagcctgggcttaagtgagactccgtctaaaaaaaaaaaaaaaaaagactggaatttaccaaggaaatacagctctctgagtgaggaaagagcaaacagaaggctgggggcagatgaaagaatagagaacaaggaccgagtgaggaacacagaaagctgaagggcgcgtaaggggacacattgccatgaggagcggaaatcagaatccagagtcatctcacctaatgttggtgatatggtttggctgtgtccccacccaaatctcatcttgaattgtagctcccataattcccacgtgttgtgggagagacccagtggaagataagtgaatcatggtggtggatctttccggtgctattctcgtcatagtgaataagtctcacgagatctgatggttttataaagggaagtttccctacagaagctctcttctcttgtctgccaccatgtgagacctgcctttcaccttccctcatgattgtgaggcctccccagccatgtggaactgtgagtccattaatcttctttcgtttgtaaattgcccaatctcttttcttcctcacccctcctgcttctactccttctactttctggcctcttgctcattaaagagtaggaagaactagtggttcccagtttcaggaacttcagtacactgacgacacgtatatctccctcaacctgactcatacctgaagtgccataatttaatttcatagctgtattaatctaggtttatgctcatattttagtgtatattacatatttgattaatttttttttcaacaaacatgttttcaacaaacattccatcgcacatactctggaaggataatacgtttacctgttatcagtcatttcctccttaattttgattcctggtttccatgtgtcacctctatctggtcttgtgtaatagatccatactttggtctcctggtcaggactgcctgatagtgtccatcctctgagtctattggcagacattacctggccttgtccttgaccactccttgccttgtagttcaagtgctccagccaccttgcataacctgcagttctctgatgcatcattctgtatcacacacctgcatctttgcttgttgcctctattgcctgaggtatttcttcacctgttgtattagtcaggattccccaaagaagcagaacttatagtctgtgtgtgtgcgtgtgtgtgtatttattgagacaaggtcttgctctgtcacccaggctgaagtgcagtggtgcagtggtgtgatctcgactcactgcaacctccacctcttgggctcaagcaatcccccaacctaagcctcctgagtagctgggactacaggcatgtgccaccatgcccagctacttttttttttttttttttttttggtggagttggagtttcatcatgttgtccaggttggtcttgaactcctggggtcatgcagtccacctaccttggcctcccaaaatgcagtattacaggtgtgagccactgtgcccagccctatatttttttgtaattatagaaattgcctcatgtgaggaggctaatcagtctcacagtctgctgtttgcaagctggagaaccaggaaactggtggtgtagttcaatctgagtccaaaggcctgaaaaccaggagtgccaatgtccgagggtaggagaatatggatgtcacagctcaaatagagagagcaaatttgccctccttccacccttctgttctatttaggacctcaagggatgatgcccacctacatggatgagcgcagaccttctttactcagtctactgatgagctaatctcttccagaaacaccctcgcagacacatccagaaataatgttttatcacctatctgcacatctaattgacacataaaactaccatcacaaattcactcctcgtcaatgtggcacccatatgcattgcatctccttaaaccatacttaatccccaaataaaaacaataacaagatcctaattctaacatgacatatttatctcatactaatgccttccccagaagaggagatgaagctcttgagtgatgtttactgttctccaggtaaacactatgacgtaaaattaacttaaataccgatataaagtgaatacatcttatgttacataataagggagtaagagaagaaagaaaacaaagatatttgcttaaaacatgtgtacatatacacaaacatataacaaaatgaggaggatatactcatgtcagttacagtcctcatttccataactggtcatgtggtcacagctggtattgatcactaccttcttctactacccattctgtattccatttgccttcagcaagcacttcagctggtcgaggtttgttacctggtggagtgacacaaaacttcatacctgaaggatctgggtcattcatagtcctgcctggattgcactgttgtagttttccgttgaccttaatcacagggtgtggtaatactaagagatgccctaagaggcctcctatattccagacatactcttccttacctccattgtggagtggaggtccaatttcccctttggaagtctggatcagtcaccccaaccaacacagtaactcccttcttggcctattgactcagaggcataaagagcccaaagaggctgggtggtagtcttagcttccagttcaattgaatcattgttgtgtttcttaatggaagcattcctccctccagaactaagacctctaggccagcagagcataaaattgcaggaacaggaaacaaaaattttgctagtgggtcactaggggtaatggcaagtggtgctatttctatttccaccccttgattcctggacccttgaattttggccctcggagaaacagcaccatatattggatgctgattcagagcacgtatagcctcctgaatagccttgccctggcatcacaaggcattgccacctagctggagtgataactgagactaatcacctcttaaaggccccgcttctcaatactgccatactggggaataaattctgacatgaattttggaggggacaaatattcaaaccagagcaggtggtaaacttcataatgtgtgtattttacctcaatttcttgaaaaagccattagagccaccggtcgtaatttgggaatctttagactatataggtgacaactaaagtcatgatctcaccgagagagagaacagtggaggaaactactagttgtagggttggcagagtaaaaggaagatgcaagagggcctgtgacatcagagggaaaacaggaaggagtggtagcgtcaaaatggatgaaagagagctcatcttagggtcagaagctacagacacatcaagaaagaaggactaaggggaatcctgtatttagcgacagagagagcgtttatgacctaggtgggggcagcttcaggggagaggtggggtagaatccagattgcaatggggtgaggagtgtgtgagctgaggaagtaggaaaagagtgcagcatcctggaagcttgtttatgactgagggagagggagagggaagatggtgataaagacagatgcagccggctatcctacgttgatgacaagatcactagctttgcaacttgccccaaggtcatgctcactcaagcatccttttggacatacacagattccaatgcccatatgaacacctagcccactgacagagtaatgacttgaggaattggcattctagttgatacactttccctcaaaagtttggttagctcaaggttagatctgacaagatcaagtttttgaaaatgcaaagctcaagacattgaactgtttggagatccccacatgcccacactgcacctctcttctatgtctttcttaaaccgtcctccctccatgaaatgtcatccctcagaaacacacaacttgttttattttatttttaaaatttttttgtagagacggggtcttcctatgttgtccgggctggccttgaactcttgggcttaagcaatcctcccgccttggcctcccagagtactgagattacaggcatgagccactgcacctggccataatttgttttattcttacacattctttgaggctcagtttagtttcgctcctgtttccctcactgaacagcttcttgtttctatagcccttgctcccagcatatgtgtagatgttccgtaagtgcttatgaaattagggagtagatggcaaagaaagatggggttgaaaatgcttaatgaataacaggacaaaaaatccattatttaacgagcagtatttattgaacgtttgccaggcacacaccaggtacgaccggtgtacaaaaagatagggaccccctccttaaagagcattttcatgggagttcttttatcacacctttcatggttgaaaggagaatggtagttatatttggcctctgtgctctcaaaattatttgttcatacttgaggctggcacattgtgtacaataaatctttgttgaccagatgaatgagccttaattatagaacttataatacgattttttagtttttatgtgtgattttctcctccacatcatgagctcttggaagccaggaactacaccttactcatgtttgttaacagaatctagcacagagttttgtacatagtaagtgtcaaaaatgtttatgctgaaagaatgaatttctaatagaggtaagagcaatgcatacacagccacacatacaagtattttacattctctttttcctgcaatttttttttgtttttttttttacataggaaaccaggtgaaaaatccatttcttgttattggtttttaatgggcctgaatgtttctgcagccatcctccacagtttcctctggctatggcaaacagactctcattgcatcaattgggttccaaaggatctgggaggaagcacatcagttgggggcttggtgcccttggtcctcataaagcctgtgactgtgatgacacataacatttctttgaaagggcaggtgctggttgatagacaacacagctttgcacctggagtgtgggaatgtgggaagtttagctgaggctgcccagctgaactctatgcttcactttattaaattctccaatgaatatattaaatttaccaatatgtacacaaacaagagatacccaggggatgtctagtctagacttcccctcctctagccctcttatacagcaaaaaacagcaaacaaaaaaaacttctctgtccctttccatgtttgtcctgcctgcaggggaaatgggtttgtctaagcaaggaagaggttttccagcagggttaagagggaaggataaatatatatatatctatatattttttttttccttttcttttttgaggcggagtctcgctcttttgcccaggccggagtgcagtggcacaatcttggctcactgcaagctccgcctcccgggttcacgccattctcctgcctcagcctcccgagtagctgggacaacaggcgcccaccaccacgcccggctaattttttgtatttttagtagagatggggtttcactgtgttagccaggatggtctcgatctcctgacctcgtgatccgcctgcctcggcctcccaaagtgctgggattacaggcgtgagccaccgcgcccagccaggataaatattttaaattttgttccccttcagcaatggaatgcacttgtcaaagaacagaagacacaccctcagagctgcaggagttatcatttcagaagttctggatgttgccacaggggctgccatggtgactgtaaaactggttgaatcagagcaaagatgacagcccttcctgcctgctccttggccagctcagctccctgtgaccttgtcctctggaaagcagccctccagcctccacacttccatgttttccccaccctgggtagaagcactaatagctcatgattcttacttcagtgcatgttcttactgcccctctgctttgatgggtaacaccaagcagatagtccaaggtcagccagcgagggaatgccctgggtaacagttctttcttgtgggtcttccagcgtttggcctcaactccataaacagcgatgggaaagcctcacactttcttgatctgcagccggatttctgttgaaccagcctgatttctttcctgctctcttcagagggtagggggttgtcctaaagcatattctgttttccccaaggaaacgagctggcttcctctacagctatttttctgctcttcattacttgtaaatttcaactctccagcctccagctacgcaaatttacaaactattattagtggctctgtggaaacttcatatttgaaatgttttctgataaaagaatggggacattctttgttaaaaaattatttcagaaatacttagctcatttctccctattctagctgttttcctctttgtttcccagctcactgccagatgcagtttttcacagctttgcaaaactgctgtttaatttgacacagtgttaacagttattaatcaaggtggtgggaatataggtttcagttacagtattatttagacttttctgtaactttcatatttatcagaaaagaacaaccatacgataaatggctttttgtcctcttttcacggggttctgttggtggttctgttgctatctcagttcccaagctgttagcaggaccacgctgtttcctttgtgtacaacgagatctcagtgttccagggcggtgtttctcccacctaacagcccagacttgccaaccattcttgctggattaggaaatgaactactgatcctaaagattagaaaacaaaatagggagatatagggtccccaaggacttctctatttaactctacctcggattactagctttgttccaacaactttgcttcagttcccggagaaaataaccaggctcttgaggtgggctgaccccactaaagctgctggggtggtctggaccaaaacgccacatcatatgacatttgagggagttgaagttacaggaggaaggtgttgattccagagcttcacgttttagctagacttggttacacccttgtttgacatcttttagccaacaaactgcatccttgtatgcgctttcagcatctgcatttggaacagttgtcaagctcgtgtgtgtatcagaatcacccagagaacttgttaaaatgcaaatttgtggaacccacccccagagtttctgattcagtaataatgggatgaggcctgaggctttgcatttcttttttcttttcttttttttttttttttgagatggagtttcactcttgttgcccaggctggagtgtagtggcacgatttcggctcactgcaacccctgccttccaggttcaagcaattctcctccctcagctcccaagtagctgggattacaagctgtgccagcacgcccagctaatttttgtatttttagtagagacagggtttcaccatgttggtcaggctggtctcgaactcctgaccttaggtgatgcatgcaccttggcctcccaaagtgctgggattacaggtgtgagccaccgcacctggctcaggctttgcatgtctaacaagctcccaggggacgctgatgctgctgattgggaacaacagtttaagaaccactgatttaggagacaggactggtggttgtatcttacctgtgggctggggtgaaaataaaggtcaagaggggaacagatgtggtgttttgtacagttctgtgagttgtttttttttttgttagtttgtttttcgaagagaagtttgctgtctgtcacccaggctggagtgcagtggcttgatcataactcactgcagcctagaattcctgggctcaagggatcctcctgcctcagctgcctcagtagcgactggtctcaaacccttgggctcaagcaatcctcccacctcagcctcccaaagtgctgaaagtacaggcaccagccactgtgcctggcccagttttgtgtttttacatatgcttataacttagcagtacacgatttccattactccgtgctccagtagttgtgggaaagagaggcactgtttgggaaggggcacatcagtgtgtatcccaacccagaagctatattctctgctcttatagtgaccctgtccacgccctggttggaaatcaacttgaaatttgcatctctagattttttttaagtgtactaatacgtgtctcaaaatttcacagcacaactggtgttcgaagccatgttttggggtgtcctaattctgcctacccatctcactctctgttcccatggcagctgtgccctaccaactgattgagtgtctggttgtcacctgtccatgtcaccctcccagcccatacgggaccactctgtgggggctctgcagcaagcctcgatgcactgtggaccagctggctgtgtcccaggagttcttggggacctggctgtctcctgatgtgatttaaagtttgagttattggtgacattaatgcaactgctcaggaagtagaaaatccccaatatatatgtcctgtgcccttttagagaaaaggaagagcttaggggtggggaggagaattctttgttttcattgcctactacatttccctaaatgatccccacttctaacatttagccctgggaggaaaattcccaaataagttgtaataggaatctgaaatcttagccagcaggagcagagggaaaaatgttggtaatccgctatcttttttatcacgtaacagtcaaactttatttttgctatgagactttatttttagggtggtgaatagtctctgtagagggtgatggcttcatttttatcctctctgtaagacggtaatgcattctgcacaaactatactgcgttaatatttctgccattagtaacttctcatatatgagaaagttaaacaatatctatcttaaaataatgttttgtcttatgttgtacactttgagagtgttttagaaaaatccctctgtcctccctaatgttacataatttttttctgcgtaaattagactttattactttttccctgccagaaatcttaatctgggggcattttttatgaatgatggagaaaatttggtgccttatctggagagatagagagatataactattggccataggaaaaaaaatttaacggtagtcagtgttccttggagtaggtttcatttgtgttttaatacacttcgccattagatggtagcacagtaatagacataacgatttaggggtagaggcacggtctcgtcccccattttaaataagatcagaaaggtctaagttggtttaatagaaccatcagatggtcttcgtcaaccccaacaccgtagatttgggtctaggaccttagtcctaagactgtggcaagtcagattgggggtgaatgttataaacaggagcattggtttcaggttgccctgttacctccagatctgggataattatcatttaagcctaagaatgcttggatgggttgggggtgttgttctgagactccttagcacagcttttggcctctctttttctcccctcccccctcccctcccctcctctttctctttctttctttctctttttctttctttctttctttctttctttctttctttctttctctctctctttctttctttctttcctttcttttctttcttttctttcttctctttctttcttcctttcttttctttcttttctttcttttctttcttctctttctttcttcctttcttttctttcttttctttctcctccttctctcgctctctgtttccttctttcaacagagtcttgctctgtcactcaggctggagtgcagtggtgtgatcacagcttactgcagcctcaaactcctgggctcaagcgatcctcccacctcagccttggagtagctgggacaatgggcacacatcctcacacctggctaagttttcgaaatttggatgtcgaaatatataatttattattacctcatgacagagctattgtttatccaacattcaaattaaatacatttctttgaattagtattgaattttctcttccttgtgtctatactttcctaaattgatgtttaaaaaacacacaagggcagtgtttggcaacttctctcccacatcatttgtgacctgggaaagggaaaaatggctcttctccagtctgttggtttcaagggtcagctgccctttgacatcaatgtcttcctgtcttctgcagtgtcataaggtatcattaacaggaattccgtgtcccaaggggacaaaagaaaaccaggtcaagggaacttgcatggaagcttaaacgtttttaagaatggcaaatttggctccatttttaacataattgaaagactctctaacagtattagaaagctaatggggctatacatggctgatagaaatagaaaagaatccaattcgacctagtttccataaagataatgagtccaagaagaaaacaaatctggagaaataaagaaaacagagcggatttgatttacaaacattttcctgtttttggagttaaggtgatggagtctcagtggggctccacgggtcctagacttgccagggcagttcattccacctctgtgggagcctgcatccgtgcccccagcacagttaatgctcctttaggaacttggcactgccaatccctcattcattgggccattgctacagggtgtttcactgttaactcacagccttctccctcttcccctaccctctccggggaccatcataactgtcacagtcagaaaccagccctccacatcccgagtctggggctctcaccaatcctcctagtctgggtacatccccactactgcagggagagttgccagccagatgagcaaggacctagactgcctattgggggcagccctgcctcagtgggccactctctagccacccagccagtgtccccattctgaggaacacagacccactcatctccttcacctgttagaaaattacttttactggccggtcacggtggctcacgcctataatcccagcactttgggaggccaaggtgggtggatctcctgaggtcaggagttcgcgaccagcctggccaatatagtgaaaccccgtctctactaaaaatagaaaaattagctgggcgtggtggcgggcacctgtaatcccagctacttgggaggctgaggcaggagaattgtttgaacctgggatgcagaggttgcagtgagccaagactgtgccactgcactccagcctgggcaacaagagcaaactccgtctcaaaaaaaaaataaagaaagaaaattacttttcctgaggccaggtgcagtggctcatacctataatcccagcagttcaggaggctgaagcaggcggatcacctgaggtcagaagtttgagaccagcctggccaaaatggtgaaaccccatctctactaaaaatatattttaaaaaagaaaattacttttcctagaaaacaggtgcttcctccaggccctaggaagtctgttgtcttttccttcagcatacttttgctgactacccgtggggaaattcctaggtgaaacgaagcctccacccatccaccctctttctatcgtggctctgactgggaaccttatcttccagccatgccatatgaaggatctggatatagaaatatatagcagtatgatttactacatttataactgcatgcagtgctatgctggtaaatgttagtaaccagagttggctggggaagggagaggagaaaactctaacttgtagcatttgcttatttcgatgtgtaaatactctgggatctgtatttggggaactcctgtgaaagcagccttggcagaggaggtaggtgatggagaaaacagagctgcatttaggaaagaattacacttccacagagagctgggaccaacagatggaagcctcatggcagagagagcaggctgggagacattctaaattcaatccaagcctggggagctgagatggacgggacaattgtaacagggagagcctggtaagaactgtgtctcctgagctctgctctttcctacaggatgggcatgtgaagtgctggaaagcctcttctttaaatgaatattaaagtgttaatattctggattcttggcccagacattgaatttcttttcttttcctttttttttttttttgacaggttcttgctctgtcacctccattggcatgcagtggtgcaatcatgggtcatttgcagcctcgacctcctgggcttaagtgattctcccacctcagcctcccaagtagctgggactacaggtgctcaccaccatgcccagttaatattttgtatttttagtagagatggggttttgccatgttgcccaggctggtctcaagctcctgggctcaagtgatcctcccacctcagcctcccaaagtgctgagattgcaggcataagctaccacacctagcccctaatctagccttccttcctttcttttttttttcctctaggcaaagaactttattaacctttgtttcaaactttattcccaggcttcttcggcctaattaactgtaaagaatgaactgtgtgtaagcacaaactgaaaagagctgcagtgtccaaggggcttgggcttaaaaatattagagatctagattttatcagattcataaacaaaaaattcttgaaaagcagtcataatataaaatggcagctcccagtaacttcttcaagttttatcttcagaagttgactcaattcagtttgcctcattcttggaagcctcatcaaaattctccatgatacctggaacttcatcatcgtcatcatcctctccagtagcaagtggtgcttttccatccacagattgtttgggcagagcttcagccagtctccttaaactagtcagactgactgcagcaagctggtttaagacgctgcgtagcatttctgtcagctgctttgtctcaccatggcctgtaatggtgaaagtgttcactgccagaaatgcctgaacttcagggttgttaaagtggatcattgttctttggagtttttcctggttcatgattgtttctttcatcttctcagagtggataaggggccacgcgggggactaggcttggtgctcaggggctcttgggtggaccagctgagactaggcgcacacacgtggtgatgcaagatggcagctaaagcctttctttttctctctctctctgtctctctctctctctctctctctctctgtctctctctctctctctcctctctctctttctccctctctcctctctctctttccccactcccctcccatcctctcccctccccttcacttccctttcctttttctcgctctgttacccaggctggagtgcactggcatgatcatagctcactgcaaccttgaactcctgggctcaagcaatcctcccacctcagctgggactacaggcatgcaccaccatgccctgctgtttttaaactttttttttagaaaaggggtctcactttgttacccaggctagtcttgaactcctggtctctagtgatcctctctcctcagcctcccaaatcgctgagatcataggtgtgctccaccatgccagactcagacaattgctcgaatgagactgtattttgtgatttaaaatgcccatagaatgatcttataccttagagtgagcagaaaaattctggagtcctcataatttttatctaatggcaggaaagagctttcctcatggaataaattttgaaggagcagtgggtaacaaaaataaagttgctttttgatcacatcccatgagcagtgctggtccaacaaatggatttggtggttaatggtgagcgtcaggcctcctaagaccaacctaatctgcagggttccttgctgtgggcccagtgggagcagagcaatctgggaagagtgggtgagcccagctcattctgtgggaggagttgcttcaacagacttggattgaggtaaaggctgaatttaaaaatatatcttttaataaggtgatacatttgcagacagagttattgcccatgtcgaaactttgtgggacagattcctcctcctacttggtttttgttgtcattgttgttgtttggtttcgttttgagacagggtctcactctgttgcccaggctggaatgcagtggtacagttactgctcactgcagccttgaccaccccaggtttaggtgatcctcctgcctcagcctcttgagtagctggaactataggcctgcaccaccacactcagctagtttttgtattttttgtacagacagggttttgccatgttgtccaggctggtcttgaactcctggactcaagtgatctgctcatctcagcctcccaaagtgctgggattataggtgtgagccaccatgcccgacccccactcccatttgtgatttgtgcagaatttctgccagcccctcacatgactcatgaagggtgagaattttcccctaaagtctcctccagaagcccacactagaatctaccacactaaccaaatttcatcatgtgatgtttcacaagaaattagaatgagttatatccatgcttgcaggcagagagtgggtccagtttggagaatctgaccccagtgacaagtccagctcctcggggattttttttttaatttttaatttttagttttttgtagagatggggtctcactatgttgtccaggctgatctcaaactcctggcatcaaatgatcctcccaccttgggctcccaaagtgctgggattacaggcatgagccaccatgcccagccctccttagggatcttgataaaagatattaatggaaaactggattaagatctaacatacttatatattcttccaggctccctgaagctccataagtctttgattctgtgtcttcttggctgtagcacagtctaagagtcagaatttttgccattctccaggcagtgtaatgtttgtactgtgtgtgtgtgtgtgtgtgtgtgtgtgtgtgtgtgtgtgtgtgttctgtgagctgccacggccaccgctgcaggctgcagctggtgttgatggtgcagaagcgctgagtcactggctgtttagcgacccttacatcacgttccattgtcctttcttcctttctaggctttgagagccctttcagtgttttcattttgttttgtttttgcccagggcctctccctggtaggaaatcagggtgtaaaaactgagagggtgctggggctcccgaacaaagctgtgcagaaggacagtggatccctgcaggctgctgaggacacccagcaacccagattcacgtgctggaagcacacgagggccctgggccagccccagcgaggccccggagccccagggtgggctctgactgacatttttctgcagctctccctgctgtgctggtttcaactagagctgatgagtttaacaatctctttataagttctgaatccaacgttcttcgtgcccattttagcacaagtgtaacaggtggtgctaattatcagtgtgacataaattcttggagaggtagcctctggagagggctatacagatttttttaaatgactattttgacccaacgagcttgtcactttattacagttgttttgttattaaaaaatacctatttattatggaaacattggggaaaaaacaaaacatcataaaggatgaagtaaaggttattcgtattccaccacccagagatgatcacattttgatatataatcttctaatattttttctaaatatggattgatatgcacgtacgttttacataattgggcccacattgagcattttatttaaactgaaaaatatgctgtgaatatactcttacgtcattgagccatattctagaagtgctgcaaattaatgcagtatgagcagagagataagatgcatcttggattgttttatttgctgtcagttcatttctatttgtaggatctttctcttgccagaatagcctcatttacaagtcctgtcccttccttccacccctgcaagggagctaaagcattttctcaggtaatcatcccacactatctctgcatttttttttttttttggtatataaactatttattaacagacaaggcctacagacttattccttcttggacacacccgtagtacagccatggcagccagtggtcttgctgtgctggcctcaagacacgaaggccccagaggtggcgcagccctctatgggcctgaaacttcttcaatcactccaggtggtcacagaacttgttgtccattggctgggatctggctgtattttccagactttacatccttctgtctgttcaagaaccagtccgggatcttgtactggcatggatcctgtataatggtgatcacacgttccacctcatcctcagtgagttctcctgccctcttggtgtggtcaaagtctgctttcctcaacaccgcatgagcatatcttcgacccacagcctaaatggcagtgatggcaaaggctttttttccaccgcccaccgatgctggtgttgagtactcgcagaatatgctggaactcttcagggatcactagagacatggtggccacagaggtggcagcatgtaggcctcctgtggaggagaatctctgcttttttaaaaatgctttctgggaagccctaggaccagctaagatctatctggatcagtagttctcaatcttgagctcacatcagaatctcctggaaggcttgtcaaaggagattgctgggcttcacccctggagtttcagtagggctggggtggtagacaagttcccaggcaaatgttactcatgttggttttctactgagaaccactgatttgggggaatggatgaacaatttgcttcctccaagccctctcccagcgttccttggctacttgtctttttcccttagagcatttattttgtctctaaattctttgcttgtaaccactccctatgctgtcttctcgtggtgtcactcatgcatacaaaggacagaaatattttcttaatggagggctggaatccaaagggttcaaggagccccctagtatccgtgagagtagaaaccagggtgattcgtccttccctgtcacagcagcacagtctcctgaagagctggctcaaaaggaaatgcacagatgcccggactatttgttaaaggaaatggcacattatcctcttcccaacatctggtcattcctgaaagacagtcaagccccgataatactgttgactcactcgaagcctgtgtcttctttcccgagggaggtggagacgaaccaaggaggatagaatctatttttgtgtcggcccaaggggacgccttggggaggggacgaagggtcacccacattgctgttctgttctgggagccaggaatgcatacttccttcctgtccagccctgagcaacagtctctttctcaagtctcagatcttccacagagagctggaaagatttttaaatgccatggtgggctggaatggctggacaccagcatagatggactgatgaaatgggaagagatttggcaggacgcagggtgttgaggttgcagcaaaggcaagagagctgtgttgggttgagtgactgtcacactgtgcagtcagggctcagaggctgcatctggctgcctcttcattaggaaatgcgtgtgttttttttttcatctctaaggcatcttctaggggctaaacatggagaaagaataagaggggtgtgagtagggtgtctggttaattaacctggaggacttgcccaggttgactttgcacaggtaaggagaagtaataccctgaaatccacctggagatccagggggaccccctccagcatctcaaccagttggattaagtgaagctgagttctgagagaaggaagtttcattctcattaaactaatagagggcctcctggactagggaggggatggggagaggtggggagaggtggggagggcacctctgcctttggagctaagggcatttattgtgccaggcctttgttttgttccagccagggcactctggcgaaggcatcctgggaatttggcctgcaaacagaaagggcatttccttgtgtgggtttcctgtttaggtctgcgtagaaacccaaaggatcgcttggcctcataaatcctctagacattactggtgtagatgctctggctggatgccatgggaaaatcgcacagaaatagaagaagggaggaaagcacatttactcccaggatgctgggtgggtttcaggctccctgccttcagatctgtaaacagaggaggttgggctagaggggatgatcattcaggtcccctccagctttgacaatctcaggttccatttccctctcaagggtcagcgggagctggcactgtgaagctcaggcatgggagtcagctgagcagctcaccaaacagaagcatgaagaaaatttcaaccaaaaaattagaaagttgccttggaatatcctttaggctccttcacagaaagaaggtgcttctgaactctggtatttcccagactttcctagacgcttagcgtatcccaaaaatgacagctaccagggtcaggagtattgtggagtctcgtggatgggttttggcacaaagcaagtttgcagagctggcagtgaataaggtgtttattaggagacatcacccatttcaggtttctttttttacttccagtttccctcaatttctgtatatgtcaaattgcagtttggcattcacacttgttggtttaatggaagaggcatgttttcattcttaatctgtggatgaattcagattctgcgcagactgcacttggagattgaccagactttaggtcagttgggaaagtcatggggcaaaaacaggatttcttatggagatttcctgtgtcaacccaagctttgttccagtaagaacatgctcatcatcttcaacgatgcctcttgtgttaccttattttctcatttatccttatttgcatcatttagaaaatgtgttatatagaactgtcttttttgggaggcaaataatgaaatgatattgagtaacattaaattaattgcttgtagtcagacaatgcagcgttctagtaaattaattggatattttacttaagcaggggtagacccacttatgaagcaatatttctcaagacaagattgcccccttagaattcagcatggctctatcctcagttctctcgggtgcgaatcgtggcatttgtctgtgaacctcataccctcaaacatgtccttacagataaacacatccacaaaggaaaatcacttccaaggtcccattctgttatttcttttccaaattttgcttttgtgtgtctgaaatacattcttcttttcctcccaccaactctgagctgtttcttcaataatgaagtaggtggaagaagaaggaacatgataggaagttctaagctttctgggtccgtgctccttagaacactaatcctgagaaatgtgctttaaaagggagtcctgtggtcacacaggggttgggaaatgcatgtttgcactctgctgtgttaaaagctctgaaaattcatgcaataaagaaatatgtttgactttagctcagcatttcccaaacttatctgatcaagaaaatatctttttatattatgtgtatagcagatattaacaaatggaggaataagtgttctatgtgacactttgagaaatgcttcctactgaaaaatagagttcactgtcttatatttagtactggggataaatatatgtatttatgttatagtatataatatgaatatttataatatatgttatatattatatgaatcattatattatagtatataatattatataacataaatataaatatatttatagtgataataatataaatattatatatgatatataaatgtttataatttatatttatattataacattaacataattctaatatataatatattctatattacattacatataattatattatgtattgtattatataatataaatataatatgtataatgataattttatttgtttatttatttatttttttttttttttgagatggagtctcgctccatcacccgggctggagtgcactggcaggacctctgttcactgtaacctccacctctggggttcaggcaatccttctgcctcagcctcctgagtagctgggactacagtttcttgccaccacacccagctaattttttgtgtttttggtagagatggggtttcaccatgctgcccaggctggtctcaaactcctgacctcaagtgatctgcctgcctcggcctcccaaaatgctgggattacaggcgtgagcaaccatgcccagcctataattataatttatatttacatatataatttatattcataatgtttatatctcaatatttatattatatataaagtggaggaatatatataacatatgataaacattcccattaccttttcatatatacatactttatatctgatatggtttggatctgtgtcctcacccaaatctcatgttcagttgtaattccccatatgggaggtggacctggtgggaagtgtttaaatcatgggggcagatttctcatgaatgatttagtaccatccccttggtactgtccttgcaatagtgagtgacttctttatgagatctcgtcatttaaaggtgtgtagcacctccgccctctctctcttgctcctgctctggccatgtgaagtgcctgcttcctcttcaccttctgccatgattgttagtttcctgaagcctctccagaagtcgagcagatgccaacatcatgcttcctttacagcctgcagaattgtggctaattaaaccttcttttctttataaattactcaatctcaggtatttctttatagcaatgccagaacagtctaatacaatgtgtatatactgtatgtgtgtgcatatcaataatgtactggaaatgttgctgctcttttcagaattttcaggatgaacatagctatgaaaagatctttataaaaaaaacattagaaacacatcatcatttcaattgtgtctattggtgtttggtagatgacaggtgagtctttttttctttctattttttttcccacagatcttccacaatgaatatgaattatttctatattagatgcaagaaacaaaataaattttaatttttaaaaagagtccacgtacaaggttccttttatttggtcttcatgcagagaagccatcagatgcatcttcctgcttcctagtcatttatctgagcttgcttgtggttctatggcacacatctactgaggtcctgcatggcagtttcgggagcacacacagcttcttcagttttaagagaaagtaaagcaattagcacatagtgggaggatcggtaagagtgcaggaaatggcctcatcaagtccaccaaactcagttgttcctggattgtgtgttcaagaagaaacagatggtctatcagacagaattcttggttgccaccaatggaaatctcagttggaaagtggatttattggaaatgtatcatatggttcaaagaatcagtgcaaggctggagaaccaggtgatgaaattggataaaaatctagggaggcctcatgacctagcactgtgggaggccaaggcaggagctcaggaattgaagaccagcctggcagcatagagagtcctcatcaattaaaaaaaaaaaattaaaaattggccaggcatgatggtgcgtgcctgtagtcccagctacttaggtggctgaggcaggaggatcgtttaagccccaggtcgaggctgtagtgagccatgatcacaccactgcactccagcttgggtgacaaagcgagactgtttaaaaaaaaacaaggtggcaaggcacaaagatattctacttggcatgctgccattggtgttgtcaatgctgggcacttgtcatcatgctgctgggctctggcacccctgaacactcattgctgcgctgctggacactcaactccagcacagccaccgccaaaacgttctgcctccccacagtcttcctgtcctactggggccactgatcagctgaacccagggtaatatgctggttccctagctgctgcgccaaagaaagaaactctctgccctctttggcttctgaagtaggaaatggagtcttgcctcccttcttttggatgcttctttccaaagggaaaggatgtttaaagtctgggtagccagaatgaccaataaacataacatttagggattctgtaaagcggctgccaggatctcggaggggcaggggataaagcagccaaccatgctcagaagtggtctcctctcccagagccacatgcagcatggttttctttctaccgggaatcctgagatgggaaaggttctgccagatttcttaatcagttggttgaaagtctgcccctcggaagaactgacccctctggataaaaaccgcactaaataacaaaataagaatgaccattttttaaggaacctgggggcagaggaagtatgcctacctggccggaagggctggggtttctcactcactctgtcagccacacggattgtctgatggaccctgaccaggggaagtgaaggggaaacagagcacttgatggattgttttttctctgaagaactttacagtttagggaagcagattaaatagattgatattatcttagagaagggccctataagtgcagggaatgagaaaggagtgaaaaatgtaaacatggatttttttattgacttccttattcgggaacatatctttctgcttgcaaatgtccaaatgttggggctgagtccagagactaaaagatgaaatccaaggagagagtcagggtggctgttggtgctgtgggattcttagacgccagacacagaccctaatctggactacgtaggagaaaacctgtggggttaactacttcagagtttggagtctttcaggtagaactggaaatcaatgattaagaaatgagaggccaggcgcagtggctcatgcctgtaatcctagcactttgggaggccaaggcgggtggataacttgaggtcaggagttcaagaccagcctggccaatatggtgaaaccccatctctactaaaaaatacaaaaaaaaatagccaggcatggtggtggatgcctgtaatcccagctacttgggaggctgagacagaagaattacttgaacccagaggtttcacagtggaggttgcagtgaactgagatcacgcccctgcattccagcctgggcaacagagtaagactgcttcttaaacaaaaaagaacagtagaactaatatggatctgctcacctcagagtaagtgaggtataatttgagaaccccgcaaagttgaccttatgtaatctttatattattataatattctacagtgagttgcttcttggttgtcaggacatctgcacagctttcatcattgactggggccttttgaggactgtctataccatagtccccccttattgacggttacactttccacagttacagttacctctggtcaactgcagtccaaaaatattaaatggcagggcatggtgcctcacacctataatcccagcactttgagaggtagaggcaggagcattgcttgagctcaggagttcaagaccagcctaggcaatatagtgagaccctgtctctacaaataaaaattaaaaatagccagttgtggtggtgcatgcctgtagtctcagctactcaggaggctgaggcgagagaaacacttgagcctgggagttcaaggctgtagtgatccatgatcacaccactgcactccagcctgggcaacagagcaagaccctgtctcaacaaacaaacaaatgaaaaacccaaaaagattaaatggaaaactctagaaatgaacaattcataagttttaaattttgtgctattctgagtagcatgatgaaatctcaggctgtcctactccattcctgcccaggatgcgaatcctacctttttatctgcacaaaatcatttagccatcttgattatcagatcagaaaaacatagtatatgtgaggcttggttctatctgtggcttcaggcatccactggcagtcttggaatgtatccctttcagataagtgggggactactgtatattcttagagaaagggcttccaagcttgggtacttagattcttcagttggacgaggatcaggattatgcctcccagaaatgcaaccaagacaacaaaacaagcacaagtctttggtagaatgcattgtagaatgcattcttacacagtggatcgtattcttcctgggaacacatgctagaaagagaagagcaaatctttaggaacatgagaatgtactacaccttagagagtgcagctatgtgcaagtactcagtcacctggaactgaatctcaactagaaccaaatttcactgacacagacaaagttagtgatcagtgtgcaagaatatctgagtcatgatgaaggaagaaatgattaaggactcaaaggatctcttgaaattggaagcctatccattcctaggaaatttgagacaaaccacatggtgtctctcctgtaaccccagcatttttccagggaaatctttgaaggaaaaaggtcacaaaaaggtagactaagggaatagagtgaagacagagaggcatggtggggggggatattccatttttctcttcactgcctctacggtggtagattggaacaggaggtaggaagtagattggaatttctagtatccaatatagggatagtgcatttcaccttttgctgtgtcccagggtgaatagacagtgaaagggaagcataagccctcacgaaagagcctgatatagcaaaactgctataggccagggaggtaggaggcagacagggctggagctctgcatgacacttgaggtctcaggcctgggcccaagagatgagtctggacacagaataaacatctttgttgtcagttatattaaaacatggtgtctggctgggcacagtgctgcacgcctacagtccaagctacttgggaggctgaggtgggaggattgtttgagcctgggagttcgaatctagcctaggcaaaaaagtgagaccctgtctttaaaaaaaaaaaaaaaaagatggtgtctgtaaccagatgactgtctttaatcctagctctacacctcttgctagcagtaggactttggagaaattacctaacctttctgtgcctctgtttatcacttgtaaagggcaataaggatatgacctgccccataaagttttcatgaatattaaatacattaattcatgtaaagtgcttagcacataataagtgtaaccaagtgactgctcaataagcattaggcttcaattttattccaggtggttagaatatgccagaacaagggtaacatttttcacctacaaggcttgcgtgggacatccaggtaaactttcattcagattaaggtcagaaaatgccacggccattactttaatctgactgaagttgatgaagcatctctgtggtggaaatatttaacttacatctgtaatattaacagattgctggtgttaaagtcttattagtggcaaatgctttgtttcaccgaagcatttcctaagcagtggcacaacatggttgaaatgtggccatcctgggtcttagttttaagagccttgaggccgggcacggtggctgatgccggtaatcccagtgctttgggaggctgaggagagaggattgcttaagacaagaagtttgaggctacacggagccatgaccatgccactgtgctccagcctgggtgacaaagtgagatcctgtctccaaaaaaaaaaaaaaagatccttgaaaacagagtcctcagaaatgagggggactttagcgtcttgcagcgtttctcacacaggtgtgtcagtcactgggatttggggacaatttgagcattttaaaatgtatgtttcaggccaggtgtggtggctcatgcctacaagtcccagcactttgggaggctgaggtgggaggattccttgatcccaggagtttgacaccagcctgggcaacacagtgagaccctgtctctgcaagaatttgttttaaaaaattagctgggcatggtggtgtgctccctgcagtcccagctactcaggaggctgaggctggaggattgcttgagcccaggagttcaaggctgcagtgagctatgatggtgcccctccactccagtctgggtaacagagcaaaaccctgtctcataaaagataaagaaataaataagtaaaatttatgtttttataggataaaacttagttccttaaattagttttttttctcaaactggagcttgtagatgttttttttttcctttatgaggtgctggtgcattcctgaaatttgaggaatgttgatataacagaaaggacatgggctttgaaatcagacagatccatagtcaaattcagactcttctccctgggagaacctgggcgagtcactcagccccactgagcctcgactttgtcatctggaaaatggtgataatagctacgcacaatcttgctatgaagagtgcatgcaaatgtaggggctcagcaaaagttacctcccatcctctcgcctatgttcttctcccgtaaagaaagaggagaggagttattctgccttcttgaatgaaagcaaagagaaactcaactgagatattcaacaggtttgtactggagactcggtgattcagacagagatgttgtggtagactgaataacgccccctcaactcctaaagatgtttacctcctaatcactggaacctgtgaaagttatatggcaaaaaaagaatgttgcaggtgtgattaaattatagatctttcgacagagggattgccagtgagccctaaataagagggaggaagaggaagattcaacacagacagaagagtagaaggcaacatggccagggactcagagactggagtgatgtggccacaagccgaagaaaggagcagccaccagaagctgggagaaaaggaaaagagcgaattctcccctagagccttgggaggggctcagccctgccggcaccttgatttcagctccgtgaaactgacttcaggcttctggcccccagaaccatgaaagaatatatttgttttaggtttccacatttatggcaatgttttacagcagccataggaaactaataccgatgtttgctcatgactgaaataaataatgttaagatggggtggaaatgattgtgctcagtggcagaaatttaggaactcctgagcaaacattttaattctgttgtctagtccttggctcctaggccgacaggtgtgaagaagagaaaatcctttctaataatatagaactttcacactgtggcttgaaacctttagtgggctgagacttgcatgttgtttgtttgtttgtttgttttttaagtgaactagaatagaataaaaagcctgacactctgtgctgttgtcatcacaaaccaagggcttgcccactctttcctatgtgaagccgttacacatggtcttccatgcactctccttcctcctcttaccactcttagtcaggtggccactaacatgctcccatggcaccttgtgcttttgttattatggtcctcatcaccttgtaatacattattggcaattcattcagtgagtgtgcttctggtcctactgtgtctcaggcactttactgggtgctagtcctttccaagtgtctcctccttggacagccatttccctaaggaataagtttttattgttgttgggttgtttgtttgtttgttttctgagatggggtcttgttctgtcacccaggctggagtgcagtgacatgaacatggcttactccagccttgacctcccgggctcaagcaatcctcccacctcagccctactacccaagtagctgggacgacaggcgcacaccaccatgcctggctaattttttatagagacagggtctccctgtgttgcccaggctggtcttgaactcctggactcaagagatcctcttgccttggcctcccaaagtgctgggattacaggaaagagccacagctcctggcccaggaataatgttttaacatctgtatctctagtgccctaggcagtgcctggcattccaaaaggtgcttgaatggttatgagttgtggttttagaattattttttgtttgtttgttttggtttggtttttatttttgtttttgttttgagatggagtctcgctctgtcatccaagctggagtgcagtggcgtgatcttggctcactgcaacctccccctcccaggttcaagcgattctcctgcctcagcctcccgagtagctgggattacaggtgcccaccaccatgcccagctaatttttgaatttttagtagagacggggtttcaccatgttggccaggctggtctcgaactcctgacgtcaggtgatccacctgcctcggcctcccaaagtgctggagttacaggcatgagccaccgctcccggcctagaattattcttttaaacaaattcaaatggtggttgggggcaagtcatctgctctggccctgttaggtgtgggacaggacattgctctatgggaactggcctgacaggcaggcatgggtttgctagaagcatggtcatagaaatcctctatttgggcttttaaattgtagtggtccctcggtagagttggacacattttctctcttctccaggtcaccctcctgccataaatcctggaccagctagaggaggaatcacttgactgatgaagaaatggaaggagtgcattgtgaacattggaggccgtcctaattgcaggaccagctggagaagatagcctaaaataaatttcagtcatacaggaatttttgaaagaaaaggataccttcctttcccaacttaggctcttctgctaacttattgtaacatcatcatgtccttaaaacatcaaatatgagagccaaattatactcagcagtgtcttaggcaacaaccacatatgtataatatagacaatgatatcatggctgactcaatataatcacacccttgctcataaaccctatctttctttctaggcattcaaagcacatgacagacattatcttattgcttttcccaacacacttgccaggtagacaggaagcaggtatcattattgtcttcatatcatgtaggtatagacagctttcctgggaactgtttgctcaaagccccactggcaataagagctactgggaaaaaaaatggctagagtcctaatttaaaaaacagaacttcctgctgaggcaacttcaggtcacaatgctgggatatttctgatttcaggcattcttagatgggggcacaatgggttagttattttcctttatttgcaggtgtttcagagggaatgaggtagcagatacaatcaaatcgatgcaactattggcactttctgagtgttcagcatctatggggaacttcagcatctattttctttccaagatggcagtggcattaccaagcatagctcaacgaagtacgactggcaatataatctgaaacatcaatatgattctacaatgttttgccattagaggcaattctgctatcattgaaaacatttagagttgtagaggcctgagttcaggtgccagctctgacattaactggttgagtacttttgagcaagcccttgatcgctctggttctcatttttcttatccacaaaatgggaacaatatttaccttcttcgaagacactaagggtaaaaagagatcatatatatgtttcataaacattgaaatgctatagaaaaacaaagcattacaaagattagaccactacaattgcaggccctaatacaggttatattttctatcaatggggcctatttccaatgggtcatctgtgcaaaaaatatgtctttaaaactgtaaattaggctgagcccggtggctcatgtctataatcccagtattttgggaggccaaggtgggcatatcacttgaggccaggagttgaagaccagcctggccaacatggtgaaaccctgtctctactaaaaatacaaaaattaggtggacatgcctgtaatcccagctacttgggaggctgcggcaggagaatagcttgaaccagggaggtggaggttgcagtgaaccaagatggcgcccctgcactccagcctggatgacagagcaaggctctgtttttaaaaataaaaataaaaaaattaaaaagaaaacctgtaaattattatctccctgggaaatcaggagaaaagaaaattaagaggagaaaggaggcctagggctataggtctatcagaatttaaggaatgttgacaaatatgaaccgcatgcctatgtggtagaattcaagtctatatacactgtacagcccaggaagcttggaaagtaaagctttcctgtgccctctggaatgtggaccctttgtccacgatctacaaggtaaagaattccataggaagtatgtatttaattaattgtagccagaaattagatatgggtaagccagattccattgtgcgacgttattgcttcttcaacctagatacgtggatactttaacccaagctcaaacccacaagatttgaactcctaacctttaaaacgcaaggcagctactttgaccaccaggcatcctggttcttgtttaccaggactgggagttctcctcagacagagccccatttattccatgaccctagcagaataacactaagaaacccaaaagcatatccattttgaaatagtgtctgtggcaccaaaaggattctggagctctgaatcagccccttacctcatggcaaaatttacaggcttgcagagttaaataaaaatcagattggaatgcagggacttctatttttctgtaatgacatgttgtgaggagaaggagggcaattttcttggacattcctctaaaaccagtgcacttgcagtggcttttttgttgttgttgttgtttacaaaactatcctaaacagacccagggctcactgccatctccgggtgccaggactctgggccacaggggccatttgtccagggaatagaattaaaatcaataattattcctttcacctggcacatgtgagcctcttctcaaagcagtcagagagtggactttaatatctcattctttctctgaagtaatttaatgatcacataagaaaaatgattctctgaaaatataatcttagaatttggctccacctccaagttgaaagaattttgtaaggaaagaaagaaaaaaacactcaagaaatatgtctactcctcacgtctgactgtgaaaagtctatataccatgacctgaaaaggaaagataaacatagtccatgaaattctgtggcaaaaaggaatgaaaatgtgcttaagaaaaaaaaacccaaaaactggaattgtattctctgcaggtttaaaggcaacctttgccaaaatctgctttctggaaactttcctctagacctggctgctaccatcagccttggctgcgggagagagacctggaagactgtggtttggaatatgtgaatgttaaaatcagacattgttcccttttctttacaacaacaagtctttggttttggctatatacatgctgggttttccggtaccacgttgttccttttttcactagaggtcagaactattgaagggatcttgatatttttcagtttgtttcctttttgaccactgctctcccctttcttacaatgcccttgagaagctaatgggctctgtttccatgctgaaatgaagaaatgatcgagcgagtatgaaatgacgcgtggaaggccacacagcaagttggaagaagattctggatgagaaacttgaaatttccatgtcctccccaggtctgtaaatccagtccactaagctaagtttttctaagacattgaggcccaaagatgcatgctgaaccacaggcatgaggtgtgacttcaaaccaagagtcaacactatgcggagtgactagatacagaatgctctaataaaataattatcacctgctggggcagagttaagcttaaaatcaccttaccgtggattattcaaatttatagcatattacatataattcagatagaacagggtaatgttcaacctaatcccatctatgaaaagattgtggaacaaacagcaaatattaaatataggaactgtgtctcagttacatgtcatatgtcacatacataagaacaagaataggaaataacagaatcaattattattgcatcacggggaactatattttcaagaagcacctactgaacttggaagtcattctctttaacaaaaaatggtagtccatgtaacctaacatattacacagcagcagcagcaactgaaaaagctgttcccaggcaaagggcacatgccaaagtcatttttataggatcttaagcagatcttgctctgtttcagtggaaggtagaatcatgcaagaggaaactgggaatgtgcagggctagaaccacagaacatcacaaagagccttcttaaaggagcagtggtgggctgagtgattgggaatgctctgcaattaaaggcatacctggtttaacttttttttttttttttaagagatgaggctgtcactatgttgcccagactgtcttgaactcctgggctcaagtgattctctcaccttggcctcccaaagtgctggggtgacaggtatgagccaccatgccccagcctatctttgacatttttctaacagcatgtgctcatttcatggtctctgtgtcacgtttctgtaattctcacaatatttcaaactttttcatcattattatttctgttatactgatctgtgatcagtgatctccaatgttactgttgtaattgttttggggagtcatgggcagcacccacataagaagatgaacttgatcaataaatgtgtgtgctctgattgctccaccaaccggctcttcccactgactggctgttcccccatttctctccctctcctcagggtcctccctattccatgagatacaacagtattaaaattaggtcaattaataaccctacagtggcctcttaagtgttcaagtaaaagagttgcacatctctcactttatttatttatttaatttcttttgagacggagcctcactctgttgcccagggtggagtgcagtagcaccatcttggctccctgcaacttctgcctcctggttcaagtgattctcctgcctcagcctcctgaatagctgggattacaggcatgagccaccacacctgcctaatttttgtatttttagtagagacagggtttcaccatgttggccaggctggtcttgaactcctgacctcaggtgatccacctgcctcagcctcccaaagtactgggattacaagcgtgagtcaccacgccctgctcactttatttaatttattttttgagccagggtcttgctctatcacctaggctagagtacagtggtgccatctcagctcactgcaacctctgcctccagggcttaagaaatcctcccacctcagcctcctaagtagctggaattacgggcaagcaccaccatgcctggctaatatttatattttttggtagagacagggttttgccatgttgcccaggctggtctcgaactcctgggctcaagcaatctgcctgcctcagcttcccaaagtgctgggattacaggcacatctcccactttaaataaaaaactagcaatgattatgcttagtaaggaaggcacgttgaaagctgagataggccgaaagctagtcctcttgttcccaacagctaggaaagctgtgaatgcaaaggaaaagttcttgaaggaaattaaaagcacctctccatgggacacatgaataagaaaatgaaacagtcttgttgctgaaatagagaaagttttagtggtctgggtagatcaaaccagccataacatttccttaggccaaaacccaatccagagcaaggctctaatgcacctcagttctctgaaggctgagagaggtgaggaagctacagaaaaatgtctgaagctagcagatgttggttcatcaggttcaaggaaaaaactgtcttaataacatgaaagtgccaggtgaagcagcaagtactgatggagaagctgcagcaagtgacacagaagatctagctgagataattaatgaacaacagattttctacatagatgaaaccttttctattggaagataatgccatctagaactttcgtagctagagagaagtcaatgcctggcttcaaagcctcaaaggacagtctgaattttttgctaggggctaatgcagccagtgactttaagttgaagccaatgctcatttgccattctgcaagttccagggccctgaagaattatgtgaaatctactctgcctgtgctctacaaatggaacagcagagccaggatgatagaacatctcttcacagcatggtttactgaacagtttaagcccaccattgagaactactgctcagaaaaaaaagattcctttcaaaatttacctgctcattgataatgcacctggttatccaagaactctgatggagctatacaggagattaatgttttcatgcaaacacaacatccgtcctgcagctcatgcatcaaggtgtaattttggctttcaagtcttattgtttaaaaaatacttttttttttttttgagatggagtttcgctcttgttgcccaggctggagtacaatggcacgatcttggctcactgcaacctccgcctcccgggttcaagcaatcctcctgcctcagtctcccgagtagctgggattacaggcacccaccaccacgcctgactaatttttgcatttttagtagaaacagggtttcaccttgttggccaggctggtctcaaactcctgacctcaggtgatccacccacctcggcctcccacagtgctgggattacagaaatgaaccattgcgcccagccgataaatacattttgtaaggctatagtggccatagatagtgatttctctcatagatctgggcatagtcagttgaaaaccttctggaaaggattcaccattccagatgccattgagaacattcatgattcatgggagaacatatccatgttaacaggagtttggaagaagttgattccaaccctcatagatgactttgaggactttaagacttcagtggaggaagtcactgcagatgtggtagaaagtgtaagagaactagaattagcagaggagcctgaagatgtgactgaattgctgcaatctcatgataaaagtttaatggatgaggagttgcctcttatggatgagcaaagaaagtagtttcttgaggtggaaactactcctgatgaagacactgtgaatattattgaaatgacaacaaaagatttaaaatattacataaacttagttgttaaagcagcagcagggtttgagagattgacttcaattttgaaagaagttctactgtgagtaaaatgccatcaaatagctttgcatgctacagagaaatctttcatgaaaagaagagtcaatcgatgcagcaaacttcattgtcttactttaagaaatggttgcattttgaagagcagggggagcggggggctcctctaaaccaaaaagcagcagagtttgagaagccggcagctcagggttcggctgaagttaggagtggtgggtggccgccaagtgcacggggttgagggtgtcctggtctttggcttctcaactctgtcttgtttcaacagagaacatgtcgcgattcttcagaactaggaaggtttgttgattactcacagtttcaggaatctggtgatgcaaatgaagattatggaagagattcgggccctatcactaagaaaatttcatcatctcccctagaagctaaaaataaggcaatctggaaagaattcacaggaagatagtgaggactcagaagaaaaagatctgaagacaaagaaggatgattttcactgagcagaggataatgaagatgaaaatgaagatgataaaaatgtacgccagcacagcaggcagcatctaaagcagcttccaaacagagctcatggaagatgtgggcatgaggaagaacaagaagaggatgagacacccttccaggagaattccagcagcaatgaagatttcctgatggaagatgatgacaatagtgactatggcaattcaaaaaagaaaaacaaaaagatggttaagaagtccaaacctgagagaaaagaaaagaaaatgtccaaacccaggctaaaggctacagtgacgccaagtccagtgaaaggcaaagggaatgtgggtcgccccacagcttcaaagccatcgaaggaaaagattacttctcccaaggaagatgaggtaccagaaagcccgccagaaaagaaaacatctacaagcccccacccaagaaatctggtgatgaaggcatctggggaggcttaaaagcgttgatggtttggggagagcttttaagaaaaggagagaagaggaggaaaggaggagaggaggagagaagagaaggaaaaaaaagaaaaagaaaagaagaaaagagagggaggaaaaaaagaacctacttaagatagaacatggttttgtctacggcttgacccatgggctttcagtgcttttttccaattgttgaaagtaacacttctctctcttttaaaaataaaaccattgtatgtttaattgtttaaattacctttttgtctattggtctctttgccaatgcccccacccacccccagctgccctttcccaatgaaagctatgtcaaattaatcactggattgatggcttcatctttttatttttaatggaaggtgtaccgcagttgtaaagcagtaagatttgagatgaacactatggaaactttgcttcttgctgaacaatagcaagttgaatagtaactaaaaaaacgtagacagattttagttcaaaatgattgcttctttctctacctggacttttaaaaaatcagttgtcatccaatatgagtttatttgtctatgtacacaagtataaatgtctaaaaaaacatgactttaaacttacactgatgaggcaagtagaagataaagatgaattctgaactggttaaaaaaaaagaaatggtcacagccaccctgtgatgatggttaatttcaagtgtcaacttgactagtttaaggaaacatacaaacctctaaaagtgtcattttggggtgtgtctgcaagggtgtttctagaggagacttgcatgtgagtctgagtggacgaggaggggaagatccgccctccgtataggcaggcaccatccaatcttccaggggcctggagaaaacaaaacagaaaaaggcagttatgttgcactgtctgttggagctggaatacactcttcctctcctatccttggacaacaacttcaggctctccagtctttggactccaggactaaaaccaatggcttcccctgttctcaggcttctgacttcacactgagagtgacaccacccgcttccctggttctgaggtctttagacttggactgagccatgttaccagcatctcagagtctccagcttgcagtcagcctgttgtggggcttcttagcgtccataatcactgagtcaatcttcctaataaatcccctctcatctacctatctatctaccctattggttctatctctttgaagaactccaacgaatatacatgctaacccccagcaacaaccaccctgatcaatcagcagccatcaatgtcaagacccttcaccagcaagattataacttgttgaagacttgattatcattagcaatttttctttttgagagagagtctcactctgtcgcccaggctggagtgcagtggcacaatctcagctcactgcaacctccgcctcccaggttcaagcgattcccctcccttggcctccaagtagctgggactataggtgagtgccaccacacccggctaattttttgtatttttagcacagacaggctttcacggtgttagacgggatggtctcgatctcctgacctcgtgatctgcctgcctcggcctcccaaagtgctgggattacaggcgtgagccaccgcacccagcctatcattaacattttttagcaataaagtgtttttaaagtatgtacattttttagacataatgctattgcacacttaatagactacagtatagtataaacataacttttatatgcactggggaacaaaaacgttcatatgaatcactttattgcaatattagcctcattgcagtggtctggaaccgaacctgaaatatctctgaagtatgcctatataaaattcttcataccagaaagaggacttactgatagaggaaggtgtgggatataggcaatgtgtgtgacagaaaaagatcagtagacgacaataaaccaatggcaatggaaggatcaagaaggaccaagagagagagatttctgtccatcaggcttgtctaaaatgaaaaccagaggcacattgtgtatcatttatagcttcatgtatgcatgtatctgtctaagttaactgtttatggttttctatgatgttggcacagtaattttacactatttgtattgattttataaaatcaggttaaagccatctcttattattagagattgatactagaaattttagttaaagatgcaggtaaaatgcatgcattaactcttattctcaagttattctaaagagtaattaaacagattttgaaacacaaaaaagacataaaccacagggacaaagaggagaggagaaagcaaaaacaaaatttcggatggtggaaagcactcagacaagtgacaactgaattagaagacctgagggtgtcaaattgtatagcagtggttgggaagctgcgaagagtccaacttacactgaagaactcccaaagtcttaggaactggtaacaaggttcttcttaaagtgaggttgaaggtgagtgaagattagcagataagaggaaagtctagttaaaaagctgttagatgaatgaatgaatgagtgaatgaatgaatgaatgaaaatagggtagatagataggtagatgagaggggatttattaggaagattggctcacgtgattatggacactaagaagccccacaacaggctgattctatacaatggaatactgttcagcaatgaagaagttctgattcatgttacaatatgtatgaaccttgaaaacattatgctaagtgaaagaagccagtcacaaaacacaacatatggcattattctatttatatgaaatgcgcagaatagacagattcatagagacagaaagaacagttgactcttgaacaacatagatttgaactacatgagtccgcctatatgtggattttcttctgcctctaccaccccgggacaataaaactcaacccctcctccttcttttcctcctcagccttctcaatgagaagacaataaggatgaatacctttaggataattcacttgcattttgtttattttttttccataggttattggggtacaggtggtgtttggttacatgagcaagttctttgctggtgatttgtgagattttggtgcacccatcacccaagcagtatacactgcaccctatttgtagtcttttatccctcttccccatcccacccttccccacaagtccccaaagtctattgtattattcttatgcctttgcgtcctcatatcttagttcccacatatcagtgaaaacatacggtgtttggttttccatttctgagttacttcacttagactaatagtctccaagatcatccaggtcactgtgaatgctgttaattcattcctttttatggctgagtagtattccattgtatatatatatatataccacagtttctttatccactcaattgatgggcatttgggttggttccatgattttgcaattgcgaattgtgctgctataaacatgcatgtacaagtatctttttcatataatgaatccttttcctctgggtagatatccagtagtgggactgctggatcaaatggtagttctacttttagttctttaaggaatctccacactgttttccatagtggctgtactagttttcattcccaccagcagagtagaagtgttgtctgatcaccgcatccacaccaatatctactgtttttttatttttttgattatggccattcttgcaggagtaaggtggtattgcattgtggttttaatttgcatttccctgatcattagtgatgttgagcattttttcatatgtttgttggccatttatatatcttcttttgagaattatctattcatgtccttagcccactttttcatgggattatttttttcttgctgatttcattgagttcattgtagattctggatattagtcctttgtcagatgtacagattgtgaagattttctcccactctgtgggttgtctgtttactctgctggctgttccttttgccatacaaaacctctttagtttaattaggtctcagctatttatctttgtttttattgcatttgcttttgggttcttggtcatcaagtccttgcctaaaccaatatctagaagggtttttccaatgttatcttctagaatttttatagtttcaggtcttagatttaagtccttaatccatcttgagttgatttttgtataagctgagagatgaggatccagtttcattctcctacatgtggctagccaattatcccagcaccatttgttgaaaagggtgtcctttatgttttttgttggtggtggtggtggtggcttttgttgttgttgttgttgttgttgtttgttttgagatggagtctcgctctgtcacccaggctggagtgcagtggcacgatctcagctcactgcaagctccacctcccgggttcgcgccattctcctgcctcagcctcctgagcagctgggactacaggcgcccgccacgactcccggataattttttgtatatttagtagagagagggtttcaccgtgttagccaggatggtctcgatctcctgacctcatgatccacccaccttggcctcccaaagttctgggattacaggcgtgagccaccacgcctggcctcctcactttatgtttttgtttgctttgtcaaagatcagttggctgtaggtatttgggtttatttctggattctctattctgttccattgatctgtgtgcctatttttataccagtagcatgctgttttggtgattatggccttacagtatagtttgaaatcaggtagtatgatgcctctagatttgttctttttgtttagtcttgctttggctatgcaggttcttttttggttccatatgaattttagagttgttttttctaattctatgaagaatgatggtggtattttgatagggattgtgttgaatttgtagactgcttttggcaatatggtcactttcacaatatggattatacccatccatgagcatgggatgtgtttgtatttgtttgtgacatctatgatttctttcagcagtgttttgtagttttccttgcagaggtcttttgcatccttgattaggtatattcctaagtattttaattttttcacagctattataaagggtgttgagttcttgatttgattctctgtttggtcactgttggtgtatagaagagctactgatttgtgtacattaatcttcaatccagaaactttgttgaattcttttatcagttctaggagctttctgaaggagtctttagggtttccgaggtaagtgatcatagcgtcagcaaacagtgacagtttgacttcctctctttactgatttggatgccctttatttctttcttgtctgattgctctggctaggacttccagtactacgttgaagaggagtggtgagagtgggcatccttgtcttgttccagttcccagaaggaatgctttcaacttttccccattcagtattatgttggctgtgggtttgtcatagatagcttttattaaatttaggtatgtcccttgtacgtcaattttgctgagagttttaatcataaagggatgcttggattttgtcgaatgcttcttctctacctattgagatgatcatgtgatttttgtttttaattctgtttatgtggtatatcacatttattgacttgcatatgttaaaccacccctgccctgcatccctggtataaaacccacttggtcatggtggattacctttttgatatgttgctggattcaattagctagtattttgttaaggattctagcatctatgttcatcaggggtatcggtctgtagttttcttttttggttgtgtcctttcttggttttggaattagggtgatgctggctgcatagaatgaattagggagggttccttctttccctatcttgtggaatagtgtcaaaaggattggtaccaattcctctttgaatgtctggtagaattctattgaaaatccatctggtcctgggcttttttttgttggtaatttttaaattaccatttcagtcttgctgcttgttattggtctgttcagggtatctaattcttcctgatttaagctaggagggttgtatttttccagaaattcatccacctcttctaggatttcttattctttttattttctttctttctttctttttttttttttttctcgagatggagtctcattctgtcacccagactggagtgcagtggcacaatctcagctcactgcaacttccacctcctgggttcaagcgattatcctgcctcagcctcctgcatagctgggactacaggcatgcaccactacgcctggctaacttttgtatttttagtagagatggggtttcaccatattagccaggctggtcttgaactcctgacctcgtgatccacccacctcagcctcccaaagtgctgggattacagatgtgagccaccgcgtccagcctcttctaggttttctagtttatgtgcagaaaggtgttcatagtagccttgaatgatcttttgtatttaagtggtgtcagctgtaatatctcccatttcatttcttattgagcttatttggattttctgtcttcttttcttggttaatcttgctatggtctatcaatgttatttatcttttcaaagaaccagctttttgtttcatttttttgtttgttcgtttgcattttgtttgtttcaatttcattaggttctgctctgatcttggttatttcctttcttctgctggatttgggtttgctttgttcttgtttctctagttccttgaggtgtgaccttagaatgtgagtgtgtgctctttcagtctttttgatatgagtgtttagggccatgaagtttcctcttagcaccgcctctgctgtatcccaggggttttgataggttgtgtcatttttgtcgttcagttcaaagactttttaaaatttccctcttgatttcgtttttgacccaatgcttattcaggagcagcttatttaatttctatgtatttgcatggtttcgaaggttcattttgaaattggtttccagttttattccactgtggtctgagagaatgcttgatataatttcaattttcttaaatttattgaggctcattttgtggcctcatggtgtatcttggagaaagttccatgtgctgttgaatagaatgtgtgttctgtggttgttggatgaaatgttcctatatatctgtgaagtccatttgttccaaggtatagtttaaatccattgtttctttgttgactttctgtcttgatgacctgtctagtgctgtcagtggagtattgaagtcccccactattattgtgttgctgtctatctcatttcttatgtctagtagtaactgttttataaatttgggagctctagtgttaggtgcatatatttttaggattgtgatattttcctgttggacaaggccttttaccgttgtataatgtccctctttgtcttttttaactgctgttgctttaaagtttgttttgtcttatataagaatagctacccctgctcacttttggtgtccatttgcgtgaaatgcctttttccatctctttactttatgtgagtctttatgtgttaggcgagtctcttgaaggcagcagatgtttggtgagttcttatccattctgcagttctgtatcatttaagtggggcatttaggtaatatcttgtcatattaccggagttggttttctggttccttctcatttgggtaggctctgtcagagggaagggctagggctgaagggtgtcgttcagattctttttttttttttttgagatggagtctcgccctgtctcccaggctggagtacagtggtgcgatctctgctcactgcaagctctgcctcccgggttcacgccattctcctgcctcagcctcccaagtagctgggactacaggtgcccgccaccacgcccaactaattttttgtattttttagtagagacgaggtttcaccatgttagccaagatggtcttgatctcctgaccttgtgatccgcccacctcggcctcccaaagtgctgggattacaggcgtgagccaccgcgcccggcccgttcagattcttttgtcccatgaggtgttcccttgatgtagtactctcccccttttcctatggatgtgacttcctgagagcagagctgcagtgattgttatctctcttctgggtctagccacccagcaagtctaccaggctttgggctggtactggagtttgtctgcacagagtcctgtaatgtgagccatctatgggtctcccagctgcggataccagcgcctgttctggtggaggtggagggtgccagggagtgaaatggactctgtgagagttcttagctttggtggtttaatgcactattattgtgctggttgacctcctgccaggaggtggtgctttccagagagcgtcagctgtggtagtatggagaggaactggttgtgggtagggccctagaactcccaagtgtatatgccctttgttttcagctaccagggtgggtagagaaggaccatcaggtgggggaaggggctaggcgtgtctgagttcagactctccttgggcgggtcttgctgtgactgctgtgggagatgggggtgaggttcccaggtcactggagttgtgtgcctgggaggattatggctgcctcttctgaatcatgcaggttgatagggaagtgagggaaagctggcagtcacaggcctcacccagctcccacacaatctgaagggctggtctcactcctactgtgtccctgctaacagcaccaagtctgtttctaggcagtgggcaagcagggctgagaacttgccccaggctacccgcctcctggctgtgaaagaaaaaggctttagttcttcccctacctgtggagtctgcacgctggattcacgccccccatccccacccaaagttctggccaggaggcttctcacctgcttcaaattgttacaaagttcaactgaagactttcttctccctgcggtgttttccccccgcctctggccaccctcccaaagatccctgtggtgccaggcaggaatgggctgcttggggacccagcaagctcccagggcctttcctgctgcttcctctacctctgtattttgcgtgactctctaaattgactcagcttcaggtgaggtcagaaacttctcccgcaaacaagaccttcagtttccccagtgggggtatgtgcctcaggggcggaagatctccctttcccactttcacactttggacacacaatatttggggtgtctcctgggtcctgcaggagcagtccacttccttcagagggtctgtgggtcctcttgggattcctggtttattcctgcagttgttctggagctaaaattcacgacgctagcctctgcatgctgctctgtccatccaagtcagagctgcaatctagttctgcctcccacttgccatgatgatccctttattttgattcacttccacttaatgaatagtaaatatattttatcttccttatgattttcttaataaaattttattttctctaattactgtaagaatatagtatataatatgtatatgttaatcgattgtttgttatcagtaaggcttccagtcaacagtaggctattagtagttaaatttaggggcagtccaaagttatacatagatttgtggcttcacagggggtcagtgccctcaagccccatgttgctccagggtcaactgtagattaatggttgcctggggctgggagaggggagaatgatgagtttcttctgatgagtatgggtttccttttggagataaaaaaatgatgaaattgactgtggggggtcgatgggtgcaaaactctgaatatagcaaaaacgattaaattaaacaattgatgtttttaaaataagaaaacgctaaaccccatcaaaaaatgagccaaagccctgggtgtggtggctcacgcctgtaatcccagcagtttgggaggccaaggcaggtggatcaccggaggtcaagagtttgagaccagccttaccagcatggtgaaaccctgcctctactaaaaaaaaaaaaaaaaaaattacctggggatggtggcacatgcctataatcccagctactcagcaggctgaggcaggagaatcacttgaacccgggaggtggaggttgaagtgagccaagatcatgcaattgcattccatcctgggcaacaagagcaaaactccgtctcaaaaaaaagaaaaaaagaaccaaagatctttttttttttttgagacagagtctcgctctgtcacccaggctgtagtgcagtggcgcaatctcggctcactgcaagctccgcctcccaggttcacaccattctccggcctcagcctcccaaatagctgggactacaggagcccgccaccacgtccggctaatttttttttttttttttttttgtatttttagtagagacagggtttcaccgtgttagccaggatggtctggatctcctgactttgtgatctgcccgccccagcctcccaaagtgctgggattacaggcgtcagccaccacgcccggccatgaaccaaagatcttaacaggcacctcaccatagaagatacacagatggcaaataagcatatgaaaagatgctcaacattatacctcatcagggaaatgcaaatttaaacaaagaggcaccactacacacctattagaatggccaaaacccagaacactgacaacaccaaatgttgatgaggatgtggagcaacacaaaggctcactctttgctggtgggaatgcaaaatgtttcagccactttggaagacagtttggcagtttcttacaaaacacaacatattcttcacgtacagtccagcactcacacaccttggtatttacccaagtgagttaaaaaaattatgtccacacaaaacctgcacacaggtgttgatttattcatagttgccaaaattcagaggcaaccaaatgtcatttggtaggtgaatggataaatatactggtacatctggacaatggggtattactcagtactagaaggaaatgagctaacaaaccaggaaaagacatggaggaaagttaagtgcatgttactaagtgaaagaagccaatctgaagggctataggctgtataattccaatgacatgacattttggaaaaggcaaaactatggggacagtaaaaaatcattgatcattgtcggggagggagggataagacacagaacgcagaggatttttagggcagtgaaactgctctgtatgacactataatggtggatgtcatcatacatttttttcaaacccatagaacgtaagataccaagagtgaaccctaatgtaaactctggattttgtgtcatagtgatgtgtcaatgtagattcatcaattgtaagaaatgtaccaatctggtggaagatgttgatagtaggaaaggctatgcatgtgcagggatagaagaaatatgggaactctgtatctattccagtatttttttttttttgagataggatctcactctgtcactcaggctgaagtgcagtggctcaatcacagctcattgcagcctcgacctcctgggctcaagcgatcctccaacctcagcctcccaagtagctgggattacaggaaagtgccaccatgcccagctaatttttttgatgtttagtagagacaagatcttgctatgttgcctaggctagtctcaaattcctagggtccagcaatccacctgccccggcctcctaaagtgctgggattacaggcatgagccaccgtgcctggcctccacttatttttgctatgaacctaaactgctctaaaaaataaagtctatttaagaaaattaactaaatgaaagagaaaagggagatggtatagctcctgccctaatggagtatacttactagtatgtactattcttgaaaagaaaaaaaatccataaatatttttaaaacgtttttaaaagttgattctaaaactcattgtactgggtaagggcacaccagacaagcagtctccttacaaaacagtgcccaatacaccctgttcctgcccaggtgtaccacaggggacccttacagtgcagtgcccttcatctagttaactgagagtagggatggctttgagagcatccaactacatagaataaaaagggtctttgcactggaggctcttaagagaagtcaagcacaaatccattgttttataaatgaaaatactggagctcagagaaattaactaaaggtagagggacttcagtggtaaaatgtgtttttgatgcattatctcacaaaaaccttaagaagtcagtgatattaatgtccctgatttagagaggaaggaaataagagactaaggaatttgttcaagttcacacagctatttaagtgacagaatcaactctaactccagagcatattgtctgacttctatgctagagttctccttcagcacttcttttcataaaatgaatctacttggtgattatattattacttgatcatttgttttgaattctagtcctcggaaaagttcatgttttctttggtttgttttctaggattccttttcagaacaaatcattccactttatagtgctataacagtcctctcattaaaggaactataattttttttctatcacagcattctaaagcttcaatgccaacagccactccaacctcccctttatacatgtcccaaatgtataacctaaaaggacttatgtgaaaatctgaagtttcattcatttgtttatgtattacttcattcagcaaatatttattgagcacttattgtaagacaggccttgggtatacaatgaatataacagacatgatccttgcagccatggagcctgtagtctaagggaggaatatagacattaaacaagcacaatcagtacttagaattataagccatattaagcgctatgaggaaaataaatggaaaaccatgagagactacaagagaggactggattttgattgggagaccaagaaaggcctctttgaaaaaatgatgagccgagagcatcaggatgagttagtgtcagaaaggcgaggtttaggtggaaggttatagggtggggcacatgcagcatttcaggaaaatgaactgcatatgtgaaagatccaagataagatggtgtttgcatggttaagaaccgaaaacaacttaatgtggctagagtgtagtaagtgaggagcgtggtaggagatgaggttggagatttaaacttaaatctgatcatgcagatgcttgcagtccatataaggacttctccttatatgagaggagggaaatgggcttctccactctctggtcccaccagaaagttttcagaacatttttcacgaaaataaattctcttcagaggaaccaggtgggtatctgaacttcctttgaagtaggattttaccgttgccacaggactctcagaagtctgatccttttagtcactaaccatataaggatccttatcaaggtttgaactatgtttcaaagatctctctggccaccatagtgagcataagagggaggggcaggaaaagagggtgggatggtgcgtagcaattgagttgcagtagtccatttgagagggaataaggacttggagacggagaaataggaaaagacttgagaaatattttgaaagtggaatcagtagtatttggtaatgggctggcggttataagcaaaggagagggcatttgaaaagatgactcctaggtttgtggctttagcaaatgaacagatggtagtaacatatatttagataaggaagatgggaggaggaagatcaagagttcaggtttggacaagttaaatttcagttgcctctgagatatgtgagtaggcagttggctacacaagcctggaggtcagaaaaaaggcctggactggagattaaaatgtgggtgttaacagcatttggtgatatttaaacccacagaactgggccgggcacagtgactcacccctgtaatcccaacactttgggaggcggagatgggtggattacttgcggtcagaagttcaagaccagcctagccaacacggaaaaactctgtctctactaaaaatacaaaaattagctgggcatggtggctcatgcctgtaatcccagctactcgggaggctgaggcaggagaatcgcttgaacccaggaggtggaggttgcagtgagccaagatcacaccactgcactccagcctgggtgacagagcgagactctgtctcaaaaaataaaataacctaaaatgaaataaaagtaaagctacaggactgaataagattacttgggggaaagtgtagagagaagaaagaaacagggtccataaggagtgccaagtggtctctaatacatagaggcagaggagaggagatagggttagctgtgagacttggattagcctggacataggagaaaggagaggacagcatggtgacaaaaagaccaaggggagagtgtttcaataacggtgcaagcaactatgtctagtgcttctgagaggttaagttgaggttgggaatgtatctactgtatttggtattgttgtagtagtgtgctgaaactgactcccatcagtgcagagaatctatgtgggcatcttttcccaattctgtgtttagtgatgacacattggtagccatggtgggagtatttccactgtggaagttagcaaccacttctatggttttttttgtttgtttgttttgttttgtttttggagagctggttgtaaacatgtaacagcatgccactgacaatatgactccatttgtaataagctgaaaagggaaatggccttctctgctctctggtctcgtcagaaagttttcatgaaaataaattatcctcagaggaaccagctgggtgtctgaacttcctttgaagtggacttctacctttgccactggactctctaaagtcttagccttttagtcactaaccttcacaaatctgatgccgaccaacaggaaaaaaaaaatcaatgtggtcatatgaagaattccttccaactctgagatgctgtgattctgtgttggctgcaagaaattccaggaagcacaagcagtaaaccacatttcatttactcctgggcttatttacttggtaaaaataatcattagaaaattccagaatccaggggctaagaaatgatattttccacatcttttttatttttgaaaaatgtttactattttataaaaaaaaaaaaagtagataaaaaaattaactgtggctgggcacagtggctcatgcctgtaatctcagcactttgggaggccaaggcaggcggatcacttgaggccaggagttcgagaccagccttcccaacatggcaaaacaccgtctctactgaaaatacaaaaattagttgggcgtggtggcacacgcctgtaatctcagctactcaagaggctgaggcaggagaattgtttaaactcaagatcacgccactgccctcaagcctggcaacagagtgagactatgtcccccccaaaaatattaattgaaatattaattgaatattgattgaatattaattgaattatcactacttgaagccagaggcaaggcaggcttctcctactctagaaaggaaaaagaagaggaatatttaataatttagatgttcttagaatatggaattgttaagtatgcaagttaacactatgaggacaactactaaaataaataagataccatgtctggctcctaaagtaacagcagaagaaaaaaggactatagaaaatgttttcaacacaagagaaggaaggaaaaaggaaaaaataagcaaagaatgataaacataagatgaaaaaataagaaaattaaaaataagttgaaacattatcattagcctcagcaaccataaacgtgttaaacattgactttcaaaaagagattatcagaatgattttttttttccagacagagtctcgctctgtcacacaggttggagtgcaatggcatgatctaggctcactgcaacctccagtccatcaggatcaagcgattcttctgcctcagcctcccaagtagctgagattacaggcacacgccaccacacctgtattttcagtacagacagggtttcactatgttggtcaggctggtctcaaactcctgacctcaagtgattcacccgccttggcctcccaagtgagaatgaattttttaaaaccccaaatccgtccaggcgtggtggctaacacctgtaatcccaacactttgggaagacgaagtgggcagatcaccagaggtcaggagttcaagaccagagaccagcctggtcaacatgttgaaactccgtctctactaaaaatacaaaaatcagctgggtgtggtgacacatgcctgtggtcccagctactcaggaggctgaggcatgagaatagcgtgaacccaggaggcggaggttgcagtgagccgagattgtgccattgcactccagcctgggagacaggagtgaaacgccacctcaaaaaaaaaaaaaaaaaaatgcattgaatacacctaacttaccaaacatcacagcttagcttagcctaaattaaatgtgctcagaacacatacattagcctaccattggacaaaaccatctaatacaaagcctatttttcaatatcttgtgtaatttattgaatactgtaccgaaagtgaaaaattgaatagttgcatggttacttgaagtatagtttctactgaattgcttttaaagcattgtatagttgaaaaattgtaagttgaaccatcgttatcagtataggcagggccgtgctccctctgaaggtgctaggaaaggaattactccatgcctctctcacaacttctggcagcttcagatgttcctcaccttgtaggtgcaccactccaagcctgtctttacatgatgttttccctgtgtgtcttcacatcatcttcctctgtgtctatgtctgtgtccatatttccctcttcttttaaggacaccagtcttgttggattagaggcccaccctactccactatgacctcatctgaacttagctaattgcatctgcaatgaccccgttgccaaataaagtcacattctgaagtactggagattgaaacttaaacctatctttgggcagggggcacaatttgacccataacagaaggaggcatcagtaaaaataagggcagaaaaggctgaaatagaaaccaaagtcataaaatagagtaaataaatacaaatgaaagttagttttaagaaaaaaatccggtttgattacccaatctttaataagactgataaagaaacaaaagagcacaaataaactatattaggaatcataaagagatacaattgcacccacagatatataaaatcacagatcattgcactataaaaaagaatacttatttatttatttatttatttatttatttattatttttggagatggagtctcattctgttgcccaggctgggtgcagtggtgccatcataactcactgaagcctcgaaatcccaggctcaagcaatctgcctgcctcagtctcccaaggagctgaaactacaggcatgtactagcatgcctggtcaattttttaaaaatgtttttggagagatggggtgggggggcgggtcttactatgttgcccaggctggtcttgaactcctgacctcaagccatccttccacctcagcctctcaaagttctgggattacggatgtgagccatcatgcccaaccgatatttatttttaaagcaaattctacagatcttcgagggaatagcacttaagactatttttaaaacttggatgggtaggtgatcacatatctctatttataatagctatgtgtcttctcttagctatattggatttttttttttttttttgagacagagtctcactctgtcacccaagctggaatgcggtggcgtgatctcggctaactgcaacctctgcctcccgggttcaagcgattctcctgcctcagcctcccatgtagctggaattacaggcacccgccacgcctggctaatttttgcagttttagtagaaatggagtttcaccatgttggccaggctagtctcaaacccctgacctcaggtgatccgtccgcctcaccctcccaaagtgctgggattacaggcatgagccactgcacctggctatattggatcttattttcaggattttagagaaaaaaaggaagaactaagaaatgtgcccttagctagtaggaagctgtggggttagaaaaacaattactaggaacttttaatgctaaccattaagtaaatattttagtatatttgaacacacagagcatatatttttacctactcaaatgtttctatgtggatatgaaaatatatacacaagaaaatgataatggagctactgacagatgctttggtacagctgcaaaatgcaaatatttctctatgtatattcatgttcgctccagagataaagatcgacaaacctgctgagctggtattttatgcactatttttctgtctgctttttaacaaggggctccacattccacatacgatctacatttcattttaactcccaagttcttggctttactcttttcatgtcagctttatccttttaaccacctgttcgatagtgatttctcagcttcaaattctagcttgcttttcttccccctcagaaatgtcctgtaattttatttattgtttcctgaagtgtggcacttgctcataatttcatgaatgacagccttttcccaaagggaaccaaaatagtagttattctccagctccacttcacaaccatatttaaatgcaaatacaatcacttccattctatctgctttgcttctcatatctgatctaaactatcaagacattaccaaaatctagcttttgttttttgtgatggtgacttttcatttttatatacacgtttttggggttgttcaagaattatataatgcccaggtacaagttataagatagctgtactatggctacacttcattattaagtagactatttgatttcctctacacttatcaatctatccctgtgcttttgcttttattggtctcccggcctggacatttagttcctctttgcttctgttacccaattgataaagacagtggggcctggagcctgacttacctaagatcacacagttaattaggacataactgagcctagagataatctctggactcctggtcccctgggatctttccaccgcaccccactgctttcttcaaggtttagttcaaataatgcctatctaagaagtcttcttgaaaccttcaaacagaagtaatctgtcctttcgttcagcacctgcatgcttgaattgcagcccctcggatgcttatccctttatttatttgtttgtttgtttgtttgtttgtttatttttgagacggagtttcggtttttttgcccatgctgaagtgcaatggcgcgatctcggctccctgcaacctctgcttcccgggttcaagcgattctcctgcctcagcctcctgaatagctgggattacaggcatgtgctaccacgcccagctaattttgtatttttagtacagacagggttgcttatcactttttatttggcactattgttattcatgtacaggcctttatttcctctcttcatgtccagttctttgagactcgaacctgctttacttttgtgtctctcatatcacctagccttcttgtattagtaggtgctcaatgtgtatttgttaaattaattagacccctttcacattttgcacaacttgtggtcatggaaatcatgtgtaagccagaaaccccagcatgccagttggcttggggaattcttttgagccatgcctttctgcctgttgctcaacacttctgtggttctagaacttcattgtccaagagaactttctgtaatgatggaaacgttttatatctgcactatccaatatggtaccactagccacatatggcaattggccacctacatgtggctagtgagactgaagaagtaaaattttaattttattgaactttaattaatttatatttaaatagccacatatgactaacagctgccacattgtacagcatggttttaggcaccccattttgataaattcacttgtcttgtcccattcaacttggttacataattctagatggcctgctgctcagtgagaaatgacatttttgtcctcaagtctccagccttcaagattccatgccttacattcctctttccccacttttctcctcaggagaaagatgagattcctaaagattttcctaagcactctgatcttcacccatctttcttgctcagaatctgactgtgttggtaaagcaccagggtataaatgtctaatgcctaggtgtatggtgtttgctgctattttgaatcttagattttgctaaatagattataaacttcttgagtgtaaggaccatgcattccatatcttctggatcctccctgttgcctattccactgccagttatattgtaaatgttctataaatattaatcaattgattgatttaaggtggaaaaatggtctgggagcagtggctcacacctataatctcagcactttggaaggccaaggtgggcgggtcacttgaggccaggatttctagatcagcctgggcagcataatgagacccagtctctacaaaatttttttaaaagtttgctgggcattatggtgtgtgcctgtaatccctgctgcttgggaggctgaggttgagcccgggaggttgaggctgccgtgagctgtgatagcactactgcattccagcctggtttacagagtgagaccctgtctcaaaaaaaaaaaaaaaaaaggaatctagtacgagcaagaaaggacaatatctgagaaatagggaagggggttgtcaaaatctcaagatttacttagcaccctaaagactaaaggacttttagaattatttcacttattcccataattgtttcacaaacgcccgttcgtattatttagtattagtcatctaaagaactcaatttaaacaatttttcagagtacgcaggtggcaacactatgttagccattttgaacgtattccttcctaagagggtcttctatcaaagaaacttttattattgttatttttattttttaaatagagatggggtctccctatgttgcccaggctgatcttaaactcctgggctcaagcaatcttcccacctcagtctcccaaagttctgggattacaggtctgagccaccacacctagcctaccaaagaaactttctgatcatgtttatgaacctcatcgtagataacttactgggaaattgaggagttgttaggtacctaaaacagcacatttggtggaagtaggataagaatgtgtcgcatatttgtttaaaaccttctcaaggtaggctcttgaatgtatataatgccatcctgcttttgtggatgaggtaataaaagcaaaggtgttagtgtcatgcctaggtctatggaaagtattttggtttacttttccttcttcctttagcacccaaattacactttagcaagattgagctcctgtggaaacctagcctatggcaaaattcctgctgaccacaccctgtgtgagaccacagtcagtctttaagaggctctgccaggaggacttagtaaattaatgatagctgcaaagttagaaggcccaacctggaattctctctcctgtagagccacactgccttcctgcctgtgctccaaccattatctcacagtgcccaaaatatgaaaagaaaattaggagccaggagggagttgtctttgtgggacaagaatttcagctggcagtagttaatcatatttttccagctattttgacatgcattatataagggaacaaattccaagacaaaacaaaaaataaaatgcttgtgactctagaagtgcaaacatagggtaaattagagctggcttttcttgttaactttgtatttacacaggatggatttgtttaagtaatttctctttttttatttacataaagccacaaatctagtatgttatttcccgatccatttttatttctgctgattttcatatgtttaaaatgtgttttcgttttcaacaggctgaaaatgcttatgaatcatatgcacacatacatatgtataataaatcacttttataggaccgatcaaatctggcattctttgtagtccacagtggttcacattttcgaggcttttcaccctgttttgaactgcaacttaacactcacaaaataggttgttcaaaggtaaaggttctgcttacaggcacttgcctttgactaggtacacctagattaagtcctgaataaaatggaggaaataacttctgtctcatctccatttatttcaggactaatgaagaaaatgcacttagtagtctgtaccaacgctgcccagtgtagaaataacataggcgacatgaatatggtgattttttttttttttttgagatggtgtcttgctctgtcacccaggctggagtgcagtggtgcgatctcggctcactgcaacctctgcctcccgggttcaagtgattctcctccctcagccttctgagtagctgggattacagtagcccaccaccacacccggctaattttcgtattcttagtacagacggggttttgccatgttggccaggctggtctcaaactcctggcctcaagtgatccgcctgcctcggcctcccaaagtgcaggcgtgagccactgcgcctggcccactgatttattttctattgctatagttctgccttttccagaatgttatataaacagaatctaatgatatgagtctttctggttctttcacttatcatgatgcatttgagatgcattcctgttggagtgcctttcaattgtcctttcccttttcttactaagcagtattccatggtatggatgtaccacagtttgtatatcccttttcccagtgaaggatgtttaggttgtgatatggtttggatttgtgctcctgcccaaatttcatgtcaaaagtaatccccagtgttggagaaggggcctcgtaggtggtgattggatcagggggcagatttcccccttgctgttctcgtgatagtgagtgagttctcacgagatctggttgtttaaaagtgtgtgacacctcctccttccctctcttcctcccgctccagccacataggacgtggttgcttccccttccctttctgtcatgattgaaagtttcttgaagcccctgcagccatgctacctgtacagaactgtgagccaagtaaaccttttttcttgataagttacccagtctcaggtggttctttatagcagtgtgagaatggactatccagtgtttgatgattacaaatagaactactgtaaacattcatatacaggtttttcagtgaacataaattttcatttcttttagggtaaatactcaagagtagtatcaaggttttttgtttttgtttttgtttttttgagacaggttcttgcttcatcgcccacgctggagtgcagtggcacaaccttgctcactgcaaccttccatctaccgggcgcaggtgattcttgtgcctcagcctcctgagtagctgggattacaggcacgcaccatcacacccaacacatttttgtgtttttagtagagacagggttttgccttgttggccaggctgctctcaaactcctggcctcaagtgatctgccttcttcagcctcctgaagtgctgggattacaggcgtgaccatcacacctggcctggtatcaaggttttaaggtatatgtttaactttataaaaaattcccaaactgttttccaaagtagttgtaccattttatattcccatcaacaatgtatgagagatccagtttctccacaatctcaccagcattcatattatcattgttttgtattttagctcttctacaagatgtgtaggagatagtgcttttaatttgcaattctctaatgactaatgatgtcaaacatcttctcatatgcttttttagctattcatataccttctttagtgaaatatccaagtctttatatacatatatatatatatatatatatatatatatatatatttttttttttttttttttttttttttttttttgagatagggtctcagtctgtcacccaggctggagtgcagtggcacgatctcagctcagtgcagcctgcacttcccaggctcaagtgatcctcctacctcagcctcccaagtagctgggaccacaggcatgtgtcatcatgttcagctaatcttttaattttttgtgaggtctcactatattatctaggctagtctcaaactcctgggctcaaatgagcctcccaccttggcctcccaaagtactgagattatgggcaagagccactgtgcctgaccactattttctaatttgatatttttctaattgtagagtttagaaaggtgttttttgttttttgtttttgtttttgttttttttttttagaaaatggatatatgtcctttgttggatatgtgatttgaaaatattttctctcagtgtatgccttgtatgttttaaaaaataaactttattttttagagcagttttagcacagcaaaattgagtggaaggtacagagatttcccatataaacctgcccctacatatgcatagcttctcccagtgcatttccacaccttccattgtagtggtgcatttgttacaactgatcaacctacactgacacatcattctcacccaaagtcctgcatttacattagggttcactcttggtgtcctacattctatgtgattggacaaagatacaatgacatgtatctgccattatagtgtcatataaagtattccactgctctaaaaatcttccgttttctatttacttacccctccctccccaccaacccctagccaccaatgatctttttactgtctccataattttgccttttccaaaatgtcacacagttggaattagacagcatatagcctttcagattggcttctttcacttagtaacatgcacttaacttccctccatgtcttttcatggtttgttagctcatttccttctagtgctgaataataccccattgtctggatgtaccagtttatttatccattcacctactgaaggacatcttagttgcttctgaattttggcaactatgaataaatcaacacctgcgtgcaggttttgtgtggacattttttttttttaactcacttgggtaaataccaaggagtgtgaatgctggattgtatgttaagagtatgttgagggttttttttgttgtttttttgttttttgagatggagcctggctttgtcacccaggctggagtgcagtggcctgatctcaggtcactgcaacctccacctcctgggttcaagcgattctctgcctcagcctcccgagtagctgggactacaggcgtgtgccaacatgcctggctaatttttgtatttttagtggagacggagtttcaccatattggccaggctggtctcgatctcctgacctcgtgatctgcccacctcggcctccccaagtgctgggattacaggcatgagccaccacgcccggccaagtatgttgagttttgcaagaaactgcgaaactgtcttccaaagtagctgaaccattttgcattcctaccagcaaagagtgagcgtttctgttgctccacatcctcatcagtatttggtggggttagtgttctgggttttggccattctaatagatgtgcagtggtgtcttgttttaatttgcatttcctgatgaggtatgatgctgagattttcatgtgcttatttgccgtctctgtatcttcttttgtggggtgtttgttaagatctttggcccagttttaaattgttttttttttattgttgctttttaagagttatttttatattttggattacagccttttatcagatacttattttgcaaatgttttctccccatctgtggcttagcttttccttctcttgacagtatgtttcaaaatttttaatattagtgaagtccagcttattggttctttctttcatggattatgcctttgatattttatctaaaaagtcatttccaaacccaaagtcatcagattttctcatatgttatcttctagaaatttatagttttgtgttttatatttagatccgtttttgagttaatttttgtgtagggtgtaaggtctttgtctaaatacatttttttgcctgtcgatgtccagttattccagcaccatttgttgaaaacattatttttttttccattgcattgcctttgctactttgtcaatgacaaattaggattgcattgaatttatagatcaagttaggaaaaactgacatcttgacaacattgagtcttcctctccgttaatgcggactatctctccatttatttaattctttgatttctttcaacagagttttgtagttttcctcatatagatcttgtatatgttccattagatttatactaattgttgcattttttgggtgctaatgtaagtagtattgtgtttttattttcaaattccacttatttgctggtatagaggaaaaaaattgacttgtttattaagcttgtaccctgcaatcttgttataattgcatatcaattccgggagtttttgttttatttatttattttttaaatgttttctttattttttatttttatttatttttttatttttttagacactttcgctcttgctgcccaggctggagtgcaatggcgcgatctcggctcaccacaacctccgcctcccgggttccagcgattctcctgccccagtctcctgagtaggtgggattacaggcatgtgccaccacactcggctaattttgtattttcagtagagatggagtttgtccatgttggtcagtctggtctcaaactctcaaactcaggtgatctgcccgttttggccccccagttatttgtttgttttaagaggtaaggtctctggccgggtgcggtggctcacgcctgtaatcccagcactttgggaggctgaggcgggcagatcacgaggtcaggagatcaagaccatcctggctaacacggtgaaaccccatctcttctaaaaatacaaaaccaaaattagacaggcttaggggcgagcgcctgtagtcccagctactcgggaggctgaggcgggagaatggcatgaatctgggaggcggagcttgcagtgagctgagatcgtgccactgcactccagcctgggcgacagagcgagactcctttaaaaaaaaaaaaaaaaaaggtggggagggggtgccgggcgcagtggctcacacctgtaatcctagcactttgggaggccgaggtgggcggatcacgaggtcaggatatcgagaccatcctggctaacacggtgaaaccccgtctccactaaaaaatacaaaaaaattagccaggcatggtggcgggcacctgtagtcccagctacttgggagactgaggcaggagaatggcgtgaacctaggaggcggagcttgtagtgagccgaggtcgcgtcactgcattccagcctgggcgacagagcaagactccgtccaaaaaaaaaaaaagaggtaaggtctcattatgttgcccaggctggcctcaaactcctgggctcaagtgatcaccccaactcagccttccaagtagctgggactacaggcatgagccaccacacctggctaattccaagagtttgggggcaattctttcagattttctacataggcagtcatatcatctacaacaaagacagtttcatttcttccttcctatcactccactttttattttctttccttatcttattgcattagctaggacttccagtataatgttgaaaggggtagtatggctaggtgcagtggctcatgcctgtaatttcagccctttgggaggctgagataggaggatcacttgagcccaggagtccaagactggcctgggcatgggagacccatatttccaaaaaaagcttttaaaattagttgggcatggtgttgcgtgcctgtggtcctagctacttgagaggctgagatggaaggatcacttgagcccaggaggtcgaggctgcagtgaaccaggtttgcaccactgcacttttgcctggatgacagagcaagagaaagaaagatgaaggaaggaaggaaggaaggaaggaagggagggaggaagggagggagggagggaagaaaaatgaaggagaaagaaaccaatgaacgataggtgacggacatctttgtattgatcctgatcttagtgggaaagcttaattttctcaccattaagtacgatgttagctgttttgttttttttttttagtagtccctgtgaagggacttgaggacattcctctgtgttcctagtttactgagagtttttatcatgaacgggtgttggattttatctaatgcttttgctatatctattgatatgataatgttagttttattctttatcttgttgagatgatagattacattagttgattttagttgaattttttaaatgttgaatcatccttgcacacctgagttaaattccacctggttatagtgtataattccttttctacattgttgaatttgatttgctaatattttgtgaaggatttttgtatctgtgttcctgagagatattgttctgtagttttcttttcttgtaatgtctactctgattttggtttagggtgatactggcttcacagtatgagttaggaagtattccctctgcttctgtcttctgaaaaagattgtaaagaattggtatgatttcttccttaaatatttggtcacccatttacttttaatctatatgtgtctttatatttaaagtggatttcttatagacactatatagttggatcttgttctttgacccacacagacaatctctgtcttttaattggtatatttgtaccactgatcttcaaagtgatcactgacatagttggattaagatttaccataggccaggtgcggtggctcatgcctgtaatcccagcactttgggaggccgaggcgggcggatcacgaggtcaggagattgagaccatcctggccaacaaggtgaaaccccgtttctactaaaaatataaaaattaagtgggctgtaatcccagctgctcgggaggctgaggcaagagaattgcttgaaccagggagtcggaggttgcagtgagccaagatcacgccactgcactccagcctgacaacagagcaagactctcaaaaaaaaaaaaaaaaaaaagatttgccatgttagttactgttttctacttgttgcccttttctttgttcctacttttgtcttttttggttataatcaagcattttataaaatgatttcattttctctcctttcttagcatatcagttatacttcttttttacttgttttaatgtttgccctagagtttgcaatattaatttaccactaacctaagtccacctttaaataaaagtatactgcttcacagatagtgagtagtttataacaaaataatctgaattccttcttcctgttccttgtattgttgctatcattcatttcatttatatataagcatcaacacacacacacacacacacacacacacacacacacacacacacatccgtacttgaatatattgttgccattattctttggacaaatggttatttgttagatcaattaagaataagaaaaataagagtttattcaaccttcatgtatttcttctttgatgctctttctttctttctgcagacctgaatttccgacttataccgttttccttcacatttttaatatttctttcaatatttcttgcagaacaggtcaactggcaataaattccctcaattttcatttgtatgaaaaatctttatttttttcttcacttttgaaagataatttcacaggagacagaattctagtttcatttttttcctctcaatagcttaaatatttcactttactctcttttttctttcatggtttctgaggaaaagtcagatataattcttatctttgcttttatataggtaaggtgtttatttcttctggctttgttggagattttaaaattcatatttgattttctgaggtttcaatatggtgtgcctaggtgttgttggttttgttttttgtttgtttgtttgttttgtttgtttgttttggcactatcctgcttggtgttctctgagtttcctggatctgcagtgtctgacattaatttaggagaaattatcagtcaatattgcttcaaatatatctttttgttatccttctagtattctattatgcatacattaaaccttttgtagttgccccacagctcttagatgttcttttctttctttgttttcccagacatttttctcttgctttttaagtttgaggtgaaaactcaaaattgccttgagatgacctcaagctcagagattttcctcagccatattcagtctactaatgagcctgtcaagagcatttttcatttctgttacagtgtttttttatctccagcattttttaattctttattaatattgccctctgtctgcttacatttcctatctgtccttgcatgctatctacttttcttagcctatgtaccatatttgtgttaaattcccagtgtgatcattccagcatctctgctgtatctatctggttctgatgcttgctctgtttcttcaaactatgctttttgctttttagtatgccttgtaattttatctttttttttgagacggagtcttgctctgtctcccaggcaaggcaggagtgcagtggcgcgatctaggctcactgcaacttccacctctcaagttcaagtgattctcctgcctcagcctccggagtagctgggactgcaggcatgagccactacgtccggctaatgtttttgtatttttagtagagatgggatttcagcatgttggccaggctggtctctaactcctgagctcaaatgatctgcctaccttggcatcccgaggtgctgggattacaggcatggccttgtaattttatcttgatagccagacttgatgtacagtgtaaagggaactatgataaatagacctttagtcatgtaggcgtaaggtgtgaaaggaaaggaagttccctgtaagtggtgggggactacttatctgtagtcctaagattaggtcttttggtgagcctgtgcccatggactgactgtgaactttagaagtgttagtgttttcttccctgccttagttggacagaacagctaaagtgggctgaagttgagtatttcccttcccccaggacaattaggttctgattaaaccccaggaggttaggggtccttagcacgtcctgagggcagaccttgctaagaagtacagaatgctttggtgtatttccaaatgattcatttttccccacccctaccaagagaatgagggaattgttgtccaatattcactgtgagaatcttgtcaagctcctggaggtaaaactcaaaagtgtcccacatcccattggccgtatcccctggagtttttgactcagagacttgtctacactaagcctccagcaatttgtcaattacagttcaagttttccttccccatgctggttcctgctgattggtttttcatttcattcatttttcagtttgttcagctttttacttgtttggatggagtgacgacttccaagctccttacatgcctgaccgatggtgccttgtcttttaatcctctaaacaatgtttctcagaaaggaaggagaaattcttaatttttttgaaatctaatttttccatttttttcttttatggatcaagcttttacatattgtatctaagacatttttgcctaactcaaggtcacaatgattttaatgtttcttctctcagagtactctttttaaagtgtaaatcagatcacatcactcccttgcttagaattctctaaggactttccctcacatttagaacaaaatctaaactcctaatccaggcctataaagtgctgcatgatcttgccttcggcttcttctttgacctcaaccccctgcccctttctccctcattcattctgctccagccacatttgttttcttgccgctccacataccctccttggagcctttgtacttgctgctacctctgcctggattactctcctctcagatcttcacatagctcactcctcagtccttaaataccaaccaccctcttggcaaagctcccttaacaagcctacctaaaataggacctctcttttacttgcagttctgttatccctttttatttttgtcatggcattgataactatctggaattacttcatttatttattgcattacttgaggttttttttttttttttgctaatttgtgctactaaaacatacattctttgagagaaaggcattttctgttttgttactttattccctgagccaagaacaaaatgtggcacagagcagatgcgcaataaatatatgttgaaaaaacgaattataccctactgaaaaccacacctcgcatactgagaaactcaaaatatgaatcttgggataagggtgagagtgagatttgaatggggtggggtttgttttgaagcagaagaagaaaggaagttttcagtgagactccctgaagagagaaagcctgctgagcaggggcccagccacttccaaagaatgggtgacctatgattccctgacctcaacagtgtccaagcacaggccttcagcagtggaagcccattgccttgtaccctctgagagtttctctcaagtccttgaggttgctttaattttaggcacactttgtgcttcgaatttcattgcttgcaacttaattattggcacaggcaaagtctttcaatccataattaaagagaaaaaggttttaattagtagtggcagaagaataggcatatagcttaatgtaaaaaatggagggtccacatacctcatgtttatggtcagttgattttgcaaggggataaaacaatttaatggggaaagaatactcttttcaacaaatagtgctgagataattcacaggcacaggaatgaaattggacccctatgtcaaaccattcacaaaaattaactcaaaatcaatcatagacctaaacgtaagagctaacagtttacaactcttagaagaatgcatagtggtaaatctttatgaccttgggtaaggcaatgctttctcacatatgacactaaagcaaaaatgtcaggaaaaaaaaatagataaattgaactcattaaaattaaaaacttttgtgcttcaaaggacaaatcaagacagtgaaaagacaacccacagaatgggagaaaatttttgcaaatcaactatccaataagaaacttgtattcaaaatagccgggcatggtggctcatgcctatgcctataatcccagaactttgggaggccgaggtgacagatcacctgaggtcaggagttctagaccagcctggccgacatggcaaaaccccatctctactaaaactacaaaaattagctgggtgtggtggcatgtgcctgtagacccagctactcgggaggctgaggcaagagaattgcttgaacccaggaggcggaggttgcagtgagccgagatcgtgccactgcactccagcctgggcgacagagagagactccatctcaaaacaaacaaacaaacaaaaacaaaaacaaaaaaacccaaaatataggaagaactcttacaactcaacaataaaaaaacctgtaactcaatttgaaaatgggcaaaggattcacagacatttctctaaacaaaatgtgcaaatggccaataagcatatgaaaagatgctaaaaattataagtcattagggagatgaaaataaaagtgaggtacccaccagaatggctgtaatcaaatagatggactataacacgtgtcagtgaggaggagaagaagttggaaccctcaaatgttgccggtgggaatataaaatggagcagctgctttggaaaaggttaaacatagagttagtatataacccagcaattccgtggctagcagttctaccccagagaaataaaaacacatgtccacacgaaaatttgtacatgaatgcttaaagcagcattattcataatagacaaaaattagaaacaactcaaatggtcatcaggtgatgaatgaataaacaaaatatgggatacctgtacaatggaatattttttgggcataaaaagtgaatgtagtagtaacacgtgctacaatgtggatgggtcttaaaaacattacatgaagtgaaagaagccagtcacaaaaggccatatatttatgattccatttatatgaaatcttcaagacaggcaatctatagagaaagtagattactggttgcctagggctgagcggggagtaatggggtcttgaggatgtggtagctaaagggtatggggttttctttctgcgggggacaaaaaagttctaaaattagattatgatggtagatgtataaccctgtgaacttactaaaaaccattgagttgtatactttatttatttattttaggagacagaatcttgctctgtcccctaggctggagtgcaatggcgtgatctcggctcactacaatctctgcctcccgggttcaagcgattctcatgcctcagccttctgagtatctgggattacaggcacgtgccaacatacctggctaatttttgtatttttagtagagctagggtttcactgtgttggccaggctggtcttgaactcctgacctcaagtgatccttccgcctcggcctcccaaagtgctgggattacatgtgtgagccacggcgcccaccatgacttgtatactttaaatgggtaaattgtgtagtatattaattacatcccaataagactgataaaaaaatataattagaaatactcattttactatcactttagtattatggtcctccatcatttgcttttcagcttctttgtgctacacgtgtagatgccaagctagagaaaacaaaatgctgcccttaagtaccttgactcacagttaagtgaagaagccattcacagaaatagatcaactgaaactcaaacaaagcactgcaggagcccaggaggcagaacaagttactatgcccaaggtgttagagaggactcttcagaggaggtgtgtttaaactaaaagatgatggacaagtagaagtttgctacacaatgaaagagaaatccagcctagtcaatgtggcaaaaccccatctctacaaaaagtacaaaatttacccagacatggtggtgcacacctgtagtcccagctacttgggaggctgaggtgggaggattacttgagcttgggaggtcgaggctgcagtgagtcaagatcataccactgcactccagcctgggtgacagagtgagaccctatctcaaaaaaaaagaaagaaaagaaaagaaaaaggaaaagaaagaagaaaaagaaaaagagagagagagagagagaaaggaaggaaggaagggaaaggaaaaggaaaaggaaagaaagaaagaggaaaaggaaaagaaagaagaaaaagaaggaaagaaggcagggggaattccaggttcagggaacagtgcatgtaaaggcacaaaaccacaggaaagcctggagagttcagacaatagtgaattaatttggcaaaaaggtgggttgactgggggagtggtgaggaattgggcaaaatgataggcaaaactaccctgaaggttcttgcatgccctgttgagaaatcccagcttttcccttagaggcaaaggggagccagtgaaagacaatcagcttctcaaaaggaaggtaactctgcaaacagtgcaggacagagctgagctaggagaaagcatgcttttttatgcctttttttttttttttttttttttgaggcagagtctcgctattttgcccaggctagagtgcagtggtgcaatcttggctcactgccaccttcgcctcccgggttcaagcgattctcctgcctcagcctcccgagtagctgagattacaggtgtgagccaccacactcggctaatttttgtatttttagtagagatagggtttcgccatgttggctgggctggcctcaagtgatccacctgcctaggccttccaaagtgctgggataacaggcgtgagccatgcgcctggcctgctactttttctactgtctttttctttctgcaaatccctcactcatgcagcactggcctttattacctttaattgtgcacattctggaagcagatgttacccatgcagatattttgtctaattcagccactcatgtgggaatacacaagatgacatgtgccagcacaggtacatatgcttactaaagatcaacatgaccaaactgcttgtttaaaaaaatcacttacagattaattaattaaggtattaatgtagtatctttgggggataaagtgaaaaaaagtggcccttggtggtctagcttaggcttgaacatagatttgctatgtgaccttggcaaagtcattgcatctttctagcttcaatctcatcatctgtaagattaaatggatggaaatgaaatcagcgattctggaacttacctaatgacaagcatctcctggagttcttgcccttactccagacccactggatcagtatttccgggggagggccactgggaattttatgtttaacaagtgctttctaaggtttctcccaggtgctgtaatcccagcattttgggaggctgaggtgggaggactgcttgaggccacaagttcaagaccagcctggggaacatagtgagaccctgtctctataaaaataaaataaaataaaattagccgagtgtggtggcacacacctgtagttccaactactcaagaatctgaagcaggaggatcacttgagcccaggaatttgaggctgccgtgatctatgatcaggccactgcattccagcctgggcaacagagtgagaccctgtctctaaaaattaaaaaaaaaaaagaagagttcctcccagctctgattccatctttcagtgatgctggcttacagcagggcagaagcctgactaaactgaagattccctagatgccgcagctggagtgccactgctgggatgtttgttggaggtggagggtgaaagtatgtataagggtggccatttatatactgaaagtgtgtgacagtgtcatggccccaagaagaagtgacaaagcaatgtctcctccacttctacctcgcctccctctgctaaccccagacatcccccttcagggaaatgggcactggagcatagaaggaaagacttccgaagtaatgaggaatgttttctaaatgatggtgttgtgctttgaagaaacagtgatgtcattcagtattcttcttccaaagagagaggctgttcttttggtatttcagttcatttagaatggtgtcactcattagggtctcccaaaggctccattcaaaatagcgtctttaagtacccacttgagtgccatgaagccattaaaataggcatcatttccactccatctaagctttccatcagggtggacaaacatgttgaagggcagacaaacagagatacacaacattgagagaaacataaacaaatggagaccctacccagcaaataaatacaatgttaaatattgacattctgagcagggattattacttgttcttaagttctgggttaagatggttggagccaggccagggtacatgattcactaccctgtgcaaacagattggattattcctccctctcctttcatcctgtctccaaatttggggttttaaaaatgcattcagtaaacatttattaaatttcttctattttctaagagttacataccaaggatacaaaaaataagacacatttctgccttctgggggcttggcaatgacaaaaattaggaaaatgcaagaacttttcattaagaaagtattagggacccttcctataagagacccaaatccaaataaacatgtaaatgtgtagattgccatctaaatcaacttggcctccaagttttacccaggattagttaaaagcccaagttagtttattccgtgggaattgccttaattgtcttattttaaattaattgaattcttttttatgggtcagatgagttcatctcattttgactggaagctgttttctcctctctctatttgtaggaagcagcaagcctaagtagatcagcactgtggcttgtatccatgtggatgtagatggctaatgtcaccctttcaggcatttttacatatgaaagattctggatacagttctgtcaggagagtccctgagtccatgttcaaattttctgacttaagagatcatctcttagcaacagctcagtcgctagtatattggttcctctgaagatctgttatgaaaatagttaatgagccagggcagataaagtggacctggaatcctcaaaacatttcccaaggacataacgacttccacaaaccaacattttcataccaccttttataccaatgtgctcacagcaagaagctgcctgctgaagattgggtatatttggtcaagggtataatataaatctcttccatatgttggctgaacatttatagggctatcacttggttttctgacacgtaacttggtttcatttgctgtcttaattctagatttgcttcataccaagtaataagttggatctcatgccagccttgtccaagggtcttccgtaacccttccaagatgggtaagatattcttctctgagctcccaaaataccctttgcatttcactatcactgctttcccctcatttttaaaatttttgttttgagacaggtctcactctcttgcccagctggaatgcagtagcgtgattatagttcactgcagcctcaacttcctgggctcaagcaatcctcccacctcagcctcctgagtagctgggactacaggcatgtgccaccatgccctgctaatttttgaatttttagtagagacagagtttcaccatgttgcttaggctgcttgctttattttctaatgttgaaatttggcagacgttttccctttgctacaggatgaagaatacttgtattaagagaataatttacacacacacacacagagagagagagagagagagagaaagactatgacatctagctggttacagttgaaacaatgattctgacactgaaaaggaattcaatatgcaactagcagacatttgaccctgaacaaacagtgtgtatgtgatatcaagtcaaaactggagaaggaagaatgaggcttatttcttgaaaggaggtggttctagtgagtaaaaataattcctcagggagtcccatgaaaatggcatgggtttcatccaaaaagtcaattatcaggaccagttaaagcagagtagaagaattatcagaccctctaacaggcctgcctgtgcacggttaaggtataatttaacacagagcaatgtatattttcttgttatagagtatgtagttgtctttgcttgctgattgtctgcatttctgttttagattaaaaaatcgagagcttcccttggctgcttctgagccagaggactgctgagcgggattgcggaagaaggtgagattctacccagggtgactgtctgtcctccaatccattattctcagactctgctgacctcagatctcgagtcatccttgccacttttactaataaatactaacaaaaacaagcagaccctgtgcatgtttccaggcaccgggtgacccagcctgtcccctgttccacttattcaatgctgctcagaaaccgcactggatttgctgcagagggcctcggctatgatgcagagaatatggtcttatttccttacatgattaatgccaaggcatggcttggtgaaaagaggattatgccagaccaatgttatttccttttgtgctaaaggggccgggtatatggtggtgggtggtggagggtggagggtggggtgagtgaatcagcccgtgtgaatacaaataaagcagttgattctgtgtcacacgatagtctaagcaaggagctgagatactggtaatactataagcttattgaaaactcctcaatagtaattatcagtggttccttatcaacccaaggacacccttagggattgttctttatcaccaatttagatgaaaatattaaaagtggtcactaaatttggagagggcactcatttgcagggagtggatgatatcaatttgatcgtttatttcaatatgactctgaaacatcagaaaatgtatccattaatagcaaaatttgcttttaatctcaacagagacaaatgcacattaaaagctttagaaattagaaatatagactcaaggtggcattaggctgaagagccataaatgcagaagaaagtgcttccagtcagagtggacaacaaacagaatgagttagcaatgtagtaatataattaaaacaattccttgtgactcaaggataaattaaagaaagtgtgctatgcaaagaaaagaaatcatctcttcatggtgtttagcattatgagcagttggagtttattttttatgatttcattttttaaaaagccaatattctagagaaatacaataacagtgatgatacggatgacaaatagaagaaagacaaaagtataataactcttcacatttgagatgttgctgaggccctgctttcagtgtctgttacctgagatagcatcattggatcttaaatgttattttgggggcttttggacaggatcaaattttacaactttggaactcagttttacagaataatgaaaaaataggtaagctgatcagctaaaattagctactaattatttgcaaagcactcctctatcaggttctcctcgtgcttgtcctacttttctttgtccctagctgaagacaaaaaaaaaaaaatgtagagaccgtttatctttttaaacaactgcagagtcacagcagcactttctggcctgaaattcaggcttcctttggtattgattctaaacaattactgctcttgactaaaatgctaagccgtaaataaggaaggtagtaaacctgaggttctccactaacatatctggcaattagatactcccaggattgctgggcttaggagcaaactcgggggaactgagctggcctgggtgagaggtgccttttctggcttctctggtgccctgtgcttccctcccccgtgccattcaggacactttcatattgtacttttctgcttgcaagattgtgttccagatcagtgcttcttaaacatcactgtgcattcaagtcacctggggcccttgttaaaatgcagttcctgagtcagcaggttcgaggtggggcctgatagtctaagtttctggtgtgtgcctgggagatgtcaaggctgtgagtctggtggcctgcacttgattgagcagtaaggccagctccttgaaagctggagggaaagtccctcgctctttttctcttttttttttttaaacttactattgaagtataacatatatgcagaaatgtgcacaaattatcaaagttcaatgtattttcaaaaagtaaacacatctgtgtaaccagcccttgtatcaaaaattagaatattggccaggcacggtggcttatgcctgtagtcccagcactttgggaggacgaggcgggcagatcacttgaggccaggagtttgagactagcctggcccacatggctctagaagtacaaaaattagctgggcatggaggtgcgcacctgtaattccagctacctggagactgaggcatgagaattgcttgaaccaggaggcggaggttgcagtgagccaggatcacaccactgcactccagcctgggtggaagagcgagactgtctcaaaaaaaaaaaaaaaaaaaaaaaattagaatattaccagcacccagagccctccttgtgcctcatccagtcacgacttttccccaaatgtaaatggaatctgacctccttcacttttgctgttaccagcaatactccaatgaacacacttgtgcatgtccctttaatcacgtgtgcattcatttctcaggtagatacctagacccattctgattttaatggtaagacgatactccacagaaacattagtgtcttgtatttatattaggacaatacaacttggtctttggatggcttttgtctatggtatcaaagactgatgaatgattggtaaatgctagtaatagcctccttaaattattttgcattttgtttttgtttttgagacagggtcttgctctgttgcccaggctggaatgcagtggtgggatcaaagctcactgtaacctcaaactgggctcaagcaatcctcccacctcagcctcccaagcggctaggaccacaggctgaagccaccacacctggctacattgtttgcttaagcagctaaaacagaataactgtgctcagtgcccctctgatgcctgaaatatgtttgttctttacacaaattctgaatttagaacctatgaccctagcatttttttttttttttttttgagacagaatctcactctgtcacccaggctagggtgtagtggtgcaatcttgtctcactgcaacctccacctcctgggttcaagccattctccctgcctcagtctcccaagtagctgggataataggcatgtgccaccacgcccaactaatatttgtatttttttagtagagacagggttttgccatgttggccaggctggtcttgaactcctaacttcaggtgatccacctgccttggcctcctaaagttctgggattacaggcatgagccactgcgcccagtcttgaccctaggatttgttgaaaagaaataggcctggagttttgaaggaatacccagtacactagcttgtaacttcacgagtattttctaaaaatagagtggacaaacatctgtctacattctatgggaaaatgcccctagtattaattaggtgtcataatttggcaaggattgggaattataaatcaggatagagtctaaataattttgatgacagaaatctggccctttttcagttgggtagctggtcagctattagaatggagttatgatgtaggtctttacaatccacaaaagacatatccacagctgtaggattgcacggccgaaggaagcaacttgtctagttaaaacatgatttatgctttgaaaaaccaatttacaaaagattcataatgcattcacagaatctaatttcatcatgatctataactgtagatatcacaatctccattgaaatctgctgtcatctaactctttgaggtaataattataaaaggatatgaatttaataagtgactacagttgatttttgtacgtgctgttatttattactttgccagctgcttttgagggatttgggtttttgtatgattgcttgtgtgttttttatcagtctctaattgttgtgattgaacaagagatggatgatactgtcctttttaactcaggaaaagtccctagagatatgacccaatctaaagtttctaaatataccttggcggaaccattgcaaattttgatgtccaagtgttcctaaatgaatacattagctgatagataatatattacatactatgtagaagacaagcagttggttccagaaatcagagtgatgggcatgcagattattaaatgatatacgtgaatgttaaggcatactaatttagcatcttcatgaaactggattagaattatgaaaagtttattttggtgtgcatgaaatcgctcaaagtgcttatgttaccaagtgcaaccagagttcatttattcattctaaaaggtccccagggtattataggtcaggtgccatggtaggcatttagggcatgggtaggaatgtgagtagttcctttcctggtatgatctgccccctacctggggagacagacacatcaacaaacatttgcattaggggaatgaacttttaagacattgtatcctatttgtatcaacaacaattaacccagaacctagcacagtaaatatggtttcaaataaagaaagcgtatcctctaatacgggaatccaagcaggtgacccaaaaggattgttcatcaacttagcctggaatggatggagtgggaagaccagaatctggaaaatctccaccgaggaaaatatatattgctggttgtcataggctaagtaatgccccctccatccccgcccccctgacaatgatgcctatgccctaatctccagaatatatgaatatatgtatgtattcatacacgaatatatgcatgtattcatacacgaatatatgcatgtattcatacacgaatatatgtatgtattcatacatgaatatatgtaagtggcaaaagagactttgcagatgtgatgaagttaggtgtcctgagatgggggattatccaggtgggcccagtgtaatcacaaaggcccatataagagggagggaggcaggcagggcagagtcagaaggaggcaatgggagacagaagtgagactggagtgatgccattgtgaggaaggggccacaagtcaaggaatgcaggcagtctctaggctggaaaaagcaaagggttaggtcctgcccttgagcctccagaaaggaaccagcctggctgatatctcaactacagactagtgaggctgattttggacttctgacctctatcattgtaagataataaatttgtattgttttatgccgctaagtttgtggtgatttgttagagctgcaatagaaaactaacatactggttcattgtcagtctctgcagtgtgtaattactggtgattcttcctttctttcccttttttcccttccttccctttcttcctttccatccctttcctcccttccttcccttctttccttccttccctttcttccttcctccttcccttccttccttgctttctattttttttctagagcacttgctaaaatcacacctgatgatttcaatatacacatagaggacccacccggctttcaggcctctcagttcctcgattttctttctttagagatctctgcttcagtcactcattactttggtcataacctagacttaatattaccaataatagcaaaccctccataaactcactctcagggattccactctgactaccactttctattttttcagctctccgtctctctggtaccctaattccagtaacccttcaatcccactggacgctccaatccactgatgctcccatctgttcactgtctctcacactctgatgtcctcatttccctcgtaactggatttaggtctcctgggcagtcattgtgaatgttcccttgcctacacgctgggctccctggctcctgtctcactttgacatatttccttgtcaaaatttccacccctgcctatatccaattgttgaactactccctgcctgcatttgcacagctgaatatggctgaagaaaaacacacaaccatgctgttggtcacaatttaaattcacaaccactaatctcaagtaccccaagtactacctggccatcctactatacttcgagtccactcttccaccctcctagctgaccacttcacaccttcccctctctcccaaactagcagcacatcctccctcttcttcactcccaccttgcttctgattccaccaaggaaacaggagcaatcctaaaaactcccacgtgattgctcctcccactgcttctgccacctacctgcctgcatctctgaccacataggatatttcattcccctcccatggtctgcctgtgttcctgtcacaggccaacatctccacttattctctttttccattctctctcccctgttcaagggctttgctcctagtatctttcccctcatccccagtgtcattattttccttctcactttttttggatcatccccaggttatagcaaaactccttgaaagtgttgtctgtctttgctttctctattttctgtctcattctctcttgaacttactctaatcaagctttctttcccaccatcttactgaaatagttattatcgagaagtccataataccaggttgctaaacccaatgctcaggcctcttctacctgattagtgagggtaatcatgccttctttcttagaacacttttttcgctttggtttctgagacactttctttcctttttttttttttttttctgaggcagggtatcactctgttgcccaggctgcagtgcagtagcacgatcacagttcactgcagcctggacctccagggctcaggcgattttcctacctcagcctgctgagtggccgggactacaggagcatgccaccatgcctggctaattttttgtatattttgtagagacggggtttcaccttgttgcccaggctggactagaactcctgggctcaagcgatcctccctcttcagccccacaaaatgctgggaatacaggtgtgaacctccgtgcccggcctctgtgagactttcttgattctccttctgtccagttgatgactcattcttttttttttttcttttttttgacacggagtttttcgctcttgttgcccaggctggagtgcactggcaacctcagctcactgcaacctccacctctcaggttcaagtgattcctctgcctcagcctcccaggtagctgggattacaggcatctgccatgacgcatggctaattttttgtatttagtagagacagggtttcaccatgttggtgaggctggcctcgaactcctgacctcaggtgatcacccacctcagcctcccaaagtgctgggattaaggcgtgagccaccacgcccggcctcattctttttccacttatcttcccaatctttaaatactcagagatcccaggggtcagtttttggcccactctagctatacccactccccagggaatctcgttgagaccccctgctttaagtatactggctatgtccatgtgctgatggctcccaaatttatatctctagccaggccacatctctattttgaactccagactttaacgttttgttgctgctccaatatctccacttggatttctaacaggcatatcaaaattaacaagtctgaagctgaactcctaatttctgtcacccaggctggagtgccgtggtgcaatccatagctcactgtaacctcaaactcctgggctcaagcaatccttctgcctcagcctcccaaagcacagggattacaggcatgagctaccatgcctggcctcaagcctctatcttgactcttacttacacaccacatctaattcatctgatcatcctatcagctgtaccttcacaatatgttcaggattcaacaacttgccatctctattgctacagctaatcattatctctctcctggattatttttttggcctcatgattggccttcttgtttctacaccacctcccttcccaacaagaagaggtaatttccatttatttaatatttattaaatgggccgggcgcggtggcttacgcctgtaatcccagcactttgggaggccgaggcgggcggatcacgaggtcaggagattgagaccatcctggctaacacggtgaaaccctgtctctactaaaaatacaaaaaatgagccgggcgtggtggcagctgcctgtagtcccagctactcgggaggctgaggcaggagaatggcgtgaacccaggaggtggagcttgcagtgagccgagatagcgccactgcactccggcctgggcaaaagagcgagactccatctcaaaaaaaaaaaagaaaaaaagaaaaaaagaaaaaaatatttattaaatgaatatttgctgtgtctgaaatgtgaaatctagtcaagtgtctgctccatctcccttgagtaaatgctgaaacttgcccagtggcccaaagcctgaaaatggtctggctttgggttcatttcctagctaacccctcctgttcactattctccagccataatggcctctttgctgtccctcaaatgtacctccaccttaggcactctgtatttggggctcgctctgcctagaatatgcatcccccaaatcttacggctctcactttctcacttcttccaggtgtctgctcaagtttcaaccaatcagtaagaccttcatgaaacagcactgccagcccccagccctgacactccctatcctcttgtcctcactttatttttcttcatggcacagatttatgctccaacaatattattgtatattttcttgtataaatacttgtgtataaatgactccctccactagaatgcagactcaacaagaggaggaatttggagttattttgttcagtgctgtaatctcaacattcagtagtttctggcacgtggtagatactcaacaagtatttgaatttgaagaatgaataagttgctagatagaatacaggacactcagttaaatttgaatttcaaataaatagcaattaattattttgtataagtatgtcctatggaatatttggacatgttatgctaaaatttttgtttatttgaaattcacatttaactgggtatcctatatttttatttactaaatctggtaaccttatgaatgaatgaatatttagtgaggttcctgaagaacgaatggaactctggacaaaggtttggaaaggacattttggcagaaaggctaaaattgacaaggtacacaagtgtgacagcaatattgttcattaagaaaagagtgatttagaaagggtagcctaccctcaactcttccagaattactttgctggagggtacatttaaagagggtctgtaggctgggagtagtggctcacgcctgtaatcctattcatcagcaaatcctatcagctgtaccttcacaatatgttcatgatctgaccactagccatctctcttgctacaactgtggtccaaactaattatcatctctttcccagattactttattgacttcaggactggtcttcttgtttctgcaccacctccactgggaggcagagggaggatcgcttgagcccaggagcttgagaacagtcctggcaacacagtgagaactcgtctccacaaaagattaaaaaaaaaaatagccgaggatggtggcacatgcctgtagtctcagcttcttggaaggctgaggcaaggagggtcacttgagcctgggaagttgaggctacaaggagccatgatcctgccactgcactccagtctgggtgatagagcaagattatgtctcaaaaataaataaattaaaaattaaaaaggtctgtgtcaaaaattggagagattttaagtcttgtctttgtagatgggtgatattaaaagtttataggacgtttaaacaggattttgcttctctgccataccattcatacagaaaaggacattcaaaatataaaaagaacattctcagggtgagagaagatatgtttttccttttgacctgggattatatgaagtcattcacaattaccatgttattaatactgctgatatttttaggcctaatttttctgggctaagtctccttccttataacagagaaacttatatgcttattagttcttttcatctgagaaagaagaatttgcctcatctgatggatgctatggtgtgggacccaaaggcccttttaagactgaggccctcattcacccagccgttggaaattgtggtggctgactgctcttgtttgaattattttctgtgacttgccgttaaccaaagatagccactttgcccaagtcacgctgtctccctggggtggcccacatcttagcacccagagctctctgtgacaccatctaaggcctctgtgatttcaatgcagttcatcttttccttctgttaaatccttcttttttcatctcctattgatgtcagtctgatgacacctcccattccccgccatgaatttactgtatactaacccgcatctcaaagtcggcttcttagggaatctgacctgcgataattcattccaggaatggtctgaggaagccaagtgtaaaatgggtcaccagcagtgagaacatcatccctgggggtaggtggagcatggacagtgcttagcatgctgtagccacgtgcttgttaaaactttcttggtagtaggccgggtgcagtggctgcacctgtaatcccagctacttgggaggctgaggcaggagaatcacttgaacccaggaggcagaggttgcagtgggccgagatcgcgccactgcactccagtctgggtgacagagggagactaaaactttcatggtcgtaaactgggatgagatgttggtggaaggcagtgcaggggcctcaggcatttgagaagttcaagggaagtcataactataagaactatggaaatggctggctgttactgttgacattttatgtattgaagaagaacaatgaaaggctgagagtgattaatcaacaatcagaaaggccgaagctctccttggcttcataataaagagactcttattctgcagttggaacacagaaaaaaaaaaaaaactgaggatcaggcccaagtcttaaatataaaagaaggggagtcccagaagagattgaactcaggttatccacctctattgcactggttcctctctgtcagctcatgcctatggaccgtagagggtccctatggcaagctgacagaagagggaaaaggccatgccaggaccacagcttggtgtgtggatgcaacatgaaaatggtctttggctgcactacagcttcattgtagccctgcagtgtgagagcctggaagacgatggcaaaggaaatcctaccaactggcagatttctgggcagtgcacctagtcaaatacttttttttttttttttttctgtagagatggggtttcactattttgaccaggctggtcttgaactcctggcctcaagcaatcctcctgtgttggcccccaaaaagtgctgagaatatagacgtgagccactgtgcctggcctggtcaaatatttttggtggttagcttggctggcttgttaagagcagggcagaaagactggaagattggtggaaagacatttaaagaagaggtgtgtcgatggacctatggccatggcccaaagtgtgaagattttgaatcccattgttaatgcccataagtgagcatcccccatggaagaagcactgaagaactaagtagacaggatgacttaactggtcatctactaaaggatgaccagccagaccctgtcacgctctagtgctggcacaatgggcacatgaaccaagcagccctgatggcaaggatggaggctgtacatgggctcacagcagggactcccactcagcaaggctgatcctgctactgcaactgcccaatgtccaacctgccagcaacacaaactaaccctgtgtaccagccgaccaattaaccatttggtattaattacattggatcctttctacactggaaggggcagtagttaatctcgataaaaatggatacatatggatgtaggtttgcttttcctacccacagtgtgtcagccagcaccaccttctgaataattacagtttttatccagaaatatggaatgccgtgtgacattctattaattcaaggagcccactttacagcaaaggagagtaaaagtagacacgtggtggggagatcaactggttctaccacccagaccctgccagcctgctgaggggataaaatggtctttgtaagggagccacagaagcttacgcttggagatgccaacctaagaagttggggcatcattttccagattgcaggacatgtcctaaatcagctaccactctatggtgttgcatccccattgggaagaatacttgggtctaggaaacagggtgaaaatagaagtggctgtgcttatcatcactgtcagtgactattaggaatgtgtgatttctgtccttgcagctttgtactctgtgggtttacaggttttatattctaaaggaaaacacactaggggacacagcagtagtcccattaacttaatttttttttgagacaaagtttccctcttttgcccaggatggagtgcagtggtacaatctgggctcactgcaacctctacctcccaagttcaagcgattctcctgcctcagcctcccaggtagctgggattacaggtgcgcaccaccatgcccagctaattttttgtgtttttagttgagatggggtttcaccaagttggccaggctggtctcgagctcctaacctcaagtgatctgcctgcctcggcctcccaaagtgctgagataacaagcgtgacccactgcgcccggccagtcccattaaattttatagctactgcctaattactttaggtttcttgttataagagacaagaaaaaaggagtcaccattctgggaatgtgtcatattggggattcagcaggggtcattgactctgatcactaagaggaagtaaaactgctgatatacaatagtgccaggaaaggtatataatatttggcacccgggacatctccaggagaatctccttgtactccctttaccaattttgatggcaaattgccaagtgccatggttgcagcctgagaaggacgtgacaaccagggtctcagacccatcaaagatgagggtctaggtcaccccagcagctaagccaccgaaaccaacagagatgatagccaagggtgaagggactctagaacgggtagaagagtgagataatcagctggcctctcaggatccattgctgtagtgacagagctgtggtttttcctgccaatcctctccttaaatttcccagaaaaagaaccagtcagaatcttggaggaactatttgcaaagactaatttacaaaaaaaaaaaaaaatccaagcagcggaaaagggtggactgtagttaatactatgcactgcccagaacttccctgcaggactgagataccatttccccagctgtcggaagtgttggccgaagggctttcagctgagtcactctccaggaaatgttctcagtccctcgcccaaggacattccctgcctggggtcagtctccagccactgactgagggaggcagtataaaggcccatccccctttgcaccaaggtgggacaagatgggctatccagagctcccctctgactgcagcctggctttgttccagctgctccccagttcagctcttccctcttttcaatcctatctccttccatgcccattagtgctgactcataagacacaccccagtaaacctccagcaggcaaatctgtctcagagtctgtctcaggggacctgacctaagaaaacgttatcaatttactgtaatttataagttaaataatgtaagacacaacataaggaaagagtcatctgataattcacaaaggaaattgcagaggaactggatgaatagtgctattagataataagagtgttgttgggttaatctttacagatagaggaagattccctgttgagactgtgtccagaggcgaatcagaatgacggataaatgaaatagaaggtttgggcaaagagaataatatcaggcaatgttctgtgagaggcaacttatcagacacatcttgtacggcatcttccatccgctcagctcacctttttactctagccattgatgtggctggtgtcagtggggacaggtggggctagcttacagcagtatcctaatcactaagaacttcaccagcaatgaagtgcaggtgaggccggcagcagcttacctcagctgtatcacatttttctccactgatctcacttcctgccctattggctggctataggaactgttcagccactgtcacacagtggctgtgcaaacctggcagggagtttcatttcctggggcaacgcttgaccagtgggagatggtcacaatttacatgaccatagagcgttcccagagggatggagccccagttgcacatgataatggccagcttaatagcaggcccttggattgctttctctcctgttttactcttctactccctcattcctattcttctggatcacttcccaaaataaattacttgcatacaaacccttatcatggaatcttttttttttttttttgagatggagtcctgctctgtcgcccaggctggagtgcagtggcacaatctcagctcactgcaacctccacctcctgggttcaagtgattcttttgcctcagcctcccgagtagctgggattacaggcacacaccaccatgcctggctaatttttgtgtatttttagtaaagacagggtttcgccctgttggccaggctggtctcgaacacctgacctcaggtgatccacccgcctcggcctcccaaagtgctaggattacaggtgtgagccaccgcacccagccatggaatctacttgttaaggaaactcaggctaagacagttgtaccgaagtgaccctaaaaaggaaactttcagggtcctttaacagtccttatcacagataagaacccgtgactggtgttaagtggttaattactaccggtttacagcagcatcctaatccctaagaattcacccagtgatggacgaaggtgagacgccggtgaatgctgaagcgttgtattatgtcatagtaatggtccttgaacagcctggtaacaatgtgtattatatgaatgtggagttggctgggtcttgttaacagaattagaaaccttgaaaaagaaaatgataggctcaggttagtcaactatcaactcaaggcatgctgtcttaagacatgccttcatggaggcattttaaagggctcttgtcttctgtaactggggcccaggacagcagtgctacaacggataatgattgcacaactttgatgggtctcccagggttacactctgggacatagaaagggggcattggagtggatgaaccagagaatcttgaggccccgggccctcctgaactgtcgaggttagcagaagtagctcactatctcacactggcggagaggagcctctcctctccaaaagacccttcaaaaacctcgcctgaggctgttgcctcacaaaatggtgagtgtcctttttaggacccatgcctggctcccttcattgcctcaagagctggctaatatgaaccggcaggaaatgagaaggtgtacagacaggtggatcttgagggaggtgggctagagagggtagcatctaaggctgggtaggtgagagttcattgatataagagcatcctcctacgatgaggagtttcacatactagcaaggacatctgagccagtcccaggatgtgctgggattgctccctaaaaattgaacatgatggtgacctgcagtaaggccagaggtactccagctgtcttgcggagttctgaggaagaggttagaaagcttggggagatggaaatataggaatggatttattatgtgatacagagaacctgttccctaagcatgtggtctaaggaatatcccttccatggaagcaataaggatgagctgctgagaggggtgcacacatctttgagaagcccagttttggctatcctccatagggcagaggtaactgtaagactctagtagtatcagtgatggtgacaattccagaatagcacggtccaggtggtagcacttaacaaaaggcaaggtggatgtaacagaaacaggcagcaaggttgaaatctcagccaggtgtctcctctcaaaaggttttgtggcaatggctaacaaatagaccatagtgatcctggagggacaaggtaggtaggcaaatgactaagaagttacttcacttatataacaagaaaaacttgagagcttggtgaacctacatcaattgcagaagtggaaaatcatgacccctcaggtctgaatcagttctcactcccagaggccatcaattgaaggagagtctgggtccctttgagaaaggactctataatgacactacaggaatagacattatttctcttattccttccctaaatggacctgtggtcatgtaccaaaaaaaggatacagaggagaaaagggaatgctcagccttttgagagccattggatagagggcactcaaaacaccattatgatcccccagttatagtggaagcttatggaaacaaggcaataaatgaaatcctggctcaagtctgacagtggtccagtaagtctccagccccctcctgtggttattaccctggttcccaactgtgtaattaggatgcaaattaacagcaggtagaatcttacattaaatacctgacctatggagtaagagctattatagagggaagagccaagtgaaggtgcctgaaactgctctcctccaggcaacatagtaaaccaaggcaatactgtatcccagaaggaactgcagaggtaggcaaagggatgcgagggtagtggcctccaccaaatctctattcaattcacctgcatgcctctagtgagcaccaggtggattaaggtaggtggagatgggggcacccagttgcagctgttttttccagatgctgcatctttactagaatagattaacagaccctggcacttggaatgcaactgttgatggagtgaatgtgttctttctcatcaccatcagtaaagaaaattttaaaaccaacttctttttacaaggcagccggacatagtcactaccttggcaccgttttgctgtgtcaactcttgtttctgttactacgtagcccacagggaacttgaccatctcaatcatctgtggaagcagaacatgatgccgatttattgaattaatgacatcaggcccattttgactcagcaggaattggtgagaactttggatgccctagtaaatacaattgtgtcaaagggtggaagatatacaccacaagcattcatggatggaagtagatttatattagtccattctcacagagctataaagaactatctgagactgggtaatttttaaagaaaaggtttaattggctcacagttcctcaggctgtacaggaggcatggctggggaggcctcaggaaacttacaatcatggtggaaggcaaaggggaggaggcacgtcttacatggctggagaagtaggaagagagagcagcgggaggtgccacacacttttaaacaaccagataccataagaactcactcactatcatatgaacagcaaggggaaaatccgcccccatgatccagtcacctcccaccatgcccctcttccaacactggggattacaattcaacacgtggtttgggcagggtcacaaagccaatctacattaagatgtaattgcagacaagctctggggatttatagcaatcttccatggaacttacaaagctactagtgatagtaggtctgtatattattgtaattcacccataatagacaataaaaagaaaggaaaagtttcgggattgggggcacatagtttacaataaccttttgtgtctaccgtctcctgatttttaggtatgatcatattgctgctgcaacttaggaactaatgagagaaaggcatcagaaagaaccttacaaacacggatttgttgttgttttgtgcataattttctagggggaatcttgtcttcttattgttgctgccaggaagcccaaacgacatgatttccttagaagcagacaatagtccctgttatgttgggaggaacaaggtaataaaaaagatgtgaaaaactacaggagtgtgcaattaggtgtggacgctggcatcatatggtggaagagaatgcaagagtcagcacagaggtggcgggttccaggcaagcagttatgcatgagggagggtgagaagtgaaaagcagcccaaagtagggcaatgcagaatggaccgagaaccagtgattgtggatgagataaaaggcacggaggccgagcgcagtggctcacgcctgtaatcccagagcttttggaggccaaggtgggcagatcacctgaggtcaggagtttgaaaccaccctggccaacatggtgaaaccctcgtctctacaaaaatacaaaaattagcctggcatgatggcaggtgcctgaaatctcagctacttgggaggctaaggcaggaaaatcacttgaacccaggaggcggaggttgcagtgagccgagatcatgccactgcactccagcctgggcaacaagagcaaaactcagtctcaaaaaaaaaaaaaaaaaaaaaaaaaggcatgggaaagtgagagaagcagagttgtgaaaagctgaaatgagagaatagaaaaaaaaaatcaatatgagtctgtgacattttataaggaggacagcaatgctgagtgacatcaatctttaaaaggctgttctacctggaaacaattatgaatatttgtcccagttataaaatcaattgtttccagaaaagaaaatcacaaattatcctaaaaatttgttttcaaaagtaacttttataacttcttgttagaaaaattatgctgatctattttagagagttcataaaattagcaaaaagaaaaaaacactataattctaccacttagagatgaataattaccattaatatcttgatgtttatcatctaaaggttttgtgtgtgtattctattttgataaaaataggatcctgttgtgtaacacaatttcttttttaaaatgcactattttcatctgtgagaaatcacattcagtttctaaaaagaactgaatagatgatagaaaatcttttctgggattgccttttatttgaattttcaacatccaacttttttcttctggaatgtgctatatatcactctaccataaagccaggaccagatcaggcctggtctgtcctttttttccctgtacagaactccacagcctccctcatgtgacattatcagtagcttgctgcagctgacccacatatttaatttatttttatgggcctttttctggaacaataaaaaaaaattctgggatatcttccaggataaatggaaaggaagtgctgtcaatcttggagaacagcagtgcagatcactgccctgacctccccatgactcaactgcctgtgttttcactttggtcctctttaaggctgcaaggactaattgaatagaggtcgatgaggcaaggtaataagtgaggtgtatataatgactcaaaggcatcttgcctcctcattttgggcaagttacttaagttctctgagccttggtttccttccatcagctaatgggaataatatctatgccatgaaatagtggcaagaactgaatgagactgtatggatattggatgatgtttctgcagtatgtgcaggaacaacaagccactcattcttcagacttgtgcactaaaagtaagaggatttatggaaaaaacaggtttgaagcagttcattcaaggcctatgcagctttgtaaccaaagcagtgacagtaacaatatccatcctaataaaatgcaccatagttaagcttctaaaaagaagaaatactatcaagtaaatttataagattgcctttgcctttaagaaaaggcaatggttacttgatggaagaggctgtgaatgagggttgatgctgccaagttacagagatgagggcaaaatgcagtgagacccagtgagtacctccaagatagagccaagaaagtggggtgaatgggcaccatgttaagtactggattacttcatggtttctttttttaaaagcttattagggtacattagctgcaaaatagtaacgtgtgcatagggctgcaattttttttttttttttcagatacagtctcactctgtcacccagagtggagtggagtggcgccatcaaggttcactgcagccttggcctcctgggctcaagcaatcctcctgcctcagcctccaaagtagctgggattacagatgtgtgccaccacacccagctaatttttgtgtatttttgcagagatgcgcgttcaccatattgctcaggctggtctcaaactcctgggcttaagtaatcccccagccttggcctcccaaagtgctgggattacaggcatgggccactgcacacaacttagagctgcaaaatattaacatgctggggaaaatcacgtatgaaagcaatcttgattttggtgatatctctggatttatcatttatgtgtggactaatttccaagatagatatagatggtgcagcagaacagaccgtccctagtacaggggctggttcatagtaagtgctccttaaatgattgtgaagtcatcttcattattctttcttttcttttttttaagacaggatctcacctcggccacccaagctggagtgcagtggcgcagtcatggctcactgtagcctccaactcctgggctcaagcagtcttcctgtcttggcttcccaaagtgctgggattaaaggcatgagccatcacaccccaactgtcttcattattctcatcatacttatcatcaaaattatcatgatatatgttaatccccactagtcaggaattcagaatagagaagtaagttactacacagaaccagcatacaatgagacataaggaaacccattctaaagcaagattctgaccctagccagaggcattacgtatgtttctgttaaaacaagaactcattctaggatgtcaccagttttgagtcccagtagaaagtgacaggtgaaagtagattcagatggtttgggggaatctccatattgagatttggaatttagcattttgtaagtaatctacttatggcaaaatggtgtgggtggacttatttagtgtccaaaatggagaatggaactggatttctctgattttatttttaccacttatctgcttaaatggaattatgagtgaagggaaaccaggtttaatctctctattctacgcagtttcagatttaacatttattgcaaaaggacatggaaaaacagagagctcatgttttatcaagatctgacctttacatatgagctactaatgttttcttatttttgcaacatccttttgtcctgcttgattgtttgacagaaatttgaggaaagaggcaataatgattttttttttttctgagatggagtctcgctctgatgccaggctggagtgcagtggaacaatctcagctcattgcaacctctgcctcctgggttcaagtgattctcctgcctcagcctccggagtagttgggactacaggcctgcaccaccacgcccagctaatttttctatttttagtagagatgaggtttcaccatgttggccaggatggtctcaatctcttgacttcatgatctgcccacctcggcttcccaaagtgcagggattacaggcgtgaaccaccgtgcccagccaataatgattttaagaattgacaaactgcaggccgggcgcggtggctcacacctgtaatcccagcactttaggaggctgaggcaggcagatcacggggtcaggagatcgagaccatcctggctaacaagatgaaaccccatctctactaaaaatacaaaaaattatccgggcatggtggcgggcacctgtagtcccagctactcgagaggctgaggcaggagaatggcgtgaacccgggaggcggagcttgcactgagcagagatcgcgccgttgcactccagcctgggcgacagagtgagactccgtctcaaaaaaaacaaaataataataataattgaaaaactgcaaggcaggcggatcacttgagctcaggagttggagaccacactggacaacatggcaaaccctgtctctaccaaaaatacacacacacacacacacacacacacacacacacacacacaaagttagctgggcatggtagtatgtgcctatagtcccagctacttgggaggctgagatgggaggattgcttgagcctgggaggcagaagttgcagtgagccgagatcatgccactgcactccagcctgggcaacacggtgagaccctgtctcaaaaaaaaaaaaaaattgaaaaactgagtcttaaatatagaggcaagtaagaaaaaataaagaaaaaaaagaattgaaaaacaattattttgcataggttgagcatggtggctcatgcctgtaatcccaccagtttgggaggccaaggtgggcggatcacttgaggttaggagttcgagaccagccgtgaccaacatggtgaaaccccatctctactaaaatatatatattgtgtatgtatatatatatacacaaaaattatccaggtgtggtggtgggtgcctctaatcccagatactcaggaggctgaggcaggagaatctcttgaacctgggaggcagaggttgaagtgagccgagatcacgccactgcactccagccagggggacagagcgagactccatctagaagaaagagaagaggagaggggaggagaggaaggaaaagaaagattactttgtacagaatcttcttcaaatgttgatgaaagaaagaagaaagaaaaagaattactttgtacagaatcttcttcaaatgttgataagagcttcagtctcagaatctacatagtgccacaatagctcaactctcctttgcttgtcataagccctagtcagtctcaggctgtcttggggagctacagtagcccaactggcagaagcaaatgtaaagttgaaaaggcaaaacctagaatggtgcttattttcataaaactgtccacaaatggtgtaacacaacaatgttacgaatttagacattcaaggatcaggaaattccagagttaaggttcttatattgattcagctatatagcacatttaatagggtttataatatgccctaaaaataaaagccataatggactatgatttttcttaaagggaaaatgggaagaccagtttatggctggagagatcaaataaatagcgctatgaaaacctctggaggctgagcacggtggctctcgcctgtaatgccagcactttgggaggccaagatgggtggatcatttgagctcaggagctgagaccagcctggccaacatggtgaaaccccgtctctactaaaaataccaaaattaggtgggcatgggtggtgtgtgcctgtaatcccagctactcaggaggctgaggcaggagaatctcttgaacccaggaggcagtggttgccgggagctgagatcgtaccactgcactccagcctgggctacagaacaagactccaactcaaaaaaatacgaaaagctttggaaactgatgctttgattatgtatgttcttagcttgtaggcttcattattatatatttttctggggttaagtagaaggcacattttcaaaaaaagtaattgtttgctaaagtagaattcttaaatgattttttttttcgcatcaggaagctgtaagtccaagttcttgcaaaaaaccataaatgttctattttgtgtttttttcttaaatacattatttaaatcttcatggctttagattggcttgatttttttcccttcctcctttgggagtacattgctaccaagtttaaagtttgtaacaatcatgtttgaatgacataaatgcaaaaaagtctcaaccgtctgtctgcaataggaaaaattatatttctttcaccattgttttactacagactcatgaagttatttttataaaactaacttttttttcccatgagggagaaagttcagtgcaaatgtatagagctaaaacctaaactaaatttttctaggaaattccttagtaaatgagtgactatggtatggtcttaaatattactatttttgagtttttttggttttgattttcactgacttagtgatttgggcaaggcaaatgatctttctaaacttccttttctcaaagtaaaattgactatagtttatgtaataggctgcagtagctactgttatttatctcctctgcaagacttcccaacacttttcttccattaacatttctggcccttggagttcttccctgggatttcttgatttggagcctggagaggaatagccttgcctcagaggtcaagtcctagagggatatgaaggtatgtatgcgtgcaggttgcagggtagaggaggtggccaacttcaccatgtgcagaagtctatctgcagtgaaagaggataaaaacgagcagagacagagaaatggcaatacatgggctgagggtgggtgggagacggagccattgtgagcattcatgagcaaacatgaagtgaaacatttctctttccagtcccagaagcccaggtcctgtaggtcctgatcaatcccttgatcctatgagctactccattatcctgagcctcacgaactaggatattcccttttacactcaatctaattttatagttagatttctgatatctgcaacccaattctgtcgtgtggcgtctttctctttttttctgagagagtcttgttctgtcgcccaggccggagtgcagtggtgcgatctcagctcactgccacctctgcctcctggttcaactgattctcctgcttcagcttcccaagtagctggtgttacaggtgcctgccaccacgcctggctaatttagtatttttagtggagatggggtttcaacatgttggccaggctggtctcaaacttccaacctcaggtgatccgcctgcctcaagcctcccaaagtgctaggagtacaggcatgagccactgcacccggctacgtggagtgttacatagggcaatgtttctcaaactttagcatgcatcagaatcactgagggtttgcattgtgtgggaagttagatttttaggtttccttctagtactaataatttatgattattttaaatgtcttctatgtaggagcaagaaaacaaaggaacactcaatctgttctttcaaacagcagggaaacacaaaaaccaaaatgcgttcctgccacaaatgaagacttgttcagtaaagcaaatttcataactcacttccatattgattttgggaaaaatttgttgccattgtttatgaaattctgtagtataacagcaaacattaattgggcacctatttaacattgctaataaagcgcatatgttgtccttactcaccaagcccaatataacagctcttcaaattacatatgtagatgactattgccagaatttattttataatatatcgaaaatgctaacttgaagagacaatgttaccaggtccagaggttcagctctgttactattacctaaatctagtggttaatccagtagaaatatcatataggaaaaaaaatcctgttttcttttcaactttttgtgaaaaaaaaaacaaaaacaaatagtgttgaacaaatttaataatgaaaataatatagctttactgggtattgttacattttcatagtggtataacaatgttcaaggattacatctttatttccagcatatggcactgcctattttttagtaatatacccaggctcatgtgcagctggtagaaccaggacagacacaccagttgttgggcagtgcccatgatatactgttattaaataagttgaaatacctctgaatataccatttcttagaatttttttttttaagacagggtctcactccagccccctgggatggggtgcagtggggccttcatagcttacttcagcctcgaagatatcctccctcctcaacctcccacgtagctgggagtacagttgcatgccaccacatccggttagcttttaaaatttttttggagaaccaggatctcgctatgttgcccaggttagtctcaaactcctggcctcaaatgattcccacactcggctcccaaagttctaggattataggcatgagccaccacacctggccccagaaattattcttaaaggcagaagcctcagtagtagttttttggttaaaaaatgaaacacagcaggttattttagttgtgttttgagacttaaaaagtttaaccaagtatattagtttgaagatacttttaaaaaagaaaccaatgaaaatgaaaaatacactagtattgcatgtttttgaaattacacacacacacacacacacacagacagatctgccacttaactaatcttctcactttgacaaaatcacaagattccctaagctcccaaaagctcagttgtcttgtctataaaatgcaaagattggactggatgttccctgtattctttttaaagctaacattctacagtcttatgggggaggggtagcacgatgattcattaagttttctttaaacacatttaggtttattgtagtttctagaatccaagagttaattctattcatgcctttatttagaaaatagagacactgaaaatgagcagcatatgactaaacttcatggagaatgattacatcataaaaggagaaaacttgaaaccctagagctctgcagaaatatgtgtcagaattgtgtgcttgtcagagaagtgtttggaggaagattggtacaacctattattcacggagttcttcctgctcttcccaaagcagcatatctctgtgatttctcagtgaatttcacaatatgctctgtggtagctacattattaactcttttatatattgggaaattgaaataaatgaagaaaagaatttgtccaggtttatgcaatgggtaagtataaaaatcacttctaaaaaccggaaatttagggggagacttatgtgaagatactaaagaattgatttaaagtgtagaaagtcaatgtcagcagtttccttttctatgaacatgacattaaataactttgaaggttataattatggatgaatattatatcatcactctttataaaagagaccaaagtactaaaatgtcaactcactttcagctgcttttgaaaatcaaaaaacaaactcaaaaacacaaatgaaattagctatggttaagtataaatcagcacaatttgtgtgagcacagttaaaatgacagatggactgtgtgcccctaaatgcaagatatagaagattttgtgcaaaacaaagtctacatatgttaagtctgagtttcctggtttgaaaaggattaatcaacctcaatagaagaaaagctaaagaaaacaagcagtttatctttggagaaaacagaaaatgctaaaatttctcttgatgatagcataatgctacatgacagtcagattttgcaacagccagttctcacatattcagctaataatttaaaacagtctttaccactttgttgagcctgaaggcataattcacagcagaccaaaaaaatacacccttcagcaacttttggctcaccatctagagagtctgctgtttgatatagttaataaaacactgaagcttcatattgcttctctactgagcagaaatatttcaagaatgcatgagagaaaataaataagaatatgattctagtagaggaattgaaataaatgtgaagattgaggaatatcaaagtaaaaaaaaaaaaaaaattgggccaggcacagtggctcatgcctgtaatcccagcgctttgggaggctgaggtgggcagatcacctgaggtcaggagttcgttcaagagcagcctggccaaaatggtgaagccccatctctacaaaaatacaaaaattagccaggcatgatggtgggtgcctgtaatcccagctacttgggaggctgaggtgggagaatcgcttgaacccaggaggtggaggttgcagtgagccgagatcatgccattgcactccagcctgggtgacagagcaggactccatctcaaaaaaaaaaattggactagtttcacatactaaatagtttcagtgactgggaatttataggttggcatcaatttggaagatcacacatccattaatctataatataactgagtttttaagtatcttaaagtacacttgcacataccatactgtcatgctgaaaaatagattcatgcaataattgtggctatagcaactgcttcaataaacccaagagtttgggcatgatgaaaaaggctgaaggaaaggaagaggagctggagtggtggaaggagattcagcagactgtgtctgtagcatattgcatggtcagtaaaattgaacctagataggagctctgtaggcttcattctatactctgtatcatttatctagtatcttcatatggctgtatgtctgcccaaagaatacacaggcatacctcattttattgcactttattgtgcttcacagtgcatttttcacaaattgaaggtttgtggcaaccctgttgtgatggttaatattgagtgtcaacttgtttggattgaaggatacaaagaatggttcctgggtgtgtttgtgagggtgttgccaaaggagataaacatttgagtcagtggactgggagaggcagacccaccctcaatctgggtgggccccatcgaatcagctgccggtgcaggtagaataaagcaggcagaagaaggtggaatgagcagacttgctgaggcttccggccttcatctttctcccatgctggatgcttcctgccctcaaacatcacactccaagtccttcagcttttggactcttgaacctacatcagtggtttgccaggggctctctggccttcagccacagactggaggctgcatccctacttttgaggttttgggactcagactggctttcttgctcctcagcttgccaatggcctatgtgggactttaccttgtgattttgtgagtcaataccccttaataaactccccttcatatatacgtctgtcctattagttctgtccctttagagaaacttgcacctgtataaaccaagtctatcggtgccatttttccaacagtacatgctcactgcatgtctccatgtcatagtttggtattcctcacaatatgtccaactttaaaataatcattattatatctattatggtgatatgtaatcagtgatcattcatgttactatggtaattgttttggggagctatgaactgaacccatataagacactaacttagataaatgctgtatgtgttctgactgctccatggacaggcccttccctcatccctctgcttctccttgggcctccaattccccatgaaattatattgaaattaagccaattaataaccctataatggcctctaagtgttcaggtgaaagtaagagtcacacatctctcactttaaatcaaaagctagaaatgattacacttacaggggaaaggaggatgaaaggcaagataggccaaaaacaaggcctttttgttttttttaaatggggtctcactctgtcacccaggcaggagtgcagtggcacaatcatagctcgctgcagcctcaaactcctggaatcaagtgatcctgccacctcagcctcctgagtggctgggacaggcacatgccaccatgcccaattaattaaaaaatttttttcatccatattctgcttatgctatggcgcttgtgctatggcacctggctaattttctgtattcttgatgctctggcatctggggtcttgtggactccaggaactgcccctccaaggattaactaatttctaaagataaggaacttgcctgccagcatgcctttaatatgcaaaccaaccaattccaagaccatattgcccacttgtcaccttttatcagacttctaaaattttttttttttgtggagatggggtctcgctatattccccgggctggtctcaatctcctagcctcaagcgatcctcctgcctctgcctcccaaaggactacaggcatatgtcaccccacctggccaacaaggcctcttgcattaacaggagagttgtgagtgcaaaggaaaagttcttgaaataaactaaaagtgctacttcataaacatatgaatgactaaaaaaaagagaaataactttttattactgatatggagaaagttttggtggtctggatagaagatcaaaccagccactacattcccttaagccaaagcataatccagagcaaggccctaaatctctgcaattctaagaagactgagagaggtaagaaagatacaaaagaaaagtttgaagctggcagaagttggttcagaggcttaaggaaagaagttgtcttaataacataaaagtgcaaggtgaaacagcaagtgatccagaagttctagctaagatgattgatgaaggtggctacactacacaacagatcttctgtgtagatgaaacagccttctattggaagaagatgccatctagaattgtcatagctagaagtaagtcaatatagtccaggtgcagtggctcacacctataatcccagcactttgggaggccaaagtggctggatcacttgaggtcagaagtttgacaccagcctggccaacatggtgagaccccgtctctactaaaatacaaatattagccaggtgtggtaatgcatgcctgtagtcccagttacttgggggactgaggcaggagaatcacttgaacccaggaggcagaggttgcagtgagccaagattacgccactgcactgcagcctggttgacagaatgaggctctgtctcaaaaaaaaaaaaaaagaaagaagtcaataataagtcaatgcctggctttaaagcttcaaaggacaggcttactctcttgttaagggctaatgtagctggtgactttaagttgaagccaaagcttatttaccattctaaaaatcctagggtcctttagaattatgctaatgaagttcaggatttcatgtcattaaaaaaagaatgatgctgaatctactctccttgtgcgctataaatggaaaaataaaatctggatgagagcacatctgtttacagcatggttaactgaataatttaagtccattgttgagaactactactcaggaaaaaagatttcttttaaaatattattgctcactgacaatgcacctagttaatccaagcattctgatggagatgtacaaggagataaatgttgttttcatgccagctaacagaacatccattctatagaagtaatttcaactttaaagtcttattatttaagaaatacattttgcaaggctgttgctgccatagatagcaattcctgtgatggatctgggcaaagtaaattaaaaatcttctagaaaggattcaccattctagataccagtgagaacattcatgattctcatcatgggaggagtttaacaggagtttggaagaaattcattccattatgtatgactttgaggggttccagacttcagtggaggaagtcactgcagatatggtggaaatagcaagagaactagaattagcagtggagcctgaagatgtgactgtattgctgcaatctcattataaaacttgaatggatgaggagttgcttcttacctgatgagcaaagataggggtttcttgagatggaaactactcccagtgaagatgttgtgaacactgttgaaatgacaacaaagatttagaatattatataaacttagttgttaagcagtgtcaggatttgagaggattgactctaattttgaaagaagttgtattgtgggtaaaatgctgtcaaatagcaccacatgctgcagataaatctcctgtgaaaggaagaatcaattgatggagttaacttcattattgttttattttagaaaattgccacaggcaccccagccttcagcaaccatcaccctggtcagtcagtatccatcaggacaagacattccaccagcaaaaatattacaactcactgaaggctcagattaatgttagcagtttttagcaatgaagtatttttaaattaaggtatatacattgtttttgtagacataatactattgcacacttaatagactacagtatagtatgaacataaacttttatgtgcactgggaaaccaaaaagtttgtgtgacttgctttactgtgatattcacttttttgtggtggtctggaactgaacctgcagtatctcaagttatgcctatagttacattcagtatattttgggccaggcatggtggcttatgcctataatctcagcactttgggaggctgaagtaggaggattgcttgagactcggagttcaagatcagcctgagcaacaccctatctctattattaaaaaaaaaaaaacccaaaagaacaaaaaaccactatattttgtattagctgtattttcttatattctgtattcctttttttttttcttttttgtgagacagggtgttactctgttttccaggctggagtgcagtggggtgatcacagctcactgcagccttgacctcccaggctcaagtgatcctctcacctcattctagcaagagtagctgggaccacagctgtgtgccaccacacttggctatttcttttttattatttgtaaagatgaggtctcattatgttgcccaggctgggctcaaacaatcctcccacctcagcctcccaaagtggtgggattacaggtgtgagctaccgcacccagcctcttcttcttcttctttttttttttttttttttgtaagagatagggtctcactatgcctgaaactcctagggtcaagcgatcctcctgcctcagcctcctgagaagctgggactacagacttgtgccccggcacccagctaattttctgtattcttgatgccctggcatttggggtcttctggaccctgggaaccacccctccgaggattaactaattcctaaagataaggaacttccctgccagtatgcctttaatatgcaaaccaaccaattccaagactctattgcccatatgtcaccttttatcagactcctactgtctgggactctatcccctaccttaatcaccgcagggccaagtaccagacaactggggaccaccaacatagcgccagagcccactgaaattatttagactctctgaccataagcttgtactgcttgcctactttgcttggcccattccttcctgcataaactacaattaaatctcccacccacagatcctgtctctccctgcctgctcatctagctttggtgcttccctgtgtggtcctgcatgtgtgttgtgcctcctctttctagggactgtgattataataaaaaacttcttccatcatggcaatcatttttatgtctgtgtgtattactataccagctcaacacaagtgctgggtacttttttagaacaatggtgataagcaaatttcccaactacccccttagactgcgccaactgaatacattttctgaggttgctcactagcttattatacactacagtccccaggccaccctacccttgctgcatgtctttattcagtactttaatgatgcagtggctataacattgtggattgttttggatggcccagcaactttacctattcttttggaaaatgagaaattagtctctccccatgaaccaccaaaatagtcctttgttagaggccatggctttttctgtccagtggatgaacatacaaccaagctaggtcatccagatagtgtttccctgaaatttttgtttttaaacttttaagtttggggtacatatgcaggtttgctacataggtaaacttgtgtcatgggcatttgttgtacgattacttcttcacccaggtgttaagtctagtacccattcattatttttcctgataatctgcctcctcctagcctccaccctccagtaggccccagtgtgtgttgttcccctctatgttgtgttcaggtattctcatcatttaactctcacttataagtgagaacatgcagtatttagttttctgttcctgcgttagtttgttaagggtaatggcctccagttccatccgttttcctgcaacgtccatgatctcgttcttttttatggctgtgttgttttccatagtgtatatgtaccacattttctttttccagtccactgttgatgggcatttaggttgattctatgtctttgctattgtgaatagtgctgcaatgaacatacacatgcatatgtcttttttttttttttttttgagaccaaatctcgcttacctaggctagagtacagtggtgtaatcttggctcactgcagcctccctcttccaggttcaagcaattttcatgcctcagcctcccaagtagctggaactacaggtatgcgccaccaggcccaactaatttttgtatttttagtagagacgcggttttgccatgttgcccaggatggtcttgaactcctgggctgaagtgatctgcctgcctcggcctcccaaagtactgagattacaggtgtgaggcactgtgcccggctgcatgtgactttatgataggatgatttatattcctttgggtatatacccagtaatggaattgctgggtcagagccagaaatgttggagctgatttatcttgtcattggcacctggaagaaataaccactggttctcactgcttagatcctacagctgtcctggtacttctgcctttcctttgttttcatgagctatctgataagcttccagtaaagtctttaagttataattggtttctatccttgcaacaataggaccccagcagacactcatgaattcagtgactagagacactttatgtaaccttggccattaaagtaaaattcacatggagtcctgaaagttcaagatggtggtaagagagtttgtgcatgaattatttgtgaaagtactttgcaaaatgtcagtgctatatggtattgtctctagtcttctctttgctcctcaccctcaccccaccctttataccaaaatggtacagacatacaagtttaaggacaattatttcaccactgtaccagtgaatggaaactatgtgctgtgctgaaatgtctggtttacagggataggtttctttctgacctcttccctctagaaagctagagatgtgagataaggcttatagttcccgtcatcagagtggagacccacccacggttatctcatgcctcaccagagggtgaagcagttggtgtaataaaccctgaccctcttcctctctttagatgctcctacccctgacccctcccattttgtaacttacttgagaagtgcttctgctctgatctgagaagccctgaggtagacaggtgtaggctttggggcaaaccgtctcttctgctctctgttcctttgggtcttctgcctcccatctggtggatgtgacctgttcgtgcagtggagtgaaaagatctgtgtctcaggttcaggcttccagtgggaaaaaaaccacagcaagcctttgcgcatattttggcttgaggttattcagactgaacttgagttctttgctaggagttggggccaaagctccagccaatgataaagtgccttgctgtgtctcttgggtatatatttctcttgggagaaagtcatgaacaaggatagaatttgggtattcctagcttcttagtgaaatatcatcataatatcacatctttcaggtcagtcagcatacattaattcggccatgtctattgtttacaactgtccattctgactgattaatgtccatgccctactgttgtccttttggcattttgaatattatatcttattttgttaatatactcaacacctccttcctaaatgctttttttttttggagatggagtttcactcttgtcacccaggctggagtacaacagtatgatctcggctcactgcaacctccatctcctgggttcaagtgattcttatgcctcagcctctcaagtagctgggattacaggcatgcaccaccacaaccagctaatttttgtgttattagtagagacagggtttcaccatgttggccaggctggtctctaactcctgacctcaggtgatacacccgcctcagcccccacaagtgctgggattacaggtgtgagccaccacgcccggccctaaatgcaattttttttttttttttgagatggagtctagctctgttgcccaggctggagtgcagtggcgtgatctcagctcactgcaacctccacctcccgggttcaagtgattctcctgcctcagcctcccacgtagctgggattacaggtgcctgccaccacgcccagctaagttttgtatttttagtagagacagggtttcactgtgttggccaggctggtctcgaactcctgacctagtgacccactcgccttggcctcccaaagtgctgggattacaagcgtgagccactgcacccagttgcaattttttttttttttttttggggaacagagtctcgctccgttgcccagactggagtgcagtggcatgatctcagctcactgcaagctctgcctcctgggttcacaccattctcttgcctcagcctcccgagtagctgggactacaggtgcccaccaccacgcccggctaattttttgtatttttagtagagatggggtttcaccatgttagccaggatggtctcgatctgctgagctcgtgatccacctgcctcagcctcccaaagtgctgggattacaggcgtgagccaccgtgcccggtcacccagctgcaatttttaatatatgcggtaggttgcaaaaatgttcacagttgtttagaccttcttatatccaacaccccccaacctttctttttaagacatagggtctcactctttcacccaggctggactatagcagcatgaccttggctcattgcagcctcaaactcctgggctcaactgattctccagcctcagcctcttgagtagctgggactacagatgtgagccactttccctagccctccaaacactttataatatgtcttctcccattcaaaggtgaagtccatttccccaccccttgattctaggctggacttgtgattttgctttggccaataccatgtggcagaagtgatggtgtgctaatttcagtactggactttagaggccttgtgcatttctacttgctttatggggatccctgcctttgccatatgagcaagtctaggctagcctgctagagaacgacagatcatctggaccggagctgagtcagctcagttgtcccagctgaggctccagacatgtgtgagagcccagccaagattggcaaaaccaatctgtggctgaccacagacccatgaaggaatctaacagaagaaccgcccagctgagcagagcctaaattgctgactgtagtcacgaaaatggtgtgttatgctgctaaattttgaagtgaattgttatgtgatagtagcaatagctaactgttatattatttactatgcacaattaaaaatagacttattcagccataaaggcaatcttgaaaagcaataaaatccttgtcacagggatcaccaggcagaggttctgtgattcctatactgtacctgagaaatgattgtgaggagagttttcagttccacaattccaaaatcctactgtatgatagttgtattcatctatctctctaaatgcagaaaaatgtactaaatgtgttgtcctcttcttcccataaagaaaacttctgcacattagcattaaaatattcccaagtaaataaaaaaatctgttgagcttcttagactcaagaagccagctggctgtataatgagagtgtaacacacgtaatagattctgaaacacaagtatcaacttctaagtcatggtcatgtcttcaatatcttcccactgttgctgtgagacctcaggcaaattccttacacttttgagtttttgtttcatgattagcaaaataggcacagtaaacttctctaacttgatacttggtataagttaatttcatattccttctaaagagctgagaactcaaaatagattagatatatacaacatactatcacacaaggagaataaatctcgtaaggagagtatcttagtaaatatatcacctaaggcgtgaatatccccaagtaaaagtatcattgaagaaataatcaagtcagaagacaaatgatcaaactgattaaagtataagatatgtatggctgggcatggtggtgcacccctgtaatcccaacactttgggaggttgaggcaggaagatcatttgagcccaggagtttgagaacagcctgggcaacatagtgagaccttgtctcagtaaataaataaataaataaataaataagcaagctgggtatggtggtgcatgcctgtagtcccagctacttgagaggctgaggtgagaggattgtttgagcccaggaggtcaaggcttcagtaggccatgattgtgctcacttcagctgggggcaacaaaatgagacactgcctcaaaaaaaaaaaaaaaatatatatatatatatatatatataacatatgctactgtagaaaatttatgtttacacagaatcctgaagataaatatgagttttattgttgttgggttttttgtttgtttgtttgcttgagacggcatcttgctctgttgcccaggctggagtgccgtggtgctatctcggctcactgcaagctccacctcccgggttcacgccgttctcctgcctcagcctcctgagtagctgggactacaggtgcccgccaccacgcctggctaattttttgtatttttaatagagacgtgggttcaccgtattagccaggatggtctcgatctcttgacctgatgatctgcccgcctcagcctcccaaagtgcccaacctattgttggtttttttttagagacagcatcttgctgtctcccaggctagagtgcagtggtgtgatcacagctcactgcaactttgaactcctgggctccagtgatcctcctgcctcagcctcctgaataactgggaatatagatgagtgccaccatacctggctgagaaatatgagttattaaaacttctgaaagaatagatgtggctgggagctggtgaggccaaggcgggtggatcacctgaggtcaggagttcgagaccagcctggccaaatgtcatgaatgcacatatatttacattctgatgatttaaaaaaatatatttttttatggccgggtgcaatggctcatgcctgtaatcccagcactttgggaggctgaggcgggtggattacctgaggtcaggagttcaagaccagcctggccaacatagcaaaaccccgtctctactaaaatacaaaaattagctgggtgtggtggcgggcacctgtaatcccagctactcaggaggctgaggcaggagaatcacttgaacccaggaggcagaggttgcagtgagcctgggcaacagagcagactctgtctcaaaaaaaaattttttttttcgagacatggtatctctctctctctctctctctctctctctctctctctctctctgtctgtctgtctgtctttgaggctggagtgcagtggcataatcacagctcactgtaaccttgaattcctgggcttgagtgattctcctgccccagcctcccaagtagctgggactacaggcttacaccaccacacccagataattttaaaaaatgtttttgtagagacagggtcttgctatgttgcctgggctagtcttgaactcctggtctcacgcaatcctcccacctcagcctgccaacatgctgggattacagtgtgagccactgtgcccagccacattctgatgattttcaagattttatgatagatgaaattttacaaaagtgatagtataggaaaagtattttaagtcctctgtttatacagaagcttaaggccttgaactgctgtatcaaaaatgtggccaaattacgactcttattttgtaggattgtcctaggaatgtttatgcaggggccgcatgattcctgaattgggtaagataatgatttttccagttcagaaatttctagtggttgctgctttgaatcttattcatgcattcactaatcttttattgagctccaagcctgggccagcacactgttagggaccacgcgtgcaaagttgaatgagagcagtgccgtgggaccatgagccctcagaacatcttaccgcagttcctttttatgacttggctttgttctggcagacagaactgttcagccagctttgttctgtcaccatgggctttggtatcagacagactgggcccttgttctagctccatcactgactttctacacctgcttccttaaatgcagataataatgctgtctacctcgtagggatgttgtgagaatcagaaaaatgatgtggggaaaaggctcaggacagtctcttcactaaaccacttgccctgatgacacacttcctcactgtccccagggggtgtcccatgcataaacccttccttcctccctctaccatcaccaatggccagaaaaagtcaaacacctgggattctcttccttcagtgccctgtctcttctaggtaggatattcatctgtgtctatataaatgcgcaaataagtgctaactttatgttatttgtcccaagagtaatgcatttaacaggagctcccttgagaggatactttttccctcattgagattggttatatttaatatatattatattatatatatattatattaatatattttaaaactggttttcattcagcattatgagaagttaagggaagggagggtagtggaaaggtaaggaaataaaacagaaagatgagaaaagattagagaagagaaaggacaaatggagaaggataggtaggcagaggaaaaaggggaaaaaacagataaacaaattgctgctgaaagatacattcacagagtctgtagtgaggaaaaggcagaaacagaggaatagagtgagagaaagccagagtgagtataagaaagagagaatttggcctggcacagtggctcacacctgtaatctcagcactttgggtggctgagacaggaagatcacttgcgtccgtgaatttgagacaagcctgggcaacacagagagaccctgtctctacaaaaactaaaaaaaattagccaggcatggtggctcatgcctgtaattccagcactttgggaggctgaggtgtgtggatcacctgagatcaggagttcaagaccagcctggccaacatggtgaaaccccatctctactaaaaatacaaaattagccaggtatggtggtgcctgcctgtaatcccagctactcaggaggctgaggcaggagaatcacttcaacccgggaggcggaggctatagtaagccaagattgccccactgcactctagcctgggggacagagcaagaccctgtctcaaaacaacaacaacaacaacaacaaacaacacaaaaattagctggacatggtggcacgtatctgtagtcccagctacttgggaggctgaggcgggggaatagcttgagctcaggaggtcgaggctgcagtgagctgtgatcgtgccactgcactccagcctgggtgacagagtgagaccctgtccaaaagaaaaaagagagagagaggagaaagagagagagaagaattgcttgtattctccaagcctgagaaagacccagcatactgtccagcatacagtcagtgctcaatatatatttgctgaatgaaagagtgtatggaagagatagtcaatagctcgttctaacgtgttatctaggcattctagtccatcttattgttcactgggcagagggtattataccttagctatctcttctaatcatttcctttaaaggggtaatttgtttttaaaccatggtttatagctccacaatagctctttattatttaaccttcagtgcttccactccgaatgggatcaccacagcagccaattaagggagaaatcattatttgcattttagctccagtgctctaagtaataagtatcagtctgctagtgggcaggtcaaagtctgctagtgggcaggtcaatccaagctttagattgtacccaacctgtgaaagatgttccctgattcgaccttaactcaaagcgatggccacactgtccgaggtgttaggcatcacagtgagggagtagttttaggttggcagcataagttcatggctattcagtcttaaccagatgccagcagtgatgaccttgtaaaccaaaaagcatctgagacaggtcgcaatcaatttagaagtttattttgccaaggttaaggacatgtccaggaggaaaacaaacaaacacagaattgcgaaacagtctatggtctgagggcttcaatatttaaagagggaatagtgggctggaggggagagaggtggttacattactgaatccacatgttgcaagagaaaaggagcaggtaggggaatagtcaattatgtattcctcttgtgctcagtaaattgaagctttacctaagataaggtgaacatagaatagctacctgtggagatatttaaccctttatctgtgactatctgcttaggaacaaaaggaaaggcagctcttgcacaactcagctttcagcttcatttttttccttttggcagagcgaattggggtcctggatttttattttcctatcacaaccttcaagttctactccatatagacccttgcttagggctagtctggccttatagtgcacactgagaactctgaccaatagctggtgagatcttaaaatgggtccttgcttccacaccactggtctagtgggcccaaagtaacatttaggcctcagatatgtcagagagcttccagctgacccctagtttacctggttagcttgtatttgtagctttgcatcttggtttttgatgtgtgttccaattccttgctgaaactggaggctaccccttcttggctaagacctggaagtgcttatgggtttctgccacgtgtcctcttcccaccccttagtaaccaatgcccctctaacctagaaggaccaccatcatccatctatcatcctagcccccacttgacaactataaccatctcttctcaggagtggctctacctgaccctgtctttgtggaactgagccacttgaatattttttttttttttgagatggagttttcactcttgttgcccaggctggagtgcaattgcacgatctcagctcaccacaacctctgcctcccaggttcaagcaattctcctgcctcagcctcctgagtagctgggattacaggcatgcgccaccatgcctggctaattctgtatttttagtagagatggggtttctccatgttggtcaggctggtctcgaactcctgacctcaggtgatccgcccgcctcagcctcccaaagtgctgagattacaggggtgagccactgtgcctggccaccacttgaagatttaatcaccctcattagatttcacttagccatgcttggatttggttatttgtacctctgtcttttcctggaggggcctgattcttctgtcccatattgcttcccacagccctgaagttggcttatttattttttttaattttcattttattttagattcaaggggtacatggttatattgcatatttgcagggattgggcttctagtatacccattacccaaatagcgaacattgtattcaataggcaagttttcaagcctaacccccacagtctccctctttttagagtctccagtatctgtgatttacttctttatgtccatgtgtactcatggtttagttaccaaataccacagcgagaacatgcagtatttgttcccattccttgctgaaactggaggctaccccttcttggctaagaagtcatttcacttagaataatggcctccagctttatccatgttgctgcagaggacatgatttcatttttttaataatagttgtggcttattcgtttctctcttggaaaaatcctctctattgtctactctgttccgagcaaaccgaagtgtaccaaaaggtatactacaatacagctttcagggaaatttctctacttcattaccttccaccaaccaaccttccccttccaactaaaaggacattaacaatattatgatacctttgtttacaatttgtaagtttatcttggagatttctacaatgaaagttggacatcatccacctatactttatactctgtatctggtggagactgggggcttggtaagtacttcattgatgacattcattggtgactgaatgaatgaactgaaacatcttaatagtggttttaaaaaaggaatttgggaatggttgctctagtacttgttaatgattatctagtagttttgtgggatggttaattccatttttttttttcctgagacactctcgctctgtcacccaggctggagtacagtggtgtgatctcaggtgatccatcccccttggcctcccaaagtgcttagattacaggtgtgagccagtgtgtccggcagattaattccatttttagtatgaggtacgaatgaggacaagatggtagttttatcactgcctagataatttatttttgtgtagtatttgtttcacagtcatacatggtaccttgcactaaagtagtcattaaataaatcatgcccttctcacaaggcaggatgaacaagagtatggatatagatggtttagagaaaactcagttccactgctgagaaaataatccactaatcatcagttagttgtttttatataggataacacgttatcattatgagaaacaacgttccaaagaacaggaaaacctaatgttacagtaataaaaaatacttaatttttttctgacattatttgatattgttctctagctttttatcctgacctatgtcaatgtcatgctagtatctgaagaagtggttggaacaaggtcccacattttaatacttatgaagtcttttgtactgtttattgtcctctgcatgaatttttccttgatttttataatatttggggcctttatttattttttctttcttttttttttgacggaattttgctctgttgcccaggctggagtacactggtgcgatcttggctcactgcaacctccaccttccaggttcaagcaattctcctgcctcagcctcctgagtagctgggattacaggcccgtcccaccaggcctggctaatttttttgtatttttagtagagacagggtttcagcatgttggctaggctggtctcgaactcctgaccttaggtgatttgcctgcctcagcctcccaaagtgctgggactacaggcatgagccactgtaccggcttgggggcctttcttatttgaggaaagcccctgttaagatctcagattgaattttattgaattttcacttcccttattctcatggatgcctggggtctccagataccatcctatttgtgggtttatgtcttggtgctttttattattattattgttatatttcttactgtaaggaacattgctgacagtgccttatttcatttggcttgtaaatgctgatgcttgctatcctctgggtcagagagaggtcacagtctgttctaaaacataatcgctggctccaccatacaactgtgagtttaattagtcccccatactggtgtgaagcgctgaatcttattgctgaatgaggcctggagagcgcatctgttctggtcccttcaccttctggcaggtgggttccaaaccattcaagagaggtggctgttggaactgaattgaaataatcatttaaaaaatctttgcagattacaatttgacaatctctttgtatttaaatttagagttatcatccattaccatcctgataatgaagagtttcatttttttgtctccatgaaataagtcctattttaataaaactgttctctcttgtttgctcttctctaataaggaaaacaatggacaaaaatctctgcaaaagaatgtcttctctgcttccaggttatagctaagtcatttccgttttctcttcttttttttagacaatagggcatagtctaaatattaatcaggtagctggtattagtttctcttaccttgctatgaggtaggtgaggaaagcatttcagcacacaagctttagaatgaatcccacctgtgctggaatcctgatactaataatcagctttgtaaacttggaaaagttacttaatctctctcagtttttctccgtggaaataataatagattctcctctataggattttaaagaggattcaatgagtgtaaagaccatttgggccaagcgtggtagctcacacctgtaatcctagcactttgggagctgaggcaggaggaatatttgagcccaggagtctgagaccagcctgggcagcatggcgaaaccatctctacccttacccccaacaaaaagcattagctgggcgtggtggtgcgcacctgtagtcccagctactcaggaggctgaggtgagtgaatcaattaaacctgggaggtggaggctgcagttagctatggtcgtaccattgcactccagactcggtgaagagtgagaccctgcctaaaacaacaacaacaacaacaaaaagatattgttctacttactactgttgcataacaaattatctcagaatgtagcagcttaatgcaattatttcatcaggttcatggatgttatgcatcagaaatgtggaaaagacacagtgatgagaggttaactttgctccacaatgcctggggcctcagatgagaagactaggagtcttggctagggtgattgacagctgcaggctcaaatcatctggaggtgtctgcaatcacatgtccagcagctgatgctgcctggagctgctgaatgggtgattgcatgcagcttgggctccctactagcatggcagccttaggacagttgaatttagttgaatgtcttacatggcaatgtagggttctagtgacagtgttccagtggacaagctgacactgcattgccttttatggatcagcctaggaaggtaagcagtcatttatgctacattctatttaggacaagtgagtcaccaagattggcctagattcaaggtaagaggatatggacccaatctttcaatgggagtgtcgaatttatgacaagtttttcaaaccatcatagatagtatttttggccttaagactaattgagatcacctaggtaatgggtgtagctagaaaagaggtgaagttctgagccctgggccactccagtatttgaagatcaagaagataaggatcatccagcgaaggagactgagaaagagtggccagtgaggtaggagaaaatcaggagagtgcggaaattaagtgaaggaaagtgttttagttaagagaagtgatcagcactgtgaaatactgttaaagcggcaaatgagatgcggactgaggactgcctattaactttggtaatgtggaagtcactggcaatcttggccagagcaatttccagagtgtggtaactgaattcgtcaactttcacctccttggctgccagcctctgtaggtcctgggtgtgtcacctccactcccacctcaggaccgaaggttcacactggcttaattggtttggttttgtcaccacacgttgcaatacagtctttatcaaatgttttctgctgatagaatttatgaaagaatgccacttatctttgcagtgttcaaatttgctaagtagctctaatagccgacaatatctgtattataatgtttgattctaaacatattttggaaagtcccatttatagtagagctttagtgagagattttaaatgataaatttaaagatagggcaagatggacaagatccattgacaagcaagtggaaactattagtctgtatacctaagtaaacctgccctaatgagggttggattgttttttaacttcttgagggacaaaacaacaacagcaacaaccaaaacaaaacaaaacaaaaaacaaatttgaaaaggaaaaggtaaaaacttctcctatgtttaaataatgccacgtcaaaatctacttaatggttgttcagagataaaacatttgttttattgattttattatagtttcggttaaactataactgtgttgattatatgtgtgcaaattctgcctgtttgctcttgcattcatttcttacccattgcctgctctactctgtctttggggaccagtcatgcagcctccctttcagaggctccgtgttagcttcaaatgacaggagatttgtggtaagaggattctcctcccctctctctgactatggcagcctcccctgtagcatttgcatctcttctgtggctccatctcccaccagccctggttttagcttccaccagcctaggggtgggaatagcttcctgctgctgccaaactgggttacctgacttgccctgcatttcctcagctcttccaccatccatggaaccatgtgtcagaattaaggtttctctggttttggtcgggcacagtggctcacgcctgtaatcccagcatttgaggcgggaggatcatttgaggtcaggagttcaagaccagcctggccaacatagccctgtcactactaaaaatacaagaaaattagccagatgtgggccaggcgcggtggctcacacctgtaatcccagcactttgggaggctgaggcgggcagatcacaaggtcaggagatcgagaccatcctggctaacacagtgaaaccgcgtctctactaaaaatacaaaaacttagccaggtgtggtagggggtgcctgcagtcccagctacttgggaggctgcagcaggagaatggtgtgaacccgggaagcagagcttgcagtgagctgagattgtgccactgcattccagcctgggcaacagagcaagacttgtctcaaaaaaaaaaaaaaaaagaaaagaaaattagctggatgtgatggcatgtgcctgtagtcccagctatttgggaggctgaggcaggagaatcgcttgaatcagggagatggaggttacagtgagcatgtgatcacgccactgcactccagcctgggagacagagtgagactttgtctcaaaaaaaaagctttctctggtttaaataaataggtgatttctgcttttttggttgaactctgatataatcatgtgcgtagttctttcttttgccctcatatcaacttctaatgcccaaatatgtgaattaacaacacatcccacttcttccttgttacaataggaaggaaaagttgagtttatagaacctgcagattttttagacctcacttgctttgtgattaaagccatgggcactggcatgagacaggcctggtgttgacttgtagctcctgtgtcaattactagttgtgtgatctttcacaagttaagatctctaagcctcagcttcttccatcgtctgtgatatagaggtaatttccctacttcatatggttatgatgattgaataaaacatgagctcaaactacccaggacagtgtttacaggttgttaagtgttctgtaaaggaagcaattattaatcagaaagtttcttttttatatacaagcccttgcagttgatctcactcatgtcaggagcctgacatgaagacaggacaggcatttgctggcattttatcctgggagggtactaagccaagtcattcatttgcagggtcaggatgtggctaggctaaaaggagatgtggtaaaacatcctcagtgttgctatacattaagccctactgtggcacgcaccttgtttttggctccgttctccagcaatgaccctatagttattctgaagttagatataccaaggtgagagtgaggctgactgttataaatattaattggtggattaattctcctgcttttagccctgaattggaggattagttgaagagagcttgtattggggactaggcttaatgatttctgtcctgccttcttctttccaccttcctaccttcttgtcttctcctgtcctctttcttttctgaatggtcagattaattcccagcatcttcataaaacattctctgattatttcaaacaaattgggtgtttgcagtggtatacatctaatctccaggcccccaagcagaatttcacaaagaagacctcctccagactatttttccccaaagaataccctgcgaggcagcctgtggcactcttgttttgcaggaacacttcaagcactgtacagctgctgggctgtgcctttctttggcttaagaccggtttcattaacaagcatgttcacacttcaaccggaacatttaaaataacacccgcacaatgtgtttagtgtctagttaattattaagtctctgagcttgaattattcaagcaaaattgattgggttcaagctccttccttctctttgtgtgtgtgttttttaaaataaaaataaattctgctctctactttctaaataatgtggaaagggttatttagcaaccatcaataccctggactgtgggtggtacccaagcgctaatagaataggtaaagaactgacagcttgactcttttgttaaaaaaaaaaaaagtatctacatctcatatacttccattgtcaattagcatttagtgagacctaacatgttttaggttctcctttaaacttctttctagttatttgtaagttggaaaagcaggtatcttggagccatttctttagttaaccgtacttgaaaaagcagaagaaattgcttccttctttgctaccgcatcttatggtcaaatgaaactgttaaaattggcttcaccattaaaatccatgttgttgaagaatgtttgttgaactgaaaaaatgtccataatatattgctaattgcaagcaagaggctataaaactcttttattatgtatcatttttgttaaagtgcataggaaaaagacttgaataataaacaccaaaatattgcttattatctgtgttaggattaaacttttctactacttttagaattagacaacacacacccatataaagatgtcatggctggaaatgactgaccttttgtttgaatctaagtatcattcatgtcaagaccgcattgaaaataatgctgttcttaagccaggcaagtgtagacgttgtagatttcataaaagattcacactatttcatgaatcacaacttgaatcgacttctgttagccttcattttacgtctaggccctcatttctaattcttcctcagcttccatattatcaagatgtaagatgcaattgtggacatgaacatagaaacacaaccgcctcacaggtgtggggaaggaatataaaataattgtattttagagaacgaccataaaggagatggcaattttgagagaaagtaacagaactgcaatgacctagttttgtggtgttaatttaaatgtggcatcttccatgagaattttataaagggagctctcctaaaaccgagattcacaaaaacctggaagggccctacagggatcaggtgccctagctattcagcgatttgcctttgcttccctaattcctgcattgtgccactgggttacaagtgtgtgtgcgcatgcacacaggggtgtaggtttgatgacagtggtgaactgccttgactgccttcacaggctgaatcccccgcaggcagtaaccatggctagggaaaaacaggcagccgcgaggacagttccggaggagacaacaccaggctcccgtagggaaacttttgggaatggagatgggggattccatcctttgcgtgcagacccaagacttcgatggtagctcggacaagtctgtcattgtttttgtcctgggaaatgacacacgaagtgctgtaattagacacctaagaaacgattactctggagtgtgcgcgaaccgaatctggggggccggtggggagcaggtaaggggctgaaaggcaccgtctcctccagctctgtcggaagcctaaagccctctgcttctgggcgcccttaacaaacgcgccagacaggtgatgtctccgaggacgagcaggagccccccttcgcgatctgcaccagaagcctcggggagccggggccacggcgcggcggtggcgcagttcccagcctgcgcccagtcccgccgcagctcccggcgcggcccggtcatcccgcctccatatgctccgccaccgccgcccgggcctccctcagccctcccgcagctccgcattccacgctgcggcagccgcagcctcgccgcctaggcagtccacacccctcccctcgggctggcgcagccactcgggccccgagcccgcgcccccttgggggcctccgctgggcgcgccggccggaccccgcccggcttggccgccggctggggctgaggctcgggcagggcgggggcggggagtggagggcgtgtgcgcgcgcgtgtgccggggccggggggccaggccgccatattggatccagactcgtccgcaagcctccgcctctgtgcggcgggactggaggagcctcgctgagcccagggcgcgagcgcgagaggagagggaaggcgggggagggctggaagggagaggaagggagtggttgggagccgggctgccgcagcctctagtctcctcagccgcggaagcgacccctcctcctgcgccgggccgcctccctcctcgctgtggaaagatgcccttagcccaggggtgtgaagaagggggagaagtagctgccagagccgcccgcgccgccgccgcagctgctgctgcttgtgtcctttgaattcagagaagcacccccccgcctggggcgtcgggagcctccggcgcggcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttcaaagaaaaaatacaataaaaaaacagacactagttattcaagattttccgctagtttttggtaaatattttcccaggagtagaattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaaacattcagactatggaaattattctcaaaataggaggagatattaaaatatctgtgtttgccttaggtcaacagaaagctgaaggtggtgatcagtgggttttatttcatctctacatagtacaaggaaaggaaactgctaaacatggactttccaaaaattatgtttgtaagattaaatgacatagtttaaaaatcttgtgatagtagttagagaatgtttgggggcagcttccacttgagagttagattttactcgaaagttaatttaaatctaaactggttaggtttttggcttcattcttctaaatatagatgtgatttagaagacctactgtagtggaatagatcaatgatgtgagcaaacgctccatgaccttcaagcttgaaggcttggctcaagttcttcagcgtctgctgttacatacagggcacattctaaggtccagaagttcactgttgcaataagcacgcatcgtcacccagatctgtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgccttctgattattagagtttaggtaagtagttttatgttatgagatatttcgctgtattatcagaataatttatatatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaagagtgccagtctatttaagaattgaaatagatcagatgttcttcatatgaattgataactgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtcttttatttaaatctttaaaagactatttgcaacaggaacgcagtattaataacacaagttgttacatatttgtgttcgttatttatattaatgaaagtgtcagctagatgctacttatctttatgctgatgatagattactcttaaagtacagtcagccaagattcttaccggctgtattcagcttcatttctatcaatttcattttattcctagttttagtccattttatttttatattggtacagttaatgttttgttcatagcagtatcaaaacaataagaaaactgacaattcaaagtcagatatgttgtttttctttgacagcctttcttgcttttggtgctgatggcttgagggaggaaataagtggaaagagaaagagaggattaagccaatgatcactagagcaagggaataaaagtgccttaagactatagatcacatttaaatttaataagatgtattatttttcatttatagtaaatagtatttgaaagactatgttttttgtctgcttagttttaagttgttgaaatgattatggtttgtatgtttgtgtatacagtaatagtcgatgtcagcataactctagaataaattacagtggagttgtagaagtaaaaataacttccacattgtaaactaatttgctagtaatgactgaattagtatatcattcgttaaatcggccaccccctactttgaaatgggaaattggaattttggggaattatttaccaatttacttaataaatgtaagataatattaatacaaaataaatatgcaaggctgtctgtacatggataactattttgatgctttttgaattttggactttgtaacatacagaaattatcactaaataactaattttatagcttattcagattttgtatatacatagaaaatagtctgtttaataaatttgtacctagagcatatcagcaggtactatgctttaagcttttctttttattagtatagttttaaagctgttcactttttttttatgacacgagtgttaattaagtgaggtgttgatggatatgtatcttttctaggacacttttgttcttcacatatgctgttcctcattgttagcttttcctgagtagaatttattaattaatcagtccgaattatcaaaatgttcacttaatacagatgattacatttattttatttaagttctcaactagaataatcagcaatattggttgggtacttgtttcctttatactagccacctaatattctattctaggaatgataatgagtaattacaattattttatctagtacaatgctggcacatggtagaagtgtgttcaatagatgtaatggctattattataacatttctgtttgtctctctctttttaagagaaattacacttagaggtagttgccagatgatactggttactggcattcatgatggaatagcataggagtgatgctgttgataaaattacatctaggaaaaattccctataaagtagagtgaacttaggtataatgaactagtgctgttaacccctaaagtctttgaaatacttgatgttcattagtaatttttttgtttttaggaacatcacccttttatattatgtattgatttattttagagacagggttgtattataattgtttttaggaacattactctttttattttatgtattgctttattttagagacagggttttgttagtctgttctcgcattgctataaagaactacctaagactgagtaatttatagagaaaagaggtttgattggctcacagttccgcaggctacaaggaggcatgcaggggaggcctcaggaaacttgcaatcatggtaaaaggcaaaggagaagccgaccccgtcctgcatggctggagtgggaggaagagagagaagggggagatgctacacgcttttaaacaaccagatcttgtgagaactcactcactatcacaacacaaaggggaagtctgcccccatgatccagtcacctcccgccaggtccctcctccaacactgggattacagtttgacatgagatttgggtgacggcacaaatccaaaccatgtcaagggtcttactgtgttacctaggctggtcttgaactcctgggctcaagagatcctcccacctcagcctcttaaagagctgggattacaggcatgcaccaccacacccagcttttttaaaaaaggaatgtattgcttcatgagtgaaaacaggatgtcaggattaacactttaggaattttagacatatatttattttatatggaaatgtaaggcataccttagtatagcagtatataaaaacaaatagtgcagtatgttggaaattttatgaaatgtcccataattcctaggacttgaatactattacacagtaagctcaggctattttaggataaaataatttagctcaaataaatattttattgtaccactcttttatggcagtcaaaaatttattctctgacctttttctcatttggtacatttattgacagtatgttacgtatgtagctcattgtttttctcctgctggttgtgataggttttaaaaccaattactaagtctaaccagcatttaaaaaaaattaaagactagaatagaaaatataaagtacatcaaatatagaaggaataagtattgttgtgcaaaacattgtgttttcctgtagtccttattcccatatttcttactataggttgagataaaaatagtttgaaatacttcagtgtaggtgcagctatgctatgttgactgttaaacagtgaaaatatagacagttcattttttcaaaaaggacacacgatagattagggacttactcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttctttcaatggtttattgtctcttcctttgtttttttccgtttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgccagttttaggtatcgaggaccaagaattgcttagctccttttgccctgtcttgatgagtcaagaagtctttgcataataattgttatgagagaccatcatggctcactacagcctcaacctcctgggctcaggatcctcctgtctcagcttaccaagtagctggagctacaagcatgtgccaccatgcccagctaattaaaaaatttttgtgtgtgtggagatggggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacacttccttcctatgactgccatctctttttctaatcagtacgtagggaatggctaatcttctattggctagtgtttctttatctatcactgtatgagagcagcactttagctttcatgttaacggggcacaaagacctggctccccctttccaatcccactgtttgcctttactcttcctcatggaactgtttgcttctcttttgggattagggcctcttcactctaacctccctccctagtttcaaagtgtgttctggaaatccatgggatatttaatagatgcttgagcaaggggaaaggtttatatgaataaatcagtttgggaaaagattttagacaacatttaatgttaaaaatacagcagattatcctagaatttatgaagtttatctgactatggaataggctttttttcagagcgtctggaggatggctggcaaccagtgtttcacagaatacgctttgggaaatgttcttccagtataaggtcatggttttccttgtaacttcctgagtagcagggttagaaagaaattttgagagaaatttgggatatcgtgtggattggagagagaatccaaatctgaataggttatattttacttagtggctgtgaacttcattttctgtgtgaaagtcatgtgcactgaaagataaatttaatcatggtgaaataacatgagtgatgctgttggtaaaattacatctaagaaaagcaccctaaaaagtagagtgaaatttgacatcataatgaaccactgctgtcaacccctaaagtccttgaaattactgagagatctcttaattatgaccttttcctgctctaattaagcttacttttctttatgtgtaggcatttacattaaatacagaaattgtcactttattttttacagctttcattactgtagatgttgcaaaactattgtctatctgaagagattacattcattactttgtgatttttaagaggaaaatatcatggactcatagttttaaaatcctgttacagtgttaagtattgttttttgcagtgtaacacattttggctaggccattggtttcagacttttggactagtgtgggaactttactactatttattacatccatgaagcgctgtgtttctagtgccagcaactatttatatatactgttaaggaaactagaaaatatatacttttattaaggagaaaacataattggtgctattttggcattgtgtgaacaattaaagctgtggttactattaacttttgttcagagtttttgggaggccagataataatcatagaggacaatctagtttcattgtttaaagacagacagcatataggggaataaaattagttttcttgcttatttttttttttttttttttggtagagatagggtctcactatgttgtccacgctggtcttgaactcctagcctcaagcaattctctgaccttggcctccccaaagtgctgggattacagatgtgagcagccgcacctggccttttttcttttttctgatttagatttatttttctctttaactcttcctcaccagtgccattcttcccactcctgatctaattatactgcaaagtactacttatatggatgaaaacaatcttttgaaaagattgtgaattatttcagtcatgtgcaatcatgtgttaactttcagttttatttcagattgcttaaacgtcactgtaggcttaatcaaagacaaaaacaccttctgtttaatttggtctattcatagtgataacacttaatccagtttccttagagtttccatggtgaatatctacaagtagaacacctaacctgaaatgtttctgttctaaaccaatatactggaaaagagcaaggggttttggattaagactgactgctttgattattaactgggtgatttagttatttaacctccctatgtctctttatgaaaaatggacataagactaatagtttatttttctaaaaagttaaaagttggtttaggattcttccttttctggtgatttatggttgtattttgtcagcttgcttcccattctgtttttttttttttttttttgagatacagtctcactgtgttgcccaggctggagtgcagtggcgtgatcttagctcactgcagcctctacctcccgaggtcaggcaattcttctgcctcagcctcccaaggagctgggactacaggtgcacgctgccatgcctggctaatttttttcttgtattttagtagacacaaggtttcaccatgttgcccaggttcatcttgaactcctgaactcaggcaatccaccgggctaggtctcccaaagtgctgggattttaggcatgagccaccatgcccgtcctcccattttgctttttaaaattttgataaaggaataattaaaatgccatttattggtaaataataactgaaatgcatagctatactaatataaggatgtaaataactattttactattaacatacatttgtatcttactgatagtattttattatattgggattgaagatgccaatatttctgtgtgactatgcaaaaaaatcttacaggataagctttttgcattggaacattttgttgttatataattattcttcagtaagtatcaagttaatgctcattcatccaccaacaacaacaaatatgagatgactaattacattttatttttatatttatatatctccaatctgcacatcagtggtagagttctggacctcaacgcagagggttaaaatcatcatgaaaaattattgatgtgttgttcatttaggactttttatgtattgaagattatgcagcacccgtaaatgtatttgtgacctgacagtacgacacaaacgtgtggtgtggtatgtagaaacttaatgtacactagtgtttcctaaattatatttctagagatataaatgaatattctgaaaattaagagttcagtggctgtgtaagattggaaaatagtgctttttgtatgcctctttggatattacaaagcacattatcatagaaaaagtttcaaaaagtttgctgtagaaaccatttaaactttgttttacctagaatttgcctgagtaatttaacattggaactccttatgaagaacagctgacagagtttgggaaatgctggtatatacttaaccgtaggtagtgtgagagcctttaaactggttgtgtgacagaaagtggttaataaagtcttctaacacataaattgtcacaatttatatcaatttccaaacaaaggcaaaggtttgaaggtttgcctttatcctttccatattttttagcgtatctgtttatgtcatctaagcaatattaagttggtgtggagttttgcatggggtgtatatatctttacaaagaaaggacagtgagacttgatacatgacttcgaggagtttatatgtgcacttcttggtttgcaaagatgcacctgctaagctagtgattttgtttttttccagtaaagctttattatgttctaatccagttacctctctaaccattggtacagaatttgggatcgatattgtcatggctgtgaaatagaacaatgctaattagattttatgaaagttttgtaaaagcagtatagttatcttgctacagcaagaatcccatccttaagtatcatcgtttacttagagtggctaatgcaatgccccaagttgactcagatactattaaaagcactcaagcatctacttagaagtggtatgccctgagatttaaaaaatacttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaaaccacttagaacatgatcctttgatcatgtcaacatcctgcttaatatacttcagtgactactgaaagctttcagaatgacatttgaactcctctttagcatgccatacagaatttttaatatgatcctgtttacttctctttttcttcactttatttatttatttagttttttgagatggagtctcgctctgtcacccaggctggagtgcaatggcacgatcttggctcactgcagcctccgccttctgggttcaagtgattctcccgcctcagcctcccgagtagctgggattataggcatccaccaccatgcctggccaatttttgtatttttagtagagatggggtttcactatgttggccaggctggtctcaaactcctgacctcgggttatccacccaccttggcctcccaaagtgctgagattacaggcgtgagccaccactcccggcagatgctatgatattttaatggctgaaaaagtggtgtcaaatttgatgatggtgatgaagaaaataattttcataatccttgaagtatatgaacttcgttgaaagagaataaagtcagcttaataagaatgacatctaaaggtatgagaggacctagtaatctttgaaagaccaaccttaagagacttctctgacagcaagaaaaatgaaagagtaaacaacaagaaatgaagacgaggtttcttgagacaacaaaccacaatgcagacattatacaaatgtgagttacttttatcctatccattttgggattaatgtaaagaataagagtaatctatacagagtaatggatttaagataaaaaaatgtttgcctcagcttcccaaagtgctgggattacaggcatgagccaccatgcctggctttttcttcacttaaaaaaattttgaaataatctcgagtttacagaaacattgcaagtatagtataatttttttcctctggaaccatttgagagtaagtagcctacctaatgctctgtcatccccatatattttctgcattcttctacctaaccacaatacaactattaaaatgaagaaattaacattggtgtatattgtcatctaatctttagggctgaattgtttaggaaggagaagggaatggccacttattatgtatgtatgtgtgtgtgtgcaattttatatttattttccactgtcatcttaaaaattatttaaagttctttaagaaatttacctatagtaaaattcacttattttggtgtgtatattgtgagttttaacaaatgtaaagtcatgtgaccactaccatagtcaaggtacagagcagttccatcatccctaaaattctcttgtgctattcttttgtcccacactcatcttttactccagctataaatgaatttgactcttttactaattaaaccataactttgattattcatgacttttcacatattggttaaattgtttggaaactcctctttcactgcaccccataggagacatttggtaatgtaggttgaatgaattatgccgttatacttgttatatgcagggctagaagcagtagctctaatcttgaaacattgtatgaaactcatatttttaatgccagggacttgtttcttctttgatttaccctattttatttcaaagtaattttttccttttaaaattatttaataattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctcggcttcccaaagtgccaggattaccggcgtgattacaggcgccaccacatgtggtcaaaagtgatttcttatatgagtagtcatttattatcccctagcagttggcaatttgtaaacaagtacttcatggtggtgaggtaaggagaagagggtgctgctatttaaaagaatgaggtaaaatgcagataatctcaaatttttcaaggtaaaagttcttagattaactctgcatttaactttatttgcacaatgtccatcataaactttagagtctggtgatgatggattgagcatacaaatataacttcatttccttctgcaattcactaacactataataaaataatttttttaaagagtcataaacctttaaggatgataagagtggtagaagagactatagaaacaaaattttggaagctgaaaagcaggtagatgagtggtaatgacttaggaggtctgagaaagtcagattccaaattagcagtggtgaaagctgaggacctgttcagtttacttggcagaatcttcagaagttttagaaattgctatctttaggaacctctggaagttgaggtatgggtagggctaaagtacagaggattgattgaggctggtttagaagcagtagaaactctagagcaattcccctgttgagtgccattgggttactttatccctctcctcaaacaaatgttggatgttcttagtacaacagaggttttctggattgggcaacataggcatagtttatggtggacatttcatattgaaaataaggagattaagtaaatttgtatttacttctgctcccagaatgctggcaactgggattaggacaggagattagaagattagaagagtcttgtctggagaatctgactctccccaagaagaaagaacttagagatgcagatatcagaggcttctcagtaaagggctcaggcagtcacactacagtgagatttgttatcagggggtttcacccaaggatttggagcttcacatcatgttttagttctcgtaattaaatatgaatggaaaatagaattgccagacatctgaggatcctcaaagcctctatagggtacagtcccaaacaaagaaagcaacccacatgaaacatacttttcagggaaagcataacttcgaaaaaaaaaaaaaacccaaaaaaaccaaatcacataaaactatcagtattttccagagatgagagaaaatcctgcaatcatgaagtcaggatgccataaaaaggagcaaaagagaatgaaaaaagttctttgaaattattatgatagctaaaatggaaacctcagtacaagattggaaagtagaaaagtggagcaaaaagccacagagagatagaaaagaggagatagaggagaaaattagaggaccaattgaggaggcctgaataataatctgatgaatgataggaattctaaaagagcactttgaaagaacagagggggaaaaaaatcatcaatacaagaaaatgttgtagaaccaaaggacacgagttcctagatagaaggggcctaccaagtacctaggtcagtggatgaaaatagattcgcatcaaggttcagaatcaatatattttgcaattcctaaaactctggggacaaacaagagaccccaaaaggttccaaagagtgtgaatacaaaggataagaatcagaaactctttggccttttcagcagcaactctagaagctagaagacagtgttcatattttgaaggaaaacagtttctaaactgaaattctatatccagacaaattcttaagtatgagggcgggataaggacatttttaggcatgaaggtgttaaaaattctgtaacctgtgggctacaaatggtttacttaggataaggagcttcccaggatgtgggacttctactaaaaccagcacagtcttaggcaaactggaatgagttgattgccttagctgcaactaggtaaaggagtgaatgaagatgaggaagtaacaggatataggaagcaggagatacaatgcaggagagagtagaaaggatttcctaagactgtaatgaagggagaatacaaaatgacaactttgcaccaagcatagaggtgaaccataacagacaggatgcagttcagaaggtttcaggacagacttaagtatctgatatggatgaacatcttgagaggagattagaaaatctggggagggtttaaggttgcttaggaaatgaagcaaatgagaaaacaataagaaaaatagaaattaggaaaggaaaagtaataacttatatggttatagtaatggaaacacttaatatttatctaactaaaattatgctgtaaccatattgggaggatggtatggaaagggaattttttttttggtggaagtgatagtaggtacggggcgtaatgtttttcctaaatcttaagtgatgattgaatgtgtatttatgaataactgataaaaatgaaaattttaaaaacagctgtagtttttacagaattaaaaagtctaaatccggctgggcacagtggctcatgcctgtaatcccagcattttgggaggccgaggtgggcagatcacgaggtcaagagattgagaccatcctagccaacatagtgaaaccctgtctgtactaaaaatacaaaaattagctgggcatggtggcacatgcctgtagtcccagctaccctggaggctgaggcaggagaatcgcttgaacccaggaggcagaggttgcagtaagccgagatcgcgccaccgcactctagcttggcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtatattctttgagcagatcagtctttttcttcttcagttatttctctgttcttatgatggcaatttatagtctttgtcttaggagtttagttgattcctaaaaaacctatgtaggttaaattcgttagtgatacacagatacttctgtgaacacacagcaaaagaacactaacagagcagtgaagacaaatcacacaaatgatgtaaatgacgcaaaggatggatatgattattatttcttaaaactaaggagctgccaggtgctatgaggaggcatcagaatacgtgtcaactatacaactgcaaaggtagctttggtttagcagcgcttacccgctcttctgatgttcaagttgatacttgtaaatgcaaagaaatgccgtgtgtgcgtgtgtgtaaattctcatagcttttggagtacaagaggtttttggttacatggatgaattgtatagtggtgaagtccaagattttagtacactcgtcacctgagtactgtacattttacccaatatatagttttttatcccttaccccctttcttccttctcccttctgagtctccacctccattatactactctgtctgcctttgtgtacccatagcttagctcccacttataagtgagaacatacggtatttggttttccattcctgagttacttcacttagaataatggcctccagctccatccaagttgttgcaaaagacattattttgttctttttatggctgagtagtattccatggtatgtgtgtatatatataccatatattctttatccctacattggttgatgggcacttaggttggttccatatctttacaattgtgaattgtgttgcaataaacatatgtgtgcaggtgtgtttttgatgtaatgacttattttcctttgagtagatacccagcagtgggattgctggatcaaatggtagatatacttttagttctttaaaaaatctccatacagttttccatagaggttgtactaacttacgttcccagtagcagtctataagtgttcgcttttcaccacatccacagcaacatctgttgtttttgactttttaataatgagaggtgccttatattaaatgaaattcctcttgtaatgaatttcaacttctcctagagaaaatcccttgaaaatctaaagaactgaccagctcttccctacatgtctgttttagggcaaggttaagagaagtttgtttcaggggattgctgaactgtaggactctgagaaaactggtccgctttctaactactcctgagtcaggttttcagaggacgagaatgacgtctttatttactttaacattatgactctttacattcagatgcatattgaaaaacacaccccaaaagaaattattattgaattatgtaatactttgcttccttgtatgagaaatcattctgtttagtttgttgactacttctgttgctcaaggtcgtttttattttccagactgtgggtcatttattttgttcatgattgcatacctaaaaatttatcttgcattttatctaaagggaaaaacatcaaaatagtagcaaagccataaaaaatttacataataaatctgtaatcattttagtttctaaatttaatgtctttgctgagaatcaatagaatttaaagcagatattaatcagtgtatctagataacattatatatttacagcttaaaatagggttaggatgaaatatttatgacagtttagtatattttgttttcaattaggtgtattactaaaaaacatgtaaaccattccatttaaaaaaagaagtaaaaggagatgatgtaatataactagtatttggaaatgacaaaggaattttccctccagctgtagaagtatttcctttgcaacagtgtttctcatttatgtttcagttctcagatatacaaagatgattgctgtgagagggcattagttttttaacagacaattaaattcagtttttgaaaaccctaattgtttagtgttcgtcaaccctaagaatttttacataaagctgcttaaatattagttaaaaagtcaagtttcattttctttccaaaattctctgcacatggctcaaactgtatttgagtctgaatttcttttgaaaatccagtaagctttatgaagaaatgccaagaaaatgtttagttcaaatttactcttctttcatagaatgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgctttcttctctgtaaagttctcagtttttgtcactgaaacctataagccactgagcggctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctccttaattttcttctgagtttttaggttatagcaccaacatactaatgacactagcttgtttatatacatgtttagccaaattatgaaaagtaaaagaaactatttacctgaggatattattacaaaaaaaatgcctcaagttgagtaagggcaattataatagtggttgaatttctggtactattttgtcataatttcacttgttattttttatgtgtttgtgtatatttcttggatgtgctttaactgttgcttgtcttcagtaccttggcaatatatatgaatttggaattgtggcacgactctggggagggaggtattctggaaaatgccatatgtgtgaaatttttacctactacactgagaaagagagattttttttgagacagataaaaaaaaacattgtatatagtcacactgctttttctcagtctgctttcttttggtgtatgtatatatttatgtatgtatatattatgtatatatatgtatatatatgtatatatgtgtgtgtgtgtgtatatgtatatatacacacacacacacataaaacaaaatttgccattttagcccctttaaagtgtattatttggtggtgtcaattacatttcaaaatgtataacatcaccactatttcaaaaaccttttcatcacctcaagcagaagctctgtatccattaaccaacaactctacattctctcctttccccagtttgtggtaacttctgatctactttctgtctctctgaatttctacatattgtagatattttgtataagtggaatcatttaatattattttgtgtctggcatatttcatttagcatgctattcgtaaggttcattcatgtggcattatgtgtcagaacttcattcctgtttatggctgaataatattccattgtatggctataccacattctgtttatctgttcatttgttgatggatacttgcgttgtttccaccttttggttattatgaataatgctgcagtgaacattggcatacaagtatctgtttgagtccctatttttaactcttttgcatatatgcttaggagtgatatttctgggtcatatagtaattctatgtttaactttttgaggaactgccaaactgtttttcaaagcagtggtaccgtcatacattcccaccagcaatgtatgaaggttgagttttgctacatgcttgctaacatttggtactttctgttttttgattagtcattttagtaggtatgaagtggtaggtggttcattgtggctttgatctacttccttaataattactgataacgagcagcttttcatgtgcttattggcaatttgtatatcttctttggagaaatgtctgattaaccctttgcccactttaaaagatagactatttttagaaaagttttaggttcacagtgaaattgagcagaaggtatagaaatttcttagatttccagcctccccatatgcatagtctcgcctattctttgtctatttaaaaattgcatttatcttttgttgttagagttcttcatacattctggatattctttgtcatgtatattatttacacatattttctcccattctgtaggttgctttttcactttcttgataatgtgcattaatgatatacaagtttttcattttgatgaaatccaatttgtccctttttttttttcttgtgcttttggtgtgatatttaagaacccattgccaaatccaatgtcatattggtttaccctttgcttttttccaaaagtttttttttttttttttttgatgtggggagagtctctctctgtttcccaggctggagtgcagtggcacaatgtcggctctctgcatcctccgcctcctgagttcaagcgattttcctgcttcagcctcccaagtagctgggattacaggcatgtgacaccatgcccagctaatttttgtatttttagtagatgcggggtttcaccattatggccaggctggtctcgaactcctgacctcaagtgatctgcccacctcggcctcccaaagtgctgggattacaagtgtgagccactatgcccggcctatttttttcccaaaagttttgtgtttcacttcttatatttgttatgaatccattttgagttaatttttatatatgatttgaagtaggtatccaacttcattcttttccatgtggaaattccaattgttccagatttgccatatagaaaagagattattctttctgtattgaatggactcagcatcgttgtggaagatcaactggccttagatgtttggatttttttctagactctcagttctattccattgatctatatgtttatccttctgccagtaccatacagcctggattgctatagttttgtagtaagttttgaaattgaaaagggtaagtcctctaaactgtttttccaggttattttggcttttctgggctccttgcagttccatattgtgatgattggcttttccatttctgcagaaaaggctgttggaattttgttagggctcttctttattaacaaaacccgattgactgtgttttctagctttatttccagttaggtgtggtcacgtcagtagttctggctgattgatgtacaaagtgatgtgtgatgcttaccagaagcttcattaaaaggaaggctttccccactttattcccgtctgctgcacagaacacatgtgatgttttcagagcttggactgtgatgatgagggcatgagggccatactccaaggatggcccagcagtgagctggaagcatcctggattcctgacagctttgtgaaactgccataccagcattggaccttcaaatgtcttttacttgaaaggaaaatatattttcattttgtttaaattggggttgagttttttgttagagctaaacttaatttatacacttttcctactacattaacttggttatctcttcattgtgtgtactgtgtgagggagtgagataatatattaccagaattgctggaactatacttaatttaaattttttttaatttcatgctgggcatggtgtttcatgcctgtaatcccagcactttgagaggctgaggtgggtggatcacttgaacctaggagtttgagaccagccgggcaacatggtgaaaccccatctctacaaaaatacaaaaattagccagatgtggtggtgtgcgtctatagtcccagttgctctggaggctaaggtgggaggatcgcttgagcctgggcagtgtaggttgtaataagctgagatcacaccactgtaccctagcctgggtgagaacctgtatcaaaaagaaaaaattatatttcatatatatgtattgtgaatttgactttaaaattatttttccttagtatgtaatactaaaacgttctttaacttaaatgtagcctcaacatttttttaaaaagcagaaaaaaattttcactgctgtaacatagcagatttgtcatttttgtgctaacccgttgaatattttttatatacatacttagttttctacataggaacatttctggtatttttataccttgcttttttttttcacttaatgtgataaagtgatctagtgcaagttaattaacctctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaattaacctctttttgcttcagtttctttctctctgaaaatgggaatagttattacacatgcttcgtggggttgttttgagcattaaataaaatattggagtaaaatgctagaccagtgcccaacatgtagtgaattcctggccctcaatgaatgttagttatcattaccattattaatatcgtgtgatcttaagctcttcttctatattattgtaaaatcttgataattacgctcttcaaagtctgcttattatttcattaaataaatacacagttatttattagatactaaatttttttttttttgagatgaagtctagctcagtcgcccaggctggagtgcagtggcgcgatctcagctcactgcaagctctgcctcccgggttcatgccattctcccgcctcagcctcccgagtagctgggactacaggtgcctgccaccacgcccagctaatttttttgtatttttagtagagacggggtttcactgtgttagccaggatggtcttgatcttctgaccttgtgatccacccgcctcagcctcccaaagtgctgggattacaggtgtgagccaccgtgcctggcctaaaatttttttaaacatttaatttacttccatttatttggtgttacaaataatgctattataaactgatctatgattaaatgtcattttattacaagctagagacacttttaaaagcagcatttatcccttattttataaggtagtgaagaaaatgtgaaatagattttgtttttctaaggcggagttttgttcttgttgcccaggctggagtgcaatggcgccatctcggctcactgcaacctccacctcccaggttcaggcgattcttctgcctcaggccaacctcccgagtagccaccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatcttttgcaataaataataatagtcacagattgtataaccagttctcataacacattataagttctgtaagcttgaggatttagtttggtttaattctctttttgtggtaatttttagaaactgtaaacatttaagtgttaaaaggtgattaagaatatgccatagtcactattttctggcatttatcactgtttttaattatatatatttgcaattatttgattattattgatcttccttactagagcagggactgtgtctgttttgcttaccagctcttccccaatacctaacataagtgcttggtgtattgtaggcactcaataaatatttatttgattaatgaaagaattggtgagtgaacaacggagttaagcaaataaatagggaataaaatgttttgatacagttaaatctcaacattgagtcagtagctatgatgaagaaataacatctaaaactccaactttagatacaattttgcagagatttggggggaatatagtaaaatataacaaggagggcaatttagagatgaagtatttaactctagggttttggttttgtttgaatgatagtggaaacatccaggtagaatgttcaggagagagaaatatgggccaaaggtcaaagggtagtcattcaaataatgacagtaattaagttcaataaattattgaatgtctaccttgtgctagctattgtatagttgtggaaggtaggtgagtaagacatattcctcataataataattcaattaaaatacctcttaccctgataattctcttcacaagtaaagttttaacaaagttagaattttgattttagaatttagtggaaagcaatgattatgaccaaattatcttaataccttgttgaattttcactgtatcttctaagtgataaagatgattttaattcagtgaactttgtagttgagacttttgttaataaaatatttttaaaaagttttactgccattctgtgtagaaataattggagcaagatttttaaaaataatcattatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcacgcctgtaatcccagcactttgggaggccaagacaggcggatcactaggtcaggagtttgagaccagcccggccaatatggtgacaccccatctctactaagaatacaaaaataagccgggcatggtggcgtgtgcctgtagtcccagctactcgggaggctgaggcagaagaatcacttgaacctgggaggcagaagttgaaatgagccgagatcgcaccactgcactccagcctgggcaacagagcgagactccgtctgaaaaaaaaaaaaattatctgttatagacctcagggctatttgttatttttaaattgtctttaaaatgaacttgaattttgtgaacattgtactttatttattgaatttatgattctgtagaagaaacaggtcaatttctggtggtacatgtcttaacttcagtattggaataaaaaaagtttaaatgatagtacagtaataagaggtagctgattacacaatacaaatgttgagggttaatagtgtgcttttggttggaacagaaaacctgatgcaaactggtttgaagaatatggaaagttttactagttaacctatcaagagcaaaagtggggtagacttcttggtttagtggctctatagtattatcaaatatccaaagtctttcagtctcactgttgttgtagtatagatttgggtgttttttttgtttgtttttgtttttaatttttgagacagagtctcactctgtcacccaggctggaatgcagtggtgtgactttggctcactacaacctccgcctcctggattcaagcgattctcctgcctcagcctcctgagtagctgggatgacaggcgcgtgccaccatgcctgggtaatttttgtatttttagtagagacggggtttcaccatgttagacaggctggttttgaactcctgacctcaagtgatccgcctgcttcggcctcccaaactgctgggattacaggcatgagccaccgcgcccagcctagacttcttttttaacactgttttccctcagggttatcagatggcaccggagcaacatgattttttgttcaggtggggaggagggaggaaggctacctgtagccctcttatttcatggaagcacctagaaagtcttccctccattctcaatgaccaaaattaggtctcctctctattcctgaaccaatataattggtattggtgccaataagattattgaggtatatgggctgtgtatgggaagtgcagtgatcttaacaaagttaggattctgtttaggaagacggaatggattctgtctagacaacaaacagtctcccctatagttggcattgtggcctacagtttatttgtatcattttcgaaaggaatttttagtgctatagtaaagctttatgctatactttgtgtttccccttcccaccccaccacctgtaactaacaccttccctaataatgtgtttttgatttagggattctgggccagtgttactgtgtgtaagagaggaaaggatgcattatagatatgtataattaaattttaattttaaaattataaatagtcattaaaatgatacctttctcagccatgccatcctttgttggcatatccctcctctgaatgcctataaaatttgtttatagtgctcatttggaaaccaatatgaatcttggattatttattgtctttttatgtatgtcataccaggatcatttcttgtatatctaggacaaataaattctattatatctgtgttactggtatctgcagaaggtgtcattaagagaagatttaaagtcaattcaataaattttttaaatgtacagtaaagtattatgtctataatggagtgtagcagcaatgaagatgaacaacatgtggttccttccctaaaggaattaaacagaattaaatgtaataaagggggcagtagagagagattactttggtgtggggagtagaaaggctcaatcatggaagtgacattttgagcttactcttaaggaattaatgttttgtgaaacagagaaaagggggcattttagatggaaaggaagctcaaaggcatgtgcttggagcatagtacttgggtgcagttgaggcatagtgggaaataaagttgaaatggtggattggggccatttcagaaggcttactacttaatttgaatttgactctatggacagtgggaagccattgaatatatatatttgtttttatttttagaggtagagtcttgctgtcactcacccaagctagagtgtagtgttgcagtcatagctcactgcagctttaaacttctgggctcaagtgagcctcccagtagctgggactataggtgcacaccaccatgcctagcttttttttttttttttgtagagacagggtctcaccatgttgcccaggctggtctggaactcctagccctagtagtcttcccactttggcatcccatgtatttctttttaaagcaagaagacttggaaattattttccgccgaaacataagtacccttaagatttgttgttttttgccatgatacagtgtttgtggagtacacacattaattcatttattttaacagatatttattgcatacctcctatgtgacagacataaaaatctggagatacaacagtgaacgagacaggcagggtttctgctctcatggagcttacattataatttggggggaggtcaggaaatagacatgtaaataagattatttcagataatggtaagagctataaagaaaataagaggatgctgtgacagagtgttttgggtggtaatttagatgagttggttagtgaagacctctgaggatttgatgtttgaactgatgttaaatgagaaggtgccagccatgtgactatcttgggtaagagcaccctaggtagagggaacagtaagtgctgggtccttaagatggaaaaaggaacagaaggaagaccagtgtggctggattagagtgagtgaaggggagagtggtagggtatgaggtttctcctggaaaggagtttatattttcctctaagggttaaagccagtgcagagttttgagcagaagggtgatatctagatttatgctttaaaagggtaactgtggttgtcatgtgaataaaatcatgccagttaggacctttgtagcagtacacgtgagagagagagtagtgccttgaagttgggctgtagtaggggagatggagatttgtgatatcattttatttaatttttttattttgaattattattattattatttttgaaacaagagttttgctctttttgcccaggctggagtacaatgacatgatctctccccactgcagcctccacctctggggttcaagtgattctcctgcctcagcctcccaaatagctgggattacaggcacctgccaccacacctggccaattttgtatttttagtagagacggggtttcaccacgttggccaggctggtctcgaactcctgacctcaggtgatctgcccgcctcagccttccaaagtgttgggattgcaggcatgagccaccacacctggccttaaaaattttttttttgagaccgagtcttggtctgtcacccaggctggagtgaaatggtgcagtcttggctcactgcaacccccgcctcccgggttcaagcaattctcctgcctcagcctccccaatagctgggaccacaggtgtgcaccacgcccggctaatttttgtatttttagtagagatggggttttgccatgttggctaggctggtcttgaactcccggccttaaggaatccacttgccttggcctcccaaagttctaggtttacaggcatgagccactgcacctggccgatatcattttaattttaagatttttcatttttttattttttgaggcaggatctccctctgttgcccaggctggagtatagtggcacgatcacagctcactgcagcttagacctcctgggctcaagtgatcctcccacctctgcctcccattcacttctgattgcttttattatttcatgaagttgataaaatgtaatcagctgaggatattgggaaataatgggtgattagacatttagtgagagaagagaagatttgtgtatgtttgggatcccacagaccatccccatgttaggtgctttactaggaggactgatgggacaagcatgtaatgatactcatagattaatgtttattacagtgaaaagctacaaagcaaaatcaacaaagggaaaaggctaatggagcaaagccggaggaaaccaagcacatacttccaaggatcctctcccattggaatcatacaggatgtgtttaatcccctcagtaatgaattttaatgtatagtgtgaagtattgtctgccagagaaactcattgccctacagttttgaatagctagaaggacgatgttgaacattaccaacacaaataaatgataaacgtttgagatgatggatattgtaattaccctgatctgatcaccatacgtcttatgtattgaaacatcactgtgtactccatgaatatgtataattatttgtcaattaaaaaccctgggcactgagtttatttttttattggtggctagtcacgtaggaaccctctgcctagcctctgcctagcacatactgaaattcaacaaggttgaagattcaacaaggtattaagtaatttggtcataatcatattgctttccattgaattctaaaatcaaaattctaactttgttaaaactttacttgtgaagagaattatcagggtaagaggtattttaattgaattattaatattaattgaattattatcattccttctggacttccagaaggatagtagattttcagcataaattatattatttgcagaaatagttcaggtacagtgagccattcttaccagttaggattgtgagaacactcccaaaatctaagttcccagatgccagccatagaccaaccttgcaaataggccttgctaagaaatagcagtctcaggtctgtgatgtaactcttttccgcacaatacgaaacagtacttttggagcattggagagagaccatcctaggagagagtattgagattgtcaggaatgtgtgttcatgtaaaatgtgtgatgatgacttttatcagcaagcattgatgtagtttggaagtttttccccaccaaatctcatgttgaaatgtgacccccaatgttgaaggtggggtctagtgggagatatttgggttatggagacagattttcatgaatggcttggtgtccttcctgtggttaatgtgtgagttctcactgtgtttgttctcccaatatctgattgttaaaaagagcctgatacctccccactccccattgctcccgctcttgccacgtgacatgccagcttcttttctccatctaaaaccgcaattacttttgcatcaacctaatactatgaatgaaagcttcttgaagccctcaccataaacagatgctggtgccatgcttttttgtacagcttgcagaactgtgagccaaaataaatctctttgtaaattacccagccattcagatattcctttatagcagttcaaaatggactaatacactaatacagaaaattggtaccgggagtggaatgttgctataaagataactgaaaatgtggaagtggctttggaactggataacgtacggaggttggaagagtttggagggctaagaagatgataggaagacagggcaagtttggaacttactaaagactgattaagtggctctgataaaaatgctgatagaagaatggacaacaaagcccaagctgacgaggaatttactgggaactctggagcaaagttcacccttgttacaccttagcaaagaacttgactgcattgtgtccatgttctaggactttgtgaaaggctgatcttaagagtgatgacctagactaactggcagaagaaatttctaagcaccaaagcattcgagaatgatatgactgcttctaacagcctgtgatcaaatatgggagcaaatgaatgacttaaagttggagcttataataaaaagggaaacagcataaaattttggaaaaatctcagtctggtgcagtagtaaagaaggaagaagtgttttcaggagaggaatccaagggggctgtggagcaaccacttgctagagagagtagcatgatgaaaaggtaggtaagtgccgatattaagacagtgggaaaaaggccctgaaggcatttcagaaatcttccaggctgtccttcccattataggctcagaggcttaggaggacagaatggtttcaaggggccaggcctagggcttcaactgccttgtgccgactcaggatgctgttcttctctctgactccagctggattaataaaagcatgattgtgattttttttttctttacctatatccaagtactcaggagtaggcagagttacagttttaactagggtttgctgacataatttgaattgttcagaaatgaggtggctcctttttttacactagcgtgagacagagaaacaggtggagattttgtggattttattctcattcgataatcccatggtaaaccctaaatgatcctctttctagtgacaggaccatctaggactcacagaggatacaatttgtatggaataacctgtcaagataagcagagtatcagatactgacagtccttcattgtgacctcttatgggacgccattacctggcttggttttggcctagtaatttcctggctagatggatggaatttgggtctgttatttcaggggcatatggatagaaccaataatgtaaatttttgtttgcttttcataggcaatttgtggttattaaataattacgtaagatgtaaagtcctcagaagaagtggtgcttaacttgatatatgcatccaaataacttagtggctttttcaaaaaatatatgattgctactcacttctagagattatgactcagttaactcaggatggaagtcagtgtatgtgagtttttaaaatgcttccctgttaattccaatgtgttcttctgattaagaatcatagttccagaccatttaatgttagcttagtccttttataagttttggactctccattaatgaaactgtgtagatagtttgtattgctacctgttttgcacaagaaacaagaattttgtcaggtggggtgtgtgtctggctgggtagactggagaacgttggaccatgtttctctatccagaggtatgtaccagagaatgctttgatccagaacaaaggggattatttttttttttttgtgagatggggtctcactctgtcacccagtgacagattgcagtggcacaaccttgggtaactgcagccttctcctcctggaatcaagcgatcttcccacctcagcctcctgagtagctgtgatgacagacgtgtaccatcatgcccggctaattttttctattttgggtagagacagggttttgccatgttgcccaggctggtctcgaagtcctgagctcaagtgatccacccaccttggcctcccaacatgctgggattacagatgtaattaatcctggcctagaacaaagtggatttctaacagttaggggaacttgggtttccagcaagagaaaaatgcaatcaaatgttgctctgaagtttgggcttagggaccaacttagtatttctttaggaatcatagattaagaaaatgtgtacattctctccagtgctattagtattaaggttaggccctctcctggggatggtggtgggtagaatacttgataatcacctgctgggcctcagatttaaagcttacggacttacatgtggttcactggaaaaccaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttataaaatatcaaaatatcctatttaatactcatcaaaccataccatcatgacatttgatgtgtcaagacaaagcattaatagaagatagtttatggtttattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaatttttccaccctccgtacttctgtcctctttcctttggagtctcgagtttttttcctccatttttatctccatatgtaccctttgtttagctcccacttataaagcattttgaaaataaatataattatagcataaacattttcattacaaatagaatcttcctacctggttttcatttgctttttctatttttaggtggagagagtagtaaatgattatgataaaattttataaactattagtaaatattatcatagtattttcataggatatgaagagtaagcctgccatttttttggtgggtcaatacttttcactcatttatatttctctcgtttatgtgtatatagaaagcttatataaaactttctgtagcatttaatagcaacagatttataaatgtttgcttacaaaaatatgtacaaaaagtacaaatgagactatatgtacttttccaggaacatactgttgtatcaatatgtgtattttaagtcatggtccttagagtagtgatgttctgccactaaaatagaataatagaaatctttaatttttaggaaagattaagtcaatgggtagaattttctcaatttaaagtttttcatcccatgaattataaaaagttatttaaaaaattgtgttaaaatatatataacataaaatttactattttaaatcttttttaagtgtatagttcagtgacatcaagtacatacacattgttgtgcaaccatcctgatcatccatctcagaacattttgtgttttgctaaactgaaactgtactcattaaaaatgactttactcccactttccataccttgccctctggctactgtcattctacttcttgtctatgaatttgactactcttaagtacctcatgagtagaatcataacagtatttgtccttttttgactagcttatttcactggttctgcacttgaataaatgtaagaaccactagcaaagagtaaggtagagctgtgcttctttgctgtttgtgttttacctgctcctaagcaaacagtattactgttttaaatacttgaaaaattatttatctgcatttaaaaaataacatattaatcaagatcttagataactgccggtaataccagagagcctgttgctgctgcagtgtgtgctagaggaattctgctgtctttttgacttagctgctatcacagtcctcacatcccacatgtgtaacagtaaacactggaagttattttattttctatgcagacattttagagtattatataaacaaccgcttaattaattttggtttaaactcctaggaagtgatgaaatcacattttaacaggactgaataggaaccataaaataatttttaggtaatctctgttctcaccctaagaatattaattctgccattctaggtaatgtttactctaattcacttaaaatttttcttttcccttttttttttttttttttgagacggagttttgcttttgttgcccaggctggagtgcaatggcgcaatctcgactcaccacaacctctgcctcccgggttcaagtgattctcctgcctcagctcccaagtagctgggattacaggcatgtgtcaccacgcccggctaattttgtatttttagtagagacggggtttctccatgttggtcaggctggtcgcgaactcccgacctcaagtgatccacccgcctcagcctcccaaagtgctgggattacaggcgtgagccaacatgcctggcttctcttccttttaattattagaactcttttttcctgattgactgctctggttttacccagagccaggtaggttttccccttcccattttgttattaagggacatgtgcagaggttcaggactcctgagtctttgggcagtgctgatctcactcctctgctcagcctcatgctttgtcttaaaacttaattgtctgagttggagcacttgcaaaagctctaactcaggctagtggttgggagggttctcagagacttaattgctgcctggtgctcagggcctccaggtcccactacctctggctcagtacaggcatggggaaccagccacaggagactgaccagctggagactggcaagcgtgggggctctgagctgcttccaggggccctgggacaactgcttttgagggcctcatgtctactggaccatgggatccaagagaagagcccttgcctgaaatcacaggacctggaatggggctggcagttgtacaggttggagaactgggcctggtaatccctttaggagctgtgctctgaggagctttggagtttccctggcatgtctggggtgagagtgggggaaaaaagtgactctgagggttagggcaatgacctactcacaccccacctggttttgtgtaaaaccagagcagccaatcacgagaaagcgttctaatgattgattaaaaggactgcctttttctttctttaaaccacagcaataaagggttttgctaggctaactttctcagtttggcttggcctagattttcacatggctcagtattctccacattcacatgggccatggtgtttgtggaagtgaaggattggaatttgggagaatgtggtgaggagagagacagctgacttggtgcagtatctgggctatggaacaggcactgcataactgctgatggagtcttggctaccagtagcagccggtctatcccagagaggcagaggccctgagaggcagttctgaccccctgagctgttgtgctgggatccctggcttggcatgcttaccttagaagagaagcaggctaagaaactgatctctgtctcagctaaaacaatccttcttgcatactgcagacgatccctattaggaaacagaacttccagaatgcagtccatttgtaagtttttatcattcatttataccggagagtcaattaagatcagattttttttgttaaaatataaattggcaattttagtttttaaaagatctactaaagctcaggagataatttagtgtaatagtcttcaaactgtggtatctgtatccttggtgcgtgaagactttccaagggatatgcggatgcatatagttttaagggaatcaattttcaggtctttagctttcctaattagtcttctaaaatccatctgtttgagaacagtctgaactctgtggattttctttccactcccatttcacaatgaaccatctcccatttttataaaataaaggcatatttctcacccatctcatatgttcccatggtactgtcttgtgttgtgaagatctcttaggtgtaaaacaaaagggactgtttgagaatgtgttgctcttgaaagagggcaaaagaaaaagagcttctataaaaagtattgaagcaggtattttatttcactagcttacaaaccagtggcaaaattcttatccgtcttctttcagagaactctgaagcaaaatggttgataccaggctatgtaataacacattcatttgaattaaaaattaaagtcagacttattctaatagaaaataagtctttttttatacaaggttttaattccatttagtacagtactttgtatctttttttcttttttttgagatggagtcttgctctgtggcccaggctggattacagtggcacaatctcggttcactgcaacctccacctcccaggttcaagttattctcctgcctcagccttccaggtagctgggattacaggcacacaccaccacatccggctaattttttgtatttttattagagatggggtttcaccatgttggccaggctgatcttgaactcctaacctcaagtgatctgcccaccttggcttcccaaagtgctgggattacaagtgtgagccaccgttcccggccttagtacagtatgttaaattttgtgtgtgtgtgaatcaaattattttcaagtctgcaaaaaactgtatctccacaaagaggcttaaattgctgacaaatttctggggtgataaggcagcatatttaattaaataaaagtaatgtctccaaatataaagccttcagttaaatatatcttttggaattacaaagaattaaaccacttaatttataatataaattatattactttaatatgtgaagtaagaaaatgatagttaaatatctcaactttaattttctggtatggtcagacctttacagatatttccatgctattttaactttaggatataaaacagtagcagtctactaagttttctattattaaaattagtatagaaattatcaaaatactgaaaaaactgttttatgaaagcagtacctccatcactgtaacttatttcctttcttttagaatacatcttcaaaagagaccagaatttatttaaagatagtagtttgaattttaaatttccagtcaatttttcattatctcaaaattgagctaatgaagagttgatggagttaggagaacacaggtttccaactaatgccatcaaggcagcaggatcctcacatccatgaagaccaaaagaaagatgtaatggaagagagaactacggatctgtcttccatcctaatttaaccttcaggaaataccttctgcacaaaacacttcattaaataaaaaaaattacaagacagtaagcttaaaaaaaaaaaaggctaggaccacaacttgcccagttaagtctgaatggtgatgttattggttttaagcctgaagaaaagaatgtaacttctgcttctctaaaatcacatcttcatattgggctaatttaaatttaaatcacttaatgccttaacagtgctaaaaattccaagaatgtcagacatactgatattcaaaataaagtacaaaaataagtcaaatataaatatgtttgcctgtcatgctcctctttaatttaccctgatgagctaaagttgattataattataataatatatgttatttcaagtactactattctttttaagaactcatgacctaggaccccaaaacgcaattagggatatacaatttggagtatggtttacttctcagtaaagtttaatactaattgaagtactaaattgaacaaggtcaatattttgtagtactaatcccaataacttgatcccatgcaagaaacaaaagggaattttaaaggctgttttggaatcccagaacattggggttctaccttaacttcctagtattcccttcaagtctcagttgagtgttagagaacaagtcttacttttgtcattttgacagtgaggactggctttgccaattagattatgttgtggacattttccataaattttcataaattccaggttttgatagaattctatttaaagcacatacgcaatctgaaataggttagaaattacaccatctgcatccatttaaacctataattaaacatttgagttataatttaaaagtgttcaaggcagtacattgcttttcaaaagctttgtagagacagtgtaacaacaacagaaaaatttcacaaccactgctgtagtgtagtggagaaagcctgggctctaaagtcagtcttagtggcctagtttgaatcttttctctggcaatattggcttagaagttaagttaaaaactactaagggtggctgggtgcggtggctcacgcctgtaatcccagcacttaggaaggccgaggtggctggatcacgaggtcaggagattgagaccatcctggctaatatggtgaaaccccgtctctactaaaaatacaaaaaattagccgggcgtcgtggcgggtgcctgtagtcctagctactcgggaggctgaggcaggagaatgatgtgaaccatggaggtggagcttgcagtgagccgagattgcgccactgcactccagcctgggcgacagagtgagactgtctgaaaagaaacaaacaaacaaaagttttatccagtatatctattcctagttttctaagagattttaaatttttagtaaaaactgttacagaattttatcaattgtttgcatgcattgagaggatcttaatgatttttcagtttttaaattccattatgtggtgattaacattgaagtttgaatattaaatcagttttaaattcctggattaaactcatcttgattgtgatggataacgtatttctggatttgatttactaatgctttgattaggatattttttggattatgtttgccagagagattagtctgtagtcttgtaatactgtccttgtaagttttaagtattaacattatgctgtcctcataaaaaaggatgagatgtagtccctcaaataatggtgccatttctacatttaatattgagacgtttggaaaaatttagtgataaatccatctcattctggagttttcttgaaagattttaaattatggattcaatttctttattagagataggattgtttaagttctctgttggtcatttggcaagttgagtttttctaggaatttgcccacttttaattttaaagtttattggcgtacattttttcacaatgattgtttttctgtttactctcttaatgtccataattgtacacattttttctttttctttttttttttttttttagtatttattgatcattcttgggtgtttctcggagagggggatttggcagggtcataggacaatagtggagggaaggttagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaaggcagaagaatttttcttagtatagaacaaaatggagtctcctatgtccacttctttctacacagacacagcaacaatctgatctctctttcctttccccacatttcccccctttctattagacaaaaccgccatcgtcatcatggcccgctctcaaggagctgttgggcacacctcccagacggggcggcggctgggcagaggcgccccgcacctcccggacggggtgactgccgggagggggctgccccccacctcccgaacggggcggctggccgagcgggggctgccccccgacctccctcccggacggggcagctgccaggcggagacgctcctcacttcccagacggggcggctgctgggcggaggggctcctcacttctcagacggggcggccgggcagagacgctcctcacctcccagacacgctcctcacctcccagacgggttggcagtcgggcagagacgctcctcagatcccagacggggtcgcggccgggcagaggcgctcctcacatcccagacggggcggcggggcagaggcgctccccacatctcagacgatgggcggcagggcagagacgctcctcacttcctagacgtgatggcggccgggaagaggcgctcctcacttcccagactgggcggccgggcagaggggctcctcacatcccagacgatgggcagccaggcagagacgctcctcacttcccagagggggtggcggctgggcagaggctgccatctcggcactttgggaggccaaggcaggtggctgggaggtggaggttgtagcgagccgagatcaggccactgcactccagcctgggcaacattgagcactgagtgagcgagactccgtctgcaatcccggcacctcgggaggcccaggcgggcagatcactcgcggttaggagctggagaccagcccggcgaacatggcgaaaccccttctccaccaaaaaatacaaaaaccagtcaggcgtggcggcgcgtgcctgcaatcccaggcactcggcaggctgaggcaggagaatcaggcagggaggttgcagtgagccgagatggcggcagtacagtccagcctccgcttggcatcagagggagaccatggaaagtgggagaccgtggggagggggagagggggagggggagggggaacattttttcatttctaatattgtttatttgtgtcatctgtctttttttccagcactccttttagaggtttatcaatcttgtgaatttttggtaatgttgattttctctatttaatagttgttttaattttattaacatctactctcatctgtattgtctttcttttacttttctcttttccatcttttaaagttctatgattagcttgttaatttttagcattattgttttctaatgtaagtattaagactttagatttctaaataccaccttagttgcatctcatatgttttgatatgttgtctttttattattattccattctaaatgccctctgctttctaatttttatttttgacctgtgaattgtttagagttatgtcttaatttccaatgcttttttaaaagagccattagtttaaaatattttttatttgtatcatactccagtatttaagatttaaaaatgttctgtatggttttcaaaatagtatttcttcttgtagttgtattgcatttgtgtctactagattcaggttgttacttagattgttcaaacttttgtatgcttcacttatcaattactgagacaggtgttaaaattacctagcttaatggcaagtttgccaatttttctgtgtaactcttgtcagtttttgcccattttatacattgaggctaggtcagttaggtatataaagtgtagaatttctgtgttttcctgatgaattgcacctttttctaatgacagtcattatctgtagtgaagctttttgccttaaagtttcccctttctcttcatattaatataaataatatacctttatttggatattatttacctggtttatctttgtccatacttttattttcattctttctgtattcttgtgtttggatagtttttggaaacagcatataactggatttttctcctgtggtgtgaaatctttgtattttaatggagcagggaggccatttagatttattataaatacagatttatttggatatatttctaccatttaaaaagctttttctatatttatttttccgtatgttctcactgtcttttagattaattcagtatatttgccagatttaattttcccctctagttgtttggaagacataacacttcatttctcttcggtttgagactgcccagttgaaatttccacatttaagttatgaaagtaatcactttcttttatgctcttcctaaggatcctctcctgtgacttctagtctctgtttcttttaatttagaaaaagataatctgattggaatagtttgggtcaggtgcctacttttggatcatagctattataaggtgtggaaggtggagaatttttgtggagatgtggccactggggggttcctttccttcactccttgcatctctactaccctattcatgaactgtatattgttaacttttatcagccattttaggagatatatactacggaattgctgcaaacccaaatatatgtaattccatagtctttctgtaagactatttctctcaaatttacagggtgggggaaatactcttccttttttttttttttttttttttttttggtgtatacgaatatttgaaaactatcaaaccaggaaacacctccccccaccaccacctcccaatcccaaacctgtcatctctcattggctaagctgttccaagagctttgggttatttgtgttttttttttttttttccttgtttcttccattcttttcctttggtgcttatctgagaattcctacggaactttgaggaagtgtcatcagtatttcacagttagaacgaactattgtcctaacatttcatggaggttcaggaccatggacagatcacatgtgctacctgtctcagtcccacccacatattttagcaggttaaaatattcttctgaagtctccactggcatcattcttttccttataagttgaactcctccctatttttatcagtcatcttacagccaggtcttgcctctttaaagttgttttgttgttgttgttggtttttttttttttgagacagagtttcgctcttgtcgcccaggctggagtgcagtggtgccatctcggctcaccgcagcctcagcctcctgagtgtctgggattacaggcatgcgccaccacgcccggctaattttgtatttttttagtagagatggggtttctccatgttgtcaggctggtctcgaattcccaatcctcaggtgatctgcccgccttggaggcgtgagccaccatgcccggccttttttttgagacagagtctcattctgtcacccaggctggagtgcagtggtgcaatctcgactcactgcaacctctgcctcccgggttcaagcagttctcctgcctcaacctcccgagtagctgagattacaggcatgcgccaccatgcctggctaatttttgtatttttggtagagatggggtttcaccatgtttgccaggctggtctcaaactcctgatctcaccttaggtgatccacccaccttggcctcccaaagtgctgggattacaggcgtgagccaccgtgcccaacccctctttgaagtttttatctcacttatgtataaaatacttatcttgccaatacgtttgagttagtaaatagtttagtctctgcaaagaaatggagaattagataggttaagtaacttatttaatgatggagccaggttttgcagtcaactttttctgactctgaaaccatatctctcaattacttgatatacttcattaaaaaaataattattctgttcattatactcttggtttatgactttaaaaatatgttttaaaatcaacttataatttatttttgaaattacagggccaggagcagtagctcacatctgtaatactagctattagggaggctgaggcagagggtcacttgagaccaggagtttgacaccagcctgggcaacatagtgagatcccaaatctaaaatcaaaaacaccttacacatttgcccaattttctattatagtgttcttttttttcttactatattgtaagagctccttgaattttagggatagcaaccctctgaccatcatagattacatatatttcccccatttgtattttttctttttaacttagagtatttttaaaaataaaacttcagtacataataaaactatcttttatttagttaaatcttttcctttagggtttttcttttggcattctgtttagaaaacttcttccccatccaaagaacataaaaatatccaattctgatatatctgtggtatatgtaggttacttttagattgtctatattggaactgataattttagaacacactttaagagcagtagggtaaggaccttaatatttctttttaaatgttttcttggcttttctcctacatttattcttataggtgaccttaaaattatctttacattctctttctttttccaaaatctaatttggaagaacttttaaaaagataaacaaagtggccaaactttgcttttcacttttgtcatattttaaacatatgaaagagttaaacattaatttataatagtgttcttaccagctggatagaaatacatttacttagtacctatatttattttttctttctttgtaatttatcttctaggaagctattttgtaaaatttatggtgaaccagttgttgatttatacattattagtggtgtgataactgaggatgctcgaaagaaggcatgtaatgagattgttgctatgggaagattgagtaggtaactacccagaatgtttcccatttctagtacaatatctggtattgaataggtgctcagtaaagagttaaatacatgaagagttaaatgaatactgaagactttttttgggtgaatttactaagctcgtaatttcagccttattgatcagaatcagagatacaagtatattcagtagtcttatttataggaggcaaagtagatgaactagaatgccagttaggaatttccaataaagaatatatctatcagccatcagagtcatttgtatcgttctccccactgcttttttttttcctacaggaaaaattttatcagatgtttacttgaagaatgaaactggaataaggatagctactttagtgaatttaagttctgatagcatgataggaatgatgtgccaagtggattaatatttttgcccagtgtttaacatatccctctactgtgcacaaaagactgctacctaaatttctcactcacagattttctctactgataatatctgcctcctggccacgtactttctttagctgtgtcattagctcaccattagatcttgctctgatttagtcataattatttaaaagaaaatacacaagttgtacatgaatatatgtttatttaaaaaacagtataattaacatttattgagccattttatgcaccagatatcacattaagtattatatattcttatttaattaaaaacccatttttaacccattgagggactcaaacaggtacttacatgccagtgttcatagcactggcatgtaatagccactcacaatagccaaaaaatgtaaacaccccaagtcttcattaacttgtagttggataaaatgactgtagcataagcatacagtggagtattatttagccataagaagagtgaatttctgacacatgctgtgcaacatcactgaaccttgaaaacatgcctagtgacataagccagacatacatgattctggttatactcagtatatagaataggcaaattccgtagagacagaatgtagattagtggttaccaggcatgggatgtggtggtgggtcggggaggggatggggaattattgcttaatgtttacagagttctgtgtggggtgatgaaattgtagaaatagtgatcctaatgtttgtacaacattatgaatgtaactaaagctactgatgtacacttaacaatagttaaaatggcatattttatgttatgtattttttccacaaaataaaattcaaacaactcatgacctaggttctactattatcaccattttacaagtgaggtttagaagaaataagtaactagtatgagttcatgtagttaagtgacaggcatctagacttgaactcaggtttgtctgaccccagatgccatatttttaatcaggtggttctctgctttcagaaataaaagtggaggtgccgtctttcctattccttatttccattcttttgcacagaaattacttctgattctttgcttaattgtttgacatgtatccttttagaccctcttcctatgcatttacttaagtatttatgtgcataaatgtgtacaactttttcattaatttacatacacagcataattaacattgtttatgtgactgcttttttcatttaacagtatgcattagagatgtttctattaattcatgtgggtctacttcattttatttgctgcatatgtttcattgtatggatatatgtgggtatagtgttttgtggcatggatatcccgtaatttatataccatttcggtatttcctaggtagtttccagtttttcattctaacatacagtatttcagggcttatacatatactcagaagtggagtttttgggcaaaaggaatgtacatttaaaatatttagttactgcaatataatatttcttccacttcaaaggataccagtttaaacttctaacattgggatatgagagtccttgtttcctaggaacagagtattatcagtcttttttgcctatcccatggtcagtaattgatacttgttacattagtataaaaatctctgatttacttccagatgttagacattttccatatggttttcttttgttttgaattgccagtgcctatttttctaatattaatatttctcttagtgatttgtaaaatctgtatgttctatgtgttaattttttgttacgtaaatatttgttacaaatatatttttccaatgttgttttatttttcttaaactttgttcgtgttatcttttaccttacaggagacttaagttttcatatagataaatcttctttttattattaatacttctggctataaggctctgtgttgctaaaacagctttttccatttcaatgttatgtgaatatgctccattatattttcctagtattactgtagattttaaaaaattgtttctctaattatggcattattttttgagtcgtgtgagctatggattaaagtttttttccaaatagttcatctttctcccactcatttaaaatacctatatctgagcccatttctgcttcattgttctattggttcaggggtcagcagactgacacacaagacaaatctggcctactgccttgtttttgtaaatacagatttattggaacatagccccacctatttgtttacatactgtttttgttttgattatgcaagggctgagttgaatagttggcacagagactaaagagctcacaaagcctgcaatatttactgtggcctttacagaaaaggtttgccaacccctgaattagtctcttttctaataccagacttttttttaaataaaaatatgaatatgggctgagcccagtggctcgtgcctgtaatcccagcactttgggaggccaaggtagatggattgcttgagcccaggagtttgagaccagcctgggcaacatggcaaaccctgtctctacaaaaaatacaaaaattagccaggcgtagtagcatgtgcctgtagtcgcagctacttgggaggctgaggtggaaggattgtttcagcccaggaggttgaggctgcagtgaaccgggatcacgccagtacactccagcctgaatgacagagcaagaccctgtctttaaaaaaaaaaagtgtgtgtgtgtatatatatatatgtatatatatatatacacacacactatatatatacacatactatatatatacacacactatacacacactatatatacacatatatatatacactatatatatacagaaaaaagtatacatatatacatacacatacaaaatacacatataaatgtgtattaatgggtatgtctgtctcctccccatatcacaatattttattttatttatatacaccctggtgggggcgtgtgtcttttcctaccagatatcaaaactaataaattatagtaaaaatagagtctggtattggaaaagaaaccgactaaaacagaattggcaaactttttctgtaaaggctacaataaatactttggctttgtgagctgcaccgtctgtgtgccagctattcaactcagcccttatgtcgtgaaagcaaacgaaaacaatacataaacaaatggatggggctttattccaataaaaacacctgtgttttaaacatttttcatgattattctgcatttccttttgcacctgaacttcagaaatagttaacttcaatcagataccacattaggctttcttttaaggtgaacttaaaaaaatgttacttttcagagattacattttatctacaattttgccattttaaaatacttgattaagtaatggtactagctccagtgcctgggacatggtaggtgtacaataaatacgtgctactagtatgaattgtccaagattctttctcccatgtcttttgtctggtgatatggtttagctctgtgtccccacccgaatctcatttcgaattgttaccccctcgtattgagggagggacctggtgggaggtgattggatcatggggccaatttcccccatgctgttttgtgatagtgagggagttctcacaagatttgatggttttaaaagtggcattgcccttgcttgctctcctgctgccttgtgaagaaggtgcttgcttcccttttcaccttctgccatgattgtaagttttctgaagcctccccagccatgtggaactgtaagtcaattaaacctcttttgtttataaattacccagtctcaggtagtatctttatagaagtgtgaaaacagactaatacactggaaaatcgcctgtctgatgggtatagatattcattagcaggcatctatcaccttttatctgataacatctatgtgagttacatacatgacatgatatagattgggttgtacattttttaaatgcttaagggccagcaaacattcctaaaacattaaaatatagtaatactattccttcccctctcacaggtcttctagtagatgatcttatctaagctttaagagatcactggattcctaaagtgattttattttgtagaattatgtattctgttatgtattttagtaacagattagaactaaattggatatagtagggatttcattcataaattatcattcaacactaaatgcaaattcttggctgaaggagcttatagaaacaaaatctattttgttataaaaatgcataaattaagcattttcttagtaggaccaaactttttgtgatatgttagagtgactaacttttctttcctaatcttataatatccttctatagacatttaaagctttacttctttatgccttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgctacctatcttcatagtttgttgtgtgtcttggacaagttggtatgcaaaacataaaatgtcaagcttgttaaatggagttaatctgaagattatgagtcctattctgatagcctaattgagaaaaagtgccacaaacgtgtagtttcaatttacagatgcagagataagttataaactagtgataaacttggcaaaatttccaggtaagattatctttcactggatagaattatattttgacttcatgcttaatattttttaagagcatttgcttggccataacaatacaactaacagtgatcgaaaacacaagaacatttattactaaataagtcttgaggcaggcaatcccagggttggctctctggctcagcagtgtcagtgttagattgccaggtctctgaagctcttctgtttttcctttcatggttgcaagacagctcctaaaagagcgtatcatcatagtaatatatagagtagagagagagcattcgagaaagggctttctccttgttcttcttactcattaaggaaagaccctagaagctctcaggccctttctattactggtcaaaataatataaagcaagtttcacacagatgcctgaccaaacaatggaaaaggggaaagggcttataccaattatactggcatataccaattataattcatcatctggggtaaaacaaattgccactacccagaaatagggtctgtcaatgaggaagaagggaagattagttgttaggtaactaggcagtctgccacatacgatattcatttgtttaagtaacttacaaagtaacaaggtttaaaatagtgaacaaagcggacttaatccccggaattcttgagtttttttctttctctgtttaagagatgccatttttgttgggatattattatgcattttcttgtctcctgaatgcttataagtgttagagttcaaacgaggaccttctttggaccatcagtttttaaaaatacattccttagaagaaaaacattcacttaaaaatgttttatttttacaattatgtattagtatttctagtttcagagagaaggagaaactagggtctagaggataatatacccaagttcaaatagatgggaggttctaattgtaatatcagttaataatttttgaatcttttttttttttttttaagacggagtctcgctctgtcgtcaccaggctggagtgcagtggcgtgatcttgggtcactgcaacctccacctcccggattcaagcgatactcctgcctcagcctcctgaggagctaggattacaggtgcatgccacaattccgcccgccttggcctccctcccaaagtgctgggattacaggcatgagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctggaatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggccaagattaagaatatgtacataatggactggcatatattttatttctcatgttaaagcctcttaccttgaaattaaaaaatttttaaaactggtaaaacttagggcaacattaattaatgtatactcttaactgaattgttatactttttgaaaatcccgtgacttgcttgtttctctccactccaactaaatcattaactctcctaaaatgtatgtttcattctagtaagaaaacctcaaaggatattgtaggatataaatcttatttgaaaatatagccattgaaatgttttggccttttggagttggggaatgacaaatctgatcctggaatctttttcttttcagtaatcccttgtgtctgttgcctgagggacatggacaataaagcagtacatgatcctcagatacagggagaaggacaaggcatatagcttatttattagagccagcaagcatctgctcattatgtttggaattgctttctataagaaaattttgccctctactactaacttgaccaaaaatgaatttaaaattgcctgtgaaataacatcctctcaaatgtttgctgatgaaattcaagttgaaatgtattcattgcaaaagtctataaacctgtggattatatattcaaaataagacaaaggcaaataaaaagcagctgtcttcatgaatagacaaaagttgctttcaggaagtataaattatattctgcactgaccaaagaatagaagttattgcatctgtggaacatatatctggagttactatactaaagagcagggcatgaatttagactaaaatccatccagattacactcattctttaggccactgctggatacttcatttacatttgattcttggctgggcacggtggctcatgcctgtagtcccagcactttgggaggctgaggtgggtggatcacctgaggtcaggagttcgagaccagcctggccaacatggtgaaaccccgtctctactaaaaatacaaaaattagccgggcatggtggtgggctcctgtaatcccagctacttgggagcctgaggcagaagaatcacctgaacctgggaggcggagactgcagtgagccaagatcatgccattacactgcagcctgggtgcagagcgagactccgtttcaaaaaaaaaaaaaaaaaattgattctcaaggtaatgagatatcagcaaggtttgtcttgtatagtgggcataaaagaaaagttctaaattgcctctgcaatgacttgtagtcagtggaagagtatcattttccctgatcatgaccactatgctgtaaattgatataaattaactttctctggagttacacacaaataacgaagatttaagagaaccttggctgaaataaatttccagttgtttggaggctaataaataccatgcaggtgtaaccattaaaaaaattattatataaactactatattatgtaaactacaatattttagcttttctgtgtgagaaagtgatttttgtttgtttgtttgtttgagacagagtcttgctctgtcacccaggctggagtgcagtggcacgatcttggctttctgcagcctcagctcccgggttccagtgattctcttgcctcagcctcccaagtagctgggattacaggcgtgtgccaccatgcctggctaatttttgtatttttagtagagacgagatttcaccatgttagccaggctggtcttgaactactgacctcaagtgatctgcccacctctacctcacagggtgctaggattacaggcatgagccactgcacccagccaaaaatgatttcataaaaattgttaaaaatctgtagctgctttgttaccttcattaactctttgtgattaaagttgcaagtttattgcagtaatgggaatgtgttagattaatgtttaggtgagttatattttaaaatctgtgtagtatatttatagttcacccagtaattagaacaccgtatcttaattccttattgttcctctagtgtgtcacaggaggtagagtttattgatgctgggattgcggatgtgaaaataacattctcagggtatcttatgacttaaaaggccgattttttaaccagtgatattttctgtgattgtctataatttggtttaaatttatacttaataagggccagaatacatggctatattcttagtatcctttagaacattatttcttagtcaaagtttatgaggcatctagcaacattttacatgatatataaaattggaggtaaatgtgctttttcttgggaggaattcatagccttaaactattcttggaggagtgtatgattctctctctgtactttcccctgtttttcaattattgcttcagagtattttttttttaagtttgagtactttaaacagcatagagaagtaaatcagtgacttaaaaattcattattttgtcctatatgcacatgttaatatatcattacatttcagtggcagtatttttcatttcttgttttacttggttaattttcaaatctctgttctttcattatttgtatttcttctatctcttgaatcattgttacccacttcatggtatttttcagattgtattattctcttgagttcttgagggtactaatcttcccatttgttttgattgccaactttccccattttggtgttctatttcctcatttagtttaattttttttcaattgtgagctcacttttgactgaggtagatttttctgggatgagttcctttccctctgaatgcttttgcttctgtgggataggaactagatttaatattaatttcttggcagaggatttctttaccacatgggcagtatggattcagactccaaaccctcatgttttcctcttatgctgccccccaccaacaccctaggttgcttcactggacaagaatcagaatttttattattccctgacatggggaaagggtcctggttttaatgagaggtaatcattccagtcctctacctctgttaagccaccagcaataccttcattcgttgtggatcgaatgatccctaacaggcacctgttagggcctgtgtccaggacttttgcttttgcagcatctattcctgtgtttaaagttttgattatttttctttatttctaattcttggggatttctcttcctttcttctccttcattagtttgattgtatatttaaaatctctcatggttgtttgttttatttagcatttctatgtgtatttgtgtatgtgtgggtctgtgttactgcttactgtgttgtcaagcccatatatgcacaaggactattttgaaactttgtttaataataactcaggctaggtgcagtggctcaggcctgtaaccccagcattttgggaggccaaggcaggcagatcacctgaagtcaggagttcaagaccagcctggccaacatggtgaaaccccgtctctactaaaaatacaaaaattagctgggcatggtggcacgcacctgtaattacagctacttaagaggctgaggcatgagaattgcttgaatcctggaggtggaggttgcagtgaggtgagatcacaccactgcactccagcctgggcaacagagcgagactctgtctcaaaaaaaaagaaaaactcaattattctgttaaaaaattttaatatgaaagatactggtgcttaaaggtgaataatactgtttttaaccttcatgtgtctgtgattgtaaaaagtctcaaatataccacctgtaactttgttctttgtatattttaactcattaatgtatagtcacagtattacagaatttagacacagagcctggcataattgataacagttttaacatggctttattaactactcttttctcattcttccctattctcttctagtctcccttttgcatggattattctcttttcctgccctactgttggttccagattcttatgttattccattgcagataagggagaagaagaatggtagaatggaaacccactggagaaattcgagacgaaagagaagaaggaaaataatgggtgaagggaaggttaaaatttcttgctccagcactctctgttctcttccaggccttatcttactccttcagactctgtcttcatttctcatcttttcttctcacttatgcctctgcctttccactctctctttctattggacactttctttctgacaccatggtagctatcactagtggcttgcaatctatgttcctaccacctggccagtagttgtagggaggaaggaggttggatgggagaattgaaggagactctgttgttggatcttgggctacacagagtagggagaaagatgtaccttgcaaggtataccaggcattttgtattggaactttgagttctttttcttctagaattattcatttatctgttcattaaacagtaaacaatgaaccccaggcagtgttttaggaactcacatagaaacatactttgttcttttcagtttcagagatcttttttatttaacttagaattatttcacttttgaatctcttaatttcagcatctgtatttatttcaaaccttttgggaataaagaggcaacttgttatgttggaaaggcttttggagcctgatagatctgagttttaatcctgtctttgccacttactaggtatttaatattcaggaatttatattatctttctaaaccttttttttttttttctgtaaaatgggaagttcttagtatggtacttggcttagatggctcccaataaaataatgcctgctaagattattattatcacacagaaagtttgtccttagtaccaaatcaattttttttgtttttgtttttgttttgccaagaagtacttttaaaactagagtacattaagacaatgattaaaggattctgttttgtttatttttatatcacattcttgaagtttggacaagttgtcataatttacataaaactattacttctaagctattacttctaagttggtgtgtccttctctgagctagcagtgtcatagtagtactgtgacttactagtcaagtttaggccagcaagtcacatactatgtttaggccttataatattaatgagggttaataatatgtaccttatggattttatgataactaaattacgtattagtttggaagctaaccgtgtctagttgtgagctaaaaaccaagtatttagtgtaagattcaggcttgttcgggaaatacaaggcggggatgcaatcaaatgtcaggaatcgccagaacaccgggaataaggaagctatcggaacacttccttttctcattgtctttgcctttctctatgcatctgctttgtttttctctttcattatgtggaactgattttctcttttgcttttagagtcatagtaggatgtttgcctcaacacttgctgagtttgtatgttaattcttgtaatcatctgcagagactgactctgagttaggtttgaaattacttgtcccccagcttaggtcagatttccatattggttcagttaacactggccagttaaatggggcctcacaatatgcacttggcccacccctgagaactgagggggagattttcagaaaaagggagggaggcggcgtggcagatacctcagaaagtgtgtgccacaagtgaagtcatttaagtatacagcactgaagaaagtcaaggtattgttatcattagatgatgtagtactttgtgaaatatcactaatagcatctattcagaatagcatgtcatttatctaccagcgcaacagatctgattagtcccttatatgcccttgatttttgtcaagggcagtagcgtagtgattattatatctttttcaattgttgtaatgaatataaagtcttttgcaatttgtcttttatattcaaaattattttaatcatagagtgtgcttgaaatgaactttttggtggatataatttttaagaacatatctttgtataaaagcacttttgttaaatattgctaatgaacttttttcaggaataagttgaacgtataatcagttttttttcaaatgcagcatagaaataagaaatattcaagtaattgatacatgattcttttggttctatcattgaatttctgaactctcagctataacttgttaaggcatcttttaaattatcccagacattatgaatggagtgctcagtaatgatttgtataacccttagctttgttttgattcattttctttatactacttagggtatcatcatatgacaagataactgtatacccctgtatagacacttaatattgttaatatttattgttctgtgttcatatttaccccaaattagaatagtcaataggtataatttacctgaagtgtcagctctgcagcacactttttctgaatttctgatttagtctgggtgggggagctaggtttcggtttaaggatgcctttgttttgtgattttgtgatatagtagaaatcaaaactgcttttaagtatagaagactggtgttacaattatttggggggatagtcaggctcccattttcagttcttttttttttttttttttcccggacagggtttcaccctgttgcccaggctggagtgtagtggcgccctctaagcttactgcagccttcatctcctgggctaaagtggccctcccacttcagtctcctgagtagctgggactgcaggcacaagccaccgtgtctggccgatttttatatttgtatttttgtagagacagagttttgccacgttgcccacgctggtcttgaactcttagactcaagcaatccgtctgctttggcctcccaaagtattgggatacaggcgtgaaccaccacacccggccccatttttagttctagtaggtctgtatgtatctcccaccttgtcaaacttgtgtgtaattttttttaaaaaaggtttcacccaccttgtcaaacttgcgtgtgatttttaaaaaagttttcttccttttttttttgagacagagtctcactcaatcgcccaggctggagtgcagtggcataatcttggctcactgcaacctccgcctcctgggttctagtgattctcctgcctcagcctcccaagtagctgggattacaggcgcccatttactaccatgcccatttaatttttgtatttttggtagagacagggtttcaccatgttgaccaggctggtcttgaactcctgacctcaggtgattcacccgccttggcttcctacagtgctgggattacaggccactgtgcccagcatcttcctattttgttttaaaacagctttactgacatgattgacataccaaacaattcacctgtttgaagtatacaattcagtggttttgatatcttactaatttttaaaaattgtggtaaaatacatataacaaaatttgccattttgaccacttttacatgtacaattcagtggcattaaattatatttataatattatgtaacaaccatcacatagctgtctctaaaactttttcattatccaaagagaaattctgtaaccattaagccataagttttcattctcctgtcccccagcccttagtaacctttaatctactttctgtctctatgaatttgcctattctagatatttcatttaagtgacataatatatttgccttttaatgcctgtcttactttacttagcatgttttcaagatttatccacattatagcacgtatcagaccttaacttcattttaaagctgcttaacatactggtgtgtgtgtgtgtgtgtgtgtgtgtgtgtgtgtgtgtgtgtctgtatatatatatcacattttgtttatctgttcatctcttgatggacatttggataatttccaccttttggctactgcgaataatgctgtcatgaacatcattgtacagatatctgtttgaatctcttcttttgattctcttgggtacataggaatggaattgctgggatatgttggtaaatctatgtttagctttttgaggaactacccaactgttttacaaagcagcagtaacattttatatcccctctagcaatgaatgagggttccagtttctccacatcctcttcatcacttgttattttctgttttatttaattaatttaaaaaattcagctattgtagaggttgtgaagtggtatctcattgtggttttggttttcatttccttaatgattagtgatgttgagtatcttttcatatgtgttttggccatttttatatatcttcatatatatattattttacttttaagttctgggatacatgtgcagaacatgcaggtttgttacataggtatacatgtgccatggtggtttgctacacctatcaacctgtcatctgtgttttaagccccgcgtgcattagttatttatctaatgctttccctcctcttggcccccaccccaacaggccccagtgtgtgatgtgcccctccctgtgtccatgtatgttctcattgttcatctcccacttatgagtgagaacatgtggtatttggttttctgttcctgtgttagtttgttgagaatgatggtttccagcttcatccatgtccctgcaaaggacatgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgatagggattgctttgaatctgtggattgctttgggtaacattgtcatattaacaatattaagtcttcttccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtgtagctaaggactacaggcatatgccaccacgttcagctaatttttttctctttctcttctctgttgtgtcaattccagatagaaatcctctctctctttcctttccttacaaaacacaaatacagaaatccctagtggacttgactaagcagtgtggaatacccgttttcgaagctagttagagctaaatgcatacttttagatcagagcaaactgtatgacctatctgtttcactcccctaatgctcaaatatgtatctttgatcttatcacactctggctccatggaaggaagagagaagacagctacacccatgtattatgatcctttaatcatatcagttcctttttgtgttagaataaagagggacctgaggagaggaaaggagacacgtttaaacttctcttagaggcagcagaatatgtaattgctctaatcattaaacatttttaatttaccagttaaaattattaataagattacatctaaattcctttaatgaaattcaaagccttttccattttctagctcttatttctttgcatttcttctcacaattctttaccatggattatttaccattaacaccccaaattcacttcctcgcctctcttcatttgcttatattgttccctcttgcctggaatatctacattgtcaaacccaggcaaagcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaacgcattttaaaggaacaaatgaatgagcgtgaaagaaacatgagtttacttggtgggaattgctgaagagctctctggtgccatgaaatctgcttttattttttatatctttgtgttaaaatatatatttaatgctgatagaatgttaaaactggtctcatttttacatcccccttgctttgcattcttttatatgttatttggagtttaaacatacatttctcaccaaaaatgtaattcatatgtaagaaataaaagaaaatatattgttttcttagggaaattaaatctgtttattctcatatagtttgggatttttaaatattttgacaattcttaaatcataatttgaatttttgtgtaactaagaaacaccattatttatatctaatttgcatcacattttattaagaaaataattgatattgctctttcatttcagctaaaccatttacttctaaagtgaaacaaatgcgattacatagagaagactttgaaatattaaaggtgattggtcgaggagcttttggggaggtaagagattaagatttgatagaaggtctgctaattattttggaagctgttgaacacaattgtgagagaatttaacaagtattgttacttgttacttgttaaacaatatttgttaagttgtgattgatgtgattgattgtgctgttgtgattgatataatagctcagaaaataaagtgttgaatgaaatatttctactgggaattttttctaagatcatgttttcacatgtacttcatatgtcaatgtaaatatgagtgtgtttctagactcttcttttgttctgttggtctgtcttattctagtttataaggaatcttgatacctggtagtgtatatactctgacttcctttttctccccctctcccatctctcctcccctgatattttcatagtattttattttatgtatgaatgtatgtatgtatgtatgtatgtatgtatgtatgtatgtatttatttatttttgagatggagtttccctctgttgcccaggctggagcgcagtggcatgatcttggctcactacaacctccacctcccggattcaagtgattctcctgcttcagcctcccgagtagctgggattacaggcgtccgccatcaggcccagctaatttttgtatttttagtcaagttgggtttttgccgtgttggtcaggcgggtctcaaattcctgacctcaagtgatctgcccaccttgtcctcctaaaggatattttcatagtattttagaatcagtttttcaatttcgactcacttgtaaagatacacatgcacgcgcacgcgcgcgcgctctctctcgctctctctctcgctctctttctctctctccctcctctctctctcctctctcttctcttgtctcctctctctctctcttttttccaggaatttgggtaaagtttgtattgaaactggagatcagtttgcagacaattggcattttaacaatactactgagtcacctaatccatagacgtggtatattcttccatttatttagggctttataaatttatctcaataccgttttgtagtgttcattcagtatagaagacctccacatctttcagcagatttattcctggatatgtgatagtcttgatattattttaattagaattgtttgtgaaatttcatttcttaattgttttcttggtagtagttagaagtagaatttaattttattgatcttataccttgttatacttttcaaataggaattttgttgaattttattaatactttatctgcatcttttgggacactcatggtttttctcctttactttgttaatgtgttgaattatgctgttatattttcagatgttaaacaatctttgcattcctaaaataagcccaactgacttgtgatatgttaccccctttatatgtaccaacggacttcatgtgctttttgtgtgttgataggatctttgcacctgtgttcttcagataaattggcctgtaattttcctacttcgaatgttctgatcagattttggtatcttggttatactggtcttacaagaagagggaaatgttccctcctttagtattctccagaagagttagtgaagattgttattatttttttcctgatatgcttacaagatttaactggtgaagcctctgagaccagaggttgctagtgaaaaagttttaaataatgtttaatttctttaatggaaataaaatgacttgttctgtgtatgtattagttttgctaggtttatccatttcatctaatttttaaaacttgttactgtattgatcatttctctctctttttatttttcttgctaggggtttatcagtttattatcttttccatgaattaacttttggccttttgaattttgttattgtagatttgttttctggttctttaatttctgcactttataatattttctttggttttatcttgctattctttttctgatttttcaaaatagcattgatatctagcccttcttttcaaacctgtgtttaaggctatatgttttcctctaagcatttttagctatagcagacatattttggtatgtcatatatatgtatatattttttgcttaaaatacagtgtgattttaaatttttgtttttgatctatgaatttaaagttcattaaaaaaatttctaaacatttagaaaattttctagtttttcttattgagttataatgtaatttaaaagtggttagaacgcatactctatgtgattagaatcctttgaaatttgctctgcagtgttctgtaaatatcagttaggtcaagttcaaaatcttgtttaaatcttccatatccttactgtcatttcctgagggaggatttctttatttctttcagtttttgctgataacaaatgtacagttattatatcttcctggtgattaactcattcgctattatggagtgttcccatgatctctatagtgttttttgatttaaattttccttaatctgatattagtggaactactccagctcttttttattagtattttcattaaatatcttattctgtccttttcgttttagctttctataagcatatggtatgtttactgttcagtagaatataattagattttgttttttaatcagttaacatgtaatgatgttactacttgttttatatttgttttgctcattttgtgttgtttttctctcatttcttgcttcttcttcgattaatggaatattttaaatcatacctcccaattttatcttcttttatgtgttcccctggcaattaccacatgtatccttggtaaatttatattttgccaattcccatttacccaatttctaccttttttttttcattgctgtcatatattttagttccatttatatttgaaaccccaacatatatattgtacctatttatttaggtttacccacatatttgtattttctctgctcttcacattcatgtacttccctttgggatcattttccttttgacttaaaaattccctttaatagttctttttaatatttagagacaaagttttgctttgtctctctggctgcagtgcagtggtgtgatcatagctcactgcagccttgaattcctgggcccaagtgatcctcctgcctcagcatcctgggtagctaagactatagctgtgcaccagcatgcttggctaatttgtaaattttcttgtagtgacggggttttcctacgttgcctaggctggtctcaaactccaaggctcaaggagtcctcctgcctcagcctcccaaagtgctgggattacagttgtgaggcactgtgcctggccctctttagtatttcttcagtgtaagtctgctgataacaaattatctgattttatttgtctgaaaatatattttttgaggtcctaaaattaaaaaaaattgaagtatattatggtatacacacacacacatacacacacacacacacttcagtttcaaaaaatatacacacatataactcgatggatttttacatttttttagggtacaaaacaagcaatagcattttattgttatgccatttgaccatagcattctttttttattttttatttttttatttgagatggagttttgctcttgtcgcccaggctggagtgcagtggtgcaatcttggctcactgcaaccactgccacccgggttcaagtgattctcctgcctcagcttcccgagtagctgggattacaagtgcccactaccatgcctggctagtttttgtatttttagtagacatgtggtttcaccatgttggtcaggctggtctcgaactcctgacctcaggtgatgcacccatcttggcctcccaaagtgctgggattaacaggtgtgagccaccatgcctggccttattattattattttttttaatttttgtgggtacatagtaggtttatatatttatggagtacgtgagatattttggtacaggcatgcaatgcttaataattgcatcatggaaaattggatatccacgttatttcaaaatggacattcaagcatttatcctttgtgttacagaaaatccagttgtactcttagttatttcaaaatggacaactaaattattattggtcctttgtgttacaaaaaatccagttgtactcttttagttatttcagaatggacaattaaattattattgactacagtccccctcttgtgctaccaaatactaggtcttcgtcattctgttttttttgtactcattaatcatccccatctcctttttctccacatcctcaccagcatttgttattgcctgccttatggataaaagtcattttaactggggtgagatgatacctcattgtagttttgatttgcatttctctgatgatcagtgatgttgaccacttttttcatatgcctgtttgccattcgtatgtcttttttatagaaaggtctattcaaatctttagcccattttaaaaattggattatcagattgtttcctatagagttgtttgaattccttgtatattctggttattaatcccttgtcagatgagtagtttgcaaatatttcctcccattctgtgggttgtctcttcactgtggtttgattctgtctcttcactgtgggttgattgtttcctttgctgtgcagaagctttttaatttcgtgtcatcttatttgtccatttttgctttggttggctgtgttttaagaaatttttgtgcagaccagtgtcctggagattttcaccaatgttttcttttagtagttttatactttgaggtattagacttaaatctttaatccattttgatttgttttttatgtaaggtgagagatagggatcaaatttccttcttctgcatatggttatccagttttcccagcaccatttattgaagagactgtcttttccctaacattcttggcaccgttgttgaaaattagttccctgtatgtatgtggatttccttctgggttctttattctgtttcattaatctatgtgtctgtttttatgtcagtaccatgctagtttggttactgtagctctgtagtatcatttgaagtcaggtaatatgattcttccagttttgttctttttgcttgggatagctttggctattctgggtcttttgtaattccatataaattttaggattattttttctatttctgtgaaagaatgtcattaatactttgacagggattgcattgaatctgtagattgctttgggcaatatggatattttaacagtattgattcttctaacccatgtacattgaatattttttcagttttttgtgtcctcttcagtttctttcatcagtgtttcatcagtatattgatgtatgtgtgtgtgtgtgcatacctcacatgtatgtttatatacttcaattaaaaaatacacatagataacttgatgaatttttacatttttttgtaggggacaaataaataatagcattttattcttatgccatttgaccatagcatttgtgttctgtagttttcactgtagacatcttttacttctttggctgatttaaatcctaggtatttaattttatttgtggctattgtaaatgggattacttttttcatttctttttcagattgttcactgttggcatagagaaatgctactgatttttgtatgttgattttgtatcctgcaactttactgaatttgttcatcagtttgaataagtttttttgtgtgtgtgtgtggagtctttaggttttccaaaatataagaccatatcatcttcaaacaaggataatttgacttttttctttccaatttggacacctttcattctttctcttgtttaattgctctagctaatacttaaagaactatgctgtacttgaatattgatatctttctctagatttggaaagttcttattatccctttaataaactttctactcttattttctctaccttctctttaaggtcaataactcttagatttaccctttgaggttgtttcctagatcttatacatgcttcattctttttcattcttttgtcacctctgtgtattttcaaatagaccattttcaagctcactaattcttgcttctgcttgatcagttctgctattaagagactctgatacattctttaacatgtcagttgagtttttcaactctagaatttctgcttgatttttaaaaattattgtttgtttatttatttattttgagatggagtcacactctgtcacccaggttggagtgcagtggtgtgatctcggctcactgcagcctccatctcacaggttcaagcgattctcctgcttcagcctcctgagtagctgggactacaggtgcataccacgcctggctaatttttgtatttttaatagagatggggttttacagtgttggccaggctggtctcgaactcctgacgtcagatgatccgcctgccttggcctcccaaagtgttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcacgatctcagctcactgcaacctccgcctcctaagttcaagccattctcttgcctcaaccttctgagtagctgggattacaggcgtgcaccatcatgcctggctaatttttgtatttttttaaaaatagagatagggtttcaccatgttggccaggctggtctttgacctcaagtgatctgcctgcttggcctcccaaagtgctgggattacaggcatgagccactgcacctggccaaaatagcttttttttgagacaaagtctcgctctgttgcccaggctagagtgcagtgacacgatcttggctcactgcaacctctgcctcccaggttctgtgattcttccatgtcagcctgctgagtagctgggattacaggcacccaccaccacccctggctaatttttatatttttagtagagatggggtttcaccatgttggccaggctggtctcgagctcctgacctcaagtaatccacccacctcggcctcccatggtgctgggattacaggtgtgagccaccgtgcttggcccaaaatagctattttgaattctgtgtctgaaatgtcatgtgtctctgtttctctaggattgatccccagtgccttatttagttcatttggtgaggtcaggttttttggatagtgttgatgcttttagatgttttcggtgtctggacattgaagagttaggtatttattgtagactttgcagtctgggcttgtttgtacctgtctttcttgggaaagcattccaggtatttgaagggacttgggttcaaaggccaataacacagtggtttttgcagtcttatataggtattgtcttggtggtcttggataagatccaaaagttttctctggattaccaggcaaaaactcttattcttttactttactttcttccaaacatattgggtctttctttctgtatcgagccacctggaactctggggatttggtgatacaagcacccctgtggccaccatcactgggactgtgctgggtcagacctgaagccagcacagcactgggccttgcccaaggcccttcccttcagggtggtgagtttccccaggccccgggtgtgtccagagatgctgtctggtagcctgcgattctagttaaaaaccttagcaatctacctgatgttttatttttactacgtctgtgctggcattcaaaccacaatacaaaaagttcttcccgctcttctctcccctttccacatgcagaggaggagcgtctctctgtggccagcaccatgactgttccatgagcagttctgccaggccacaccaccagtgttcacttaaagcccaagagctctttcatcagcttgtggtgagtgctgccaggcctcggactcacccttcaggcagtgggcccccctctggcccagagccggtccagaaatggtgtccaagaggctggacttggggatctgaaaagcctgccttttgttctgtcccactgtgatacctgaaagcaagacaaagttccctttacttttccctctgcttttctcagacagaaggagtctttcacagtggccaccacaactgggaatgtgctgggtctcctttgaagcaagtagtctcagacctcaaggcccacagcatactccctgggtattgctggtgcccagtggcaattcattgcccaagaactctttagtcagcaggtgatgagtcctgccaggactggatccttctcttcaaggcagccggttcccttttggcccagagtgtgtctagaaatatcattggggagctagggcctggaatgggggcctcatggctctgcctggtgctctgttctagtgtggctgagctagtatccaagatgcaagacaatgtcggggctgggcatggtggcttacgcctgtaatctcagcactttgggaggccaaggtgggcagatcacctgaggtcaggagtttgagaccagcctggccaacatggtgaaaccctgtctctactacaaatacaaaaattagctgggtgaggtggcacgtgcctgtggtcccagctactcgggaggctgagacaggagaattgcttgaacttgggaggcagaggttggcagtgagctgagatggcaccactgtactccagcccaggcgacaaagtgagactccgtctcaaaaaaaaaaaaaaaaaaaaaaagatgcaagacaaagtcctctttactctttgctcttctgttcttaagcagaaggaaggagtcagtctggttcctgtgagctgcactgcctgggttgggggatggacagctgatgcctccctaggtcatgagcaaccctagttcactggctctaagcactaggagttgcctaggaattggagtccttgttagaacccaacttgactgccattcaggtttacctaggaccccagagcacttcagcctgcagtggtgatgcttgctgggaaactcgttctgacttgctgggatgggtgactcccctttggctagagctagtcaaatgcccctccaagcatggccactggctgagcccagcagggcttcattctctgctgtgacagggcagcactgagtctctgcgctttccctccctgaagtatattctctctctctacctcatggccattgccagggaataggaaataggggtggcatccatgattcaagactgtctctcctgtcttcctcaatgcctttttttcaagatatgaagttaaaaccaggtactgtgattgcttacctgagttttggttcttgtgagagtgcttttctctttgcagatagtttttaaaatttgctgttccagcatggtgtgggagagcttgaatggtgtaggcttctattctgctaccttgcttcacccctggccatagccagatttttacatttgtatgagtttgtataaaccatcaagcagatcaagatatagtacatttctagcattctgataggctcccattgcccccccccaccatgtgaataatcacttccttgttaactattctgacttctatcaccatagattttttttgcttgtttttgagttttatgttaatggaattatgtaatatatactctggtttctggcttcttgtgctcaacagtacacttttgtaattcattcttgtttttcactggttcacagtatttttcttaatatgaatatgtcacaagttatttattaatggtgttcaagttgtttatggtttttggccattatgaataatgctgttagaaacatttttgtgcatatcttttgggagctatgagcacttatttgtgtttgatacaaatttagaattgctgggtcacagggtaggcttatttagctttagcagataatgccaaataacttcccaagtggttaatgatttatattcccgtcaacagtgtataaaggtcccagttgctttataacctcgctaacatgggtctttttttttttttactttagtttttttttggtgagtgagtggccgtattgtgttatttcatttcgcatttcttgatagcgcctacatttgaacacattttcatatcacctcacatcacttagatatcctttccatgaagtacacattttggggttgggtaagtaggagttgcatgggtgagttgtctgacttatcgtcatattctagattcaaatctgttgttggagatgtgcacacgtgtgtgtgtgtgtgtgtgtgtgtgtgtgtgtgtgtgacaaatcttttccgtggcttggcatttccctctctccaaagatcttgtattgaacagaaattcttaatgttaatggagtgcaattaattaaacttttacttataattagtgatttttgtgtttttaagaagtttttttctaacctcaaggtcatgaacatattttccaataattaaaataaattctttctttgatctttcaagacaaacctttcacatttagatgtctcatctctctggtattgactgttttgtgttttctgaggtataggtcaaagttcactttattctttgtggtttctgattattgtttgttttaaagactacctttttcacatttaattgcaaagaaacttttaagttgggcccctatgtgtgccacttattaattttttaaaaacagttttcaatgtagaagtcttttttaaaaacagttcttaaggtcaggggtacacttgcaggtttgttaaataagtaaacttgtgtcatgggcatttgttgtacagattatttcatcgccctattaagctcagtacccatcagttattttttcctgatcctctccctcctcccaccctctgtcctctgacaggtcccagtgtgtgttgttcccttctatgtgtccatgtgtactcatcatttagctcccacttacaagtgagaacatggggtatttggttttctgttcctgtgttagtttgcagagcataatggcctccggctccatccatgtccctgcaaaggacatgatctcattttttttctgtggctgcatagcattccatggtgtatatgtaccacatttaaaaatctagtctaccattctgggcatttaggttgattccatgtctttgctattgtgaatagtgctgcagtgaatgtatgtgtgcttgtgtctttataagagaacaatttatattcctttgggtatatacccaagtaatgggattgttgggtcaaatggtgtttctgtttttgttctttgaggaatatttttcaatgtagatgtcttgttcatgtttcactaaatttatgggtctgatttcttttttttatctgccccaatccaattctttttttatttaatttttttgagtctgatgttttttagtaagctagtaaaggatagttttagaattctattttttattttcttgctgtggtagaaatacaattggctttaaaaatattaatcttttatttaaggaacttgattatattaacttcttctagtttgtacataaattttttgaattctctatatgttcatcttgatcttcaattaatgatagcatttgttcttcccaatatttattccttttatttctttttcctctattattgtaatagagaagatctttaataaaatgttgaatttaagtgctgaaagtgggcatcatccttgtctggtttgtgaatcaggagaaagtgttcagcattttactaatgattaagaagtttgctactactacttttcaaaaaaatgattactctttttccttcttgccctagtctgtagatagcttttatcattaataggagctaacttttatcaaaagctccatctatatctgttttgatatgattttactatgatatttggctaatattgatattataattttcaaatataccaatattacagtactatagaaattcagttggccttttaatatatagttgggtttgatttgctgatattttgtttataatttttttgtttatgtgcatgagacagattggcctttgtctattttataatcttacattttggaacgatattatttaagctcataagacaatttggaaagtgttttttctcaattctctgaaagcatttgtgtaagattggtgttatttctttttaataatgccaagaagacctcactggtgaagccatatgaacaaggagcacaaaatctttttgttgtttgtttagatcttctgaggaaaattttacatacattgaaataccctaattgtatatatacagttccttgaggttttggaaaatggatcacccttatcaagatacagaatatttctgtcaccctgggaagttttcttcctcgttggttccccacagcttccatcaaatggcaaccgctgttctgagttttaactgtagattaattttgactgtttgaaaatttcatataaatggaattatacagtatgtactcttttgtgtccacctttcactcaggataatgtccaagactcatccttgcaattgcatgtattaatcgtttttattactgagcagtataccattttatcaatgttccacagtttattcattttcctattgatgaacatttgtttccaattttttggctattagaaataaagctgatatgaatattctcctacaggtttttatggaaatatgtttttgttttctttgggtaaataaccagaagtggaactgctatgctaggcagtagttgcatgtttaaatttaaaagaaactggcatactacttccagttggattgtaccatttttatattcctacttatgccctgttcttgcctaatattttttgttgttaatattaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttttgctcagtctttagaaattgaaatgtttgtatttttattgttgagctgtaggagttctttgtcagatgttttagcaatattttctcagactgtgtggtttgttcattttttaaaaaaattatcgtttagagcagaagttttcaattttgaaggtataattttatcaattgttttctattacagttagtattttctgtgttctaagaaatccttgtttatactcagatcacaaagatatctatgttttttttttctaaaagccttctatttttagctactatatttagattggtgatccatctcaaattcatgtctgatgtgatatcggcattgagattcatttttttttttgtatttgtagccagttgtttcagcaccatttgttgaaaaggctgttttccctttattaagtcattttagcaccttagtaaaaagaccatgtgctctattgctgtcctctctattctctttatctcattgtctgcctttatgctaataccacagtcttgattcctatagctttatactaatgttgagattgtgtaatgaactctgagtgtatggagtcctactttgttctttttcaagattgttttaattattcgaagacttttgcattttagaatcaatatatcaatttttataaaagcctactgatgtaattgagtatgcactgagtacatagataaattttgggaggaccaatatcttaataatgttgagtctgttagtctctgaagcagatatttctctttgttttttgaaggtctaacttaattttctcaaggatgttttatagttttaatgtataggtcttcttcatattttcttaaatttattcctaagtatttaagttttttgactctgataaatgatatctttaaaatttttacattcaaacactatgctgctaatatgtagataatatagttgatttttgtatcagactttatttcctacctactaaagtcatttattttttagtagttttgttgttattttggtccctggtttcttagtttttctgtgtaagcagtcctgctgtctgataataggattttcagaatagggacgcatcctttttactttgtagactttctatttctttgtcttgacttactgcactagctcggacctctaatacagtgttgaaatggtgtcacaagggtggacatccttaccttattcctgaactgagggaggaagaattcagtgttttactgttaagtatggtgaaattattgttaggcaatattttggtaggtgccttttatctgattgaagatattgtcttctgttactataatagtttgctgagcatttaaaaaatatagttattgataggtgctgaattctgtcatatgctttttctgtatctattgaaatcattatatggattttttctttcagttagttgacatagtggattactttgattaattttttaatagactttatattttagagcagttttaagttcacagcaaaattgagcagaaaatacagagttcccgtatacctcctgttcccacacttacccaatcttcatctcccaaaacactgaaccagaatggtacatttgttacaatccaggaaactacattgacatattattattacccaaagtctgtagtttaccttagggttcactcctgatgttgtacgttcagtgggttttgacaaatgtatgttatgtatctgccattgtagtatcaaacagagtagtttccactgccctagaaatcttctgtgctctgtctgtttattcatttctccctcaccactgacccctggccaccactggtctttttttataatctccatacttttgccttttccagaatagttagaatgatacagtatgtagcctgttcagattggcttttctcagtaatatgaatttatggttcctctacatctttaaatggcttgatagctcttttctttttagtgctgaataatattacattgtctagatacactgtgtgcattgaacattccatgtacacttgaaaagaatgttttttctacatttattgtttgttgtgttttatacatcagttagctctagacggttgatgcagtcattaagctcttccataatttcctaatttttgtttagttctgtcagtgctgagaagagggttttaaagttttcaaatataattgtgggtatgtctgtatttccctgtagtttcctctctttttattttatgcattttgaaacttaattggtgcatacatgttccaattgttcatctttcttatacactgagcctttaatcatgcaatgtttcccttcaaggtagtactcgttgtcatagtctgatttgcctcagtatagccagctttcttatgatattaacctttttcatatagttaggttttatattttttacatattctgataatctgtattttaagtggactgtttagactgtgggtcaacaaactttttctgtaaagtgacagtaaatattttagatttcacagttcatatgttctctgtggcaactactcttctctgtcattgtggtgtgaaaactagccatagacagtttgcaaatgaatgatggatgtggttgtattcaaataaaattttatttttaaaaacaggtaatggaccagatttgaccttcaggccatggtttgctgaaacctggtttagatgtcgtgtttgtttgtttgtttgtttttttaatgagacagggtctcgccagtgtagtggtgccatcatagctcactgtagcctcaaactcctgggctcaagctatcttcccactcagcctcataagtagctgggactacaggtgtgccccaccatgtccggctaattaaaaattaaaaaaaaaaatagagatgggggtctcactttgttgcccaggctggtcttgaactcctggcctcaagtgatcctcctgcctatgcctcccaaagtgttgggattacagacatgagccactgtattccgctagaaataaaactttttttttttttttttttttgagacagagttttgctcttctttcccaggctagagtgcaatggcacgatctcagcccactgcaacctccacccctgggttcaagcaattctcctgtcttagcctcccgagtagttgggattacaggcatgcaccaccacgcctggctaattttgtattcttagtagagacagggtttctccatgttggtcaggctggtctctaactccgacctcaggtgatccgcccgcctcggcctcccaaagtgctgggattacaggcatgagcccccgcgcctggccaataaaacttttaataaatggtcctgagacaactggataaccatttggaaaagtccatttgtggaacaagttaaaactcttacatattccaggacaaaccacagatggatcaaaattcaagtgtaaaaaataagagaaacacaacccaaatatctgacattaggcaaccggttgaataaactattggtatagtgatagaatagaataccgtgtagctgcagtcaagaaagttcactgtacctatgtagcgcgatctccagaatgtattgtaaagtgaataaaataagatgcagaatagtatttaagtgtgtcttttttttgttaaacagaggtaggtagaaatattgtttacacttgtatttttatacagtaacaataataggtagtcgagggaatggggtagacaggagtgggagtgacacttataagtgggagcctttttatttttgttctgattttttaaagcatgtaaatgtattactcattttaagataccatgtaataacttttccagattgagctgaattcatgcaagttccatgaatcatttaaggaagaagtaattctaaacttaaacttccccagataatagaagaagaaggaccattgcccaagtcattttatgagactagaatgaccttgattctaaaacctgacatgaagcaacataggaaagaatacatatgagacgctttttttttttttttttttttgtggagaccgggtctcattctgtcatcgaggctggagtgcagtggcacaattacagctcactgtagcctcgacctcttgagctcagttgatcctcatacctcagcttcctgagtagctggtaccacaggcatgtgtcaccacaactggctaacttttgtattttttgtagaggtggagttttgccatgttgcccaggctcgtctcacacctcggtctcccaaagtgctgggattacaggcatgagccactgtgcccggccttatatgatatgcctctgtcacaaaagtcgggatcatggttaactccattggaaaggtgggggttgtgatcgggtagggctgtaggggcagggttctgtgttattgcatgttctatttcttgatctgagttttagttatatattgttcactttatcattgtataaacataatttgttttgtagttgtatgtaggtatgttatgatcaattataaatggtataagataatttaaaaaggtttaataattatggaacatatgtcttacaaattatttttaaaatatatacactaacacttgatagatggaacttgtatgaggaaatacaaaaactttgaatagtttaagattagcacttttaatattcctatatcataaattgataagcagataaaaaatcaagacatagaggtatttgttttttttgaagggagaaacttttaatggcacagttattccaattccacgttaagatgattggtaaagtagtgatttttaaaaacagcaaaagctggtttctcccaaattagtttccccaagggattagaggtcagtctgtcattcagtcaaatctatatccagtagggaccacccagttttgttttaggctagtctgttgggatatatagtctgcaactagcagagttgcagctctaacaagtgttagaaatgttcattcacagaatcacctgaggtacatagaaaataaagcttctattaaaagaattatgctacagaaaagaacagagaggatatatatacaacacaggaagactcagctgattcagggaccccaggagaaagtggctttcttcatttaaaaagctacttaccatctctcctgttaacttattccaaatctagaaagaaagtacttgccaagagatactgattatatatgggaatttaaatcctccttgttaggaattccactagcaattcttttggaaaacctgaaatcaaaccatttaggttctcacagagttttactctctggagatgctctggttgggaggttggttggagtaggagttggagcagcaagcattgcgtagaatgctagtctgtgtgaaagtccttattaggaaattaaaagggttcactttgccttgtcagcggtgaaaatcagccctcaaggaggctgagaggtagccaggtttggagttatttcctttgttagggaactctatctaacccccaaaacataattcaaatagtatacacaaaagtttggtttagtccagttcttcaggccctgaagcacattagccattgtctaaactcttgaattatatctgaactaaaagaataaaaggacttctcacccatccccacttgctatattcaacttgccatatttaaaaaaatactcaactcgccatatttaagaaaaaacttttgcaggactggctggacagactacatactaaaactttttctagtactgatcagtgtgtgagatttctaaccaggatttctgatttgattccatagtggcctttttctgagagaattcgaagaaggcattgtcaccctagtcagttttctaggaattgacagtcagccagtagggggtggcagtcttcattctcccagaccaggctgcagatggtgtaggttctcctcatttctttggtgtcatgttggacccttcagactttgattgctggaaatcagcatacacagagaaggctccatctgctggaccattcttgtaaatatcagccatgatctctacacttgaaggtttactgtaaaacagaggtgtccaatcttttggcttccttgggccacattggaaaaagaattgtcttgggccacagataaaatacactaacactaacgatagctaatgagctaaaaaaaaaaaaaaatcacaaaatctcatactgttttaagaaagtttacgtatttgtgttgggtcatattcaaagccgttctgggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcatagaggctacctgagagagaacaggcttttcttggttcagaaattctaggtttgagaaggaaagcctacatacagccatctccacactgcacaatagatgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggatcagcattttttgggcagacccattttcttaacaaactgtactctctgaggcagcttggatctatccaggaaagtttccactagttaatttgcatagctcatgttggcattatggagactcaacagtttatctgcagggtgtgaaattggggtattagtcagcaccgtaaggcagaaaaggtggccagacccactctttgggctctggatcctggatttactgaaaccgcagataccctgagcctgaagatgccatgtccagtcctaatacctggttcctggaacccacctccaccactgttgccacttgaacaacataaaaaaatattttaaggacatgttatcttgctgaacctaaaagataaatagagaattctacatgctgcagagactacacattcttttctagcttatttatgtatttatttatttaaaattgagacagagtctcgtcctgtcacccaggcaggagtgcagcagtgtgatctcggctaactgcaacttccacctcctaggttcaagtgattctcctgcctcagcctcctgagtagctgggattacaggggtccgccaccacgcctggctaatttttgtatttttagtagagatggggtttcaccatgttgaccaggctgatctcaaactcctgacctcaggtgatctgcccacctcagcctccaaaattctgtgattacaggcgtgagccaccgtgcctggcccaaaatggctctttgaaagggttaataggatatttaaaaattgttggggtcttgggaggaaaatcacatgattatttcaataaaggaaaaacataactttgataggtatatgttacaagaactcagaaaataggaataaaggggaatatccttaacttgataaaggatttatgccaataacctaaagcaaaccttttatggagaaactttagatgcattctgtctaagatcaggaacaggacaaagatggttaacactattacagctttatatgttactggaggtcctagatagtccattaagaaaagaaatagaggccgggcgtggtggctcatgcctgtaatcctagcactttgggaggccaaggtgggcggatcacaaggtcaggagattgagaccatcctggccaacgtggtgaaattctgtaacatctctactaaaataaaaataaaaataaaaaaatagcggttctaagatggccgaataggaacagctccagtctgcagctcccagcgtgagtgacgcagaagacaggtgatttctgcatttccaactgagcacatggcacaccaggacatcatatcccgcacctggctcggagggtcccacgcccatggagcctcgctcactgctagcacagcagtctgagatcgaactgcaaggtggcagagaggctcggggaggcgtgtccgccattgctgaggcttgagtagctttgaagggagtagtgcttctcccagcaaggagtttgagatctgagaatggacagactgcctcctcaagtgggtccctgacacacgagtagcctaactgggagacacctcccagtaggggccgactgacacctcatacagccgggtttccctctgagacgaagcttccagaagaaggatcagacagcaatattagccgttctgcaatatttgctgttctgcagcctctgctggtgatacctaggcaaatggtctggagtggacctccagcaaactccaacagacctgcggctgagggtcctgactgttagaaggaagactaacaaacagaaaggacatccacaccaaaaccccatctgtacatcaccatcatcaaagaccaaaggtagataaaaccacaaagatggggagaaaccagagcagaagagctgaaaattctaaaaatcagagcacctcttctcctccaaaggaacgcagctccttgccagcaacggaacaaagctggacggacaaagctgcaggcatcacgctgcctgacttcaaactatacacaaggctacagtaaccaaaacagcatggtactggtaccaaaacagagatacagactaatggaacagaatagagcccctagaaataataccacacatctacaatctgatctttgacaaaccggacaaaaacaagaaatggggaaaggattccctatttaataaatggtgctgggaaaaccggctagccatatgtaaaaagctgaaactggatcccttccttacatcttatacaaaaattaattcaagatggattaaagacttaaattttagacctaaaaccataaaaaccctagaagaaaacctaggcaataccattgaggccatggcatgggcaaggacttcatgactaaaacacgaaaagcaatggcaacaaaagccaaaattgacaaatgggatctaattaaactaaagagcttctgtatggcaaaagaaactatcatcagagtgaaaggcagcctacagaatgggagaaaatttttgcaatctactcatctgacaaagggctaatatccagaatctacaaagaactcaaacaaatttacaagaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgggataccatctcacaccagttagaatggcaatcattaaaaaaatcaggaaacaacaggtgctggagaggatgtggagaaataggaacgcttttacactgttggtgggactgtaaactagttcaatcattgtggaagacagtgtggcaattcctcaggtatctagaactagaaataccatttgacccagccatcccattactgggcatatactcaaaggattataaatcatgctgctataaagacacatgcacacatatgtttattgtggcactattcacaatagcaaagacttggagccaacccaaatgtccatgaatgatagattggattaagaaaatgtggcacgtatacaccatggaatactatgcagccataaaaaggatgagttcatgtcctttgtagggacgtggatgaagctggaaaccattattctgagcaaattattgcaaggacagaaaacaacaccgcatattctcactcataggtgggaattaaacaacgagaacgcttggacacagggtggggaacatcacgcactggggcctgtcgtggggtggggggagggaggagggatagcattaggagatatacctaatgtaaatgacgagttaacgggtgcagcacatcaacatggcacatgtatacatatgtaacaaacctgcacgttgtgcacatgtaccatagaacttaaagcataataaaaaaaattattagctaggcttggtggtgcgtgcctgtagtcccagctactcaggaggctgaggcaggggaatcgcttgaacccgggtgtcggagattgcactgagccgagaccacgccactgcactccagcctggtaacagagcaagactctgtctcaaaaaaaaaaaaaaaaaaagaaagaaagaaaaaagaaatagaaatcagttagcaggattggacaggaagagataaatctttaagtattaatagaccacctacacataaaaatgtatagatgcaatagataaaaattttgttaataagataactgagtattttcagttaagggatcatcttacaaaaatcagtagaattcctctgtattcaaaataattaactagaagagatgatgatacaagatgtcattcacaatagcaaaaacaatcatgtctctaggatctgggaattaacctaacaatgcataagatctacatggaataaattttaaactctgttacagtattattcaaaagacttgaaaaccagatacaccctattcaaagatagtacaacatatttgtaacgatatcagttctccctaatctataaattctatgaaatgtcaatcaaaatccagtggaatattttgagaaatttgaactattaaataatttatgtggagcttctgattctgattatgacacttttgcttatattacaccagctgttctgctgaaaacaactagaaaaccttgactaaagtataaatttatctgtttgaaggtataagaactatgaaatcagagaggtaaactcccaacattcagccctacctttctctttcaggcagttgccattacctaggcagtagcagaacagctagaaatctcataggcaggaaaaacataacttggagttcaggtttcagtaaagagtagggctctgttaagtatcctaggtattcagtttcgatccttgaaggcctatcacctttaggtgtaaagacaaatggaaacgagtctgccattgtaagacagaaactcagttgcaatcaaatcagttcttaagactccatgacaggataaatatgaaaattacacccagacacataatcagtaaaacttctgaaaaccaaagataaaaaatttgttaatacctagcagaaaaaggacatgtaatttccagaaagcagtaagacagttcacttctaacagaaatgatagaagttgaagataatggaaaaatggcattttaaaactactgaaagaagaaaagccatcaatctaagactttatgcccggcagcagtatctttaaatgaaggcaaaaaccagaagatattgctaaaagaagacctaggcaaacgaaaagacattgcatattcatggatttgaagacaatatttttaagatggcagtattacccaaattgatctacagatacagtgcaatccctataaaaattcaaggtacctttctggtagaaatggacaagctgattttaaaatttatgtagaaatttgagagttccagaatagccaaaacaattttgaaaaagagcaaagttggaggactcacacttcctgatttcaaaacttactacaaagcaatggtaatcaaggttgtgtggtactggcataaggctcatatataaatcaagagaaaagaattgaaagtccataaataaatttttacatttatggactattggtttttgacaagggtgctgaaaccaaggaggtaaaacagttttttttccaacagtgtggggcaactggatatccacatgtgaaagaatgaagttggactctacttcataccatattcaaaaattaactcaatatagatcatagacataaatgtaacagataaaactatgaaactcttagaaggaaacataggtgtaaatttttgtgaccttggcttaggcaatggttcttaaatatgacacgaaatctcaggcatcaaagaaaaaacaaaaaataagatttcatcagagtttaaaacttttgtgcctccaaaaaacaccatcagggaaggaaaaagacaactcacagggtgggagaaaatatttgcaaatcatgtatctgatgagggcccagtgtctgtgttaaaagaactctgcaactcagcaataaaagcacaacctaatttaaaaattgatgagtgatttggatagctgtttctccaaagaagttatacatatggacaatatgtacatgaaaagatgctcaacatcactggtcattagagaaatgcaagtcaaaactacagtgagataccccttctcacccactgagatggctgtaataggcaagacagtaacaagtattgatgaagatatagggaaattggaaagcttatgcattgctggtagaatgtaaaatagtgtaaccactttgtaaagaaattagagagttcctcaaaatgttaaacatagaattaccatatgatccagcaattctactccgacatgtgtacaaacgcaagagaattgaaaatgtaggtacacacaaaaacttgtatatgaatgttcatagcacccttaatcataatagctaggaagtggaaacacttcaaatgtccatcaactgatgaatgcataaacaaaatgtggtatatctgtatgatggaatattatctagccacacaggaatgaagaagtactgatacatgctacaatatgaatgagccttgaaaacatggtgagtgaaagaagtcagaacaaaaagccacatattgtatgattccatttatatgaaatatctgtaggtttgttacataggtaaacgtgctatgatggtttgctgctcctgtcaacccatcacctaggtgattaagctccacatgcattagctgtttatcctgctggtctccctctcccggcctgcccccacctccccaccccataggcctcactgtgtgttgttcccctccctgagtccatgtgttctcatttttcagctcccacttataagtgagaacatgcagtgtttggttttctgttcctgttagccaatagaacaagtagacaagaatcagtaatggataaaggatatgaacaacctcaacataattgacatagaacattatactgaatcactgatgactacttgtttcttgttcagtacacatggaacatttatcatttactagtgtatagacatgcagttgatttttttttaatatggaccttgtatcctgtaactattgtaaatccacttagttttaggacacagtttttgtatatggtcccgtgttagatttccgccttctatcttgtctaacctttatttcctgtctttaccagttttatggtcaccagagggaaaattcaaagtctccaaagtttggcagaaagcatcagagtgaaggccagctatgatgcctggatatccattagtattcttagatgcacttaattttgatgccatgccagtttctttcatctcactcagaaatgtatttaaatggttattttaacagtttctcacatttatgatatataggaaagtaattcaatgtatctgatcttccatactgacagaagttgaagtttttgttttttcatatgaatgttagtctcaacttgtctgcttaaaaaagtgttattttcattgggataatttgaaatttacagatgaaaggagaattgaagtccagtcctctttggattacaatgtgatttataagttcagagaagagagatggccagttttataaactttttacttgtttcttacgttccttactagatttttttagtagctgttgacgggatattttctactatgtttttttctttctttttcttgaaaaatatgaaaggcatttgtttatatatcctacttcattaatattaattacctttgttaccagctaccttaacaaattaccttgtttctagtagtttcctttttgtttattttatacttttttagttatgcaattgtgtcttctaccaaaaataataaaattgggagtctgtacattgagtttccctattagctctcttgactccttgagtttttattttcagctttaactctctatgtaattgctcttacctgtgcattaattttattctgcagtgtagtttctccattttcttttctctccatctaaccctattctgttcatccttagatttcaggaattctttaaaatatctaatcagctgatgttactcttactactttccagtttattatggtttatttttgacaacttatattgtctgtcatctcatgagcttgaaggtgggagggaagtaaatgagtctagtttgccatctcaaaacagactctatttagactatttaaatactaacttaaaaagaaaacatcaacaaaagtcaatgttcctggctcttattcttcagtaactgaatatttcttggctggtcttcgcagctgaggttctttatactgcttcagtgtttctgtcctttgagaacttcaaatctttcctgtttctgcctctacatgtcattgatgaaagtcttcattccttgtaccatagatcctggaagttttgatactttccatctatggactatgatataattgcatcctgtttgagctgtaaggaggtgaggttcaaacctcttctctttgcttctgggttttaactagtatactagagctagatcaggttcaaaattaccggattttctgttaaaagagatcaagacttaaacctggagccaaactggagatttccaattattttctcctaaatgcaaagttgggttctgacttggaatctcggagtagactccaagtatatgtatccagctagctgacttaaggtttccagccagccttacaaaccaattggctagtggaacagagaacagtattgaaatatgggcatccaggccaattgcaagaggacagatcttgagtcctaatccatttgagtttattacaaggacagaagtgaagtgaaagggaattactcatttttgtttttcaacatttgcctcttgaatcaagagagagggtggagcctctcttgcttgtgaggcagggtgtttccacatactcgtaacttgaactctaggaagaaaaaggtagcaggataaattttacagaaaagggaagtagagcagcatgctttgcccaagcactcatctcctttgatacagttccttcagatactttgaaatgactaatgcattatatttaaggccactagtactagtcattgtgttttcaaggaaatcagaggtattccctgcttcactaaatgtatttgtcatgaccaattgcttctttaaaattatcccatatttggaaatcagtgaaagaattgcggcagaaagaaatcagtgaaggaactgaatacaagaataaagtcaggagatgaatgagtttatgaaaatgggaataaagatataaaatacttttattgttctaatggggagatgagaacacctatacaacttcttcctggtatttatacttaacaactattaaattccttatttatgtgtttaatgtttgtgttcaccaataaagtgcaatctctgtgaggccagggagtgaatttctcttatttgttttattccctacttagaacagtgcttttaaatgtaattttttaaatcaagggctaaaaacaggaaaatggagttctttttttctttcatgcttccctcttttgactaatgaaaataatacttattaatcatctactgtaatccagtaatttacatgcccttgagtagggttgcagtttaatcagcaagggggagaggtacacaggattgatacccacttctgtaatttgagggatatttttccaattttatttctattcacaggtaacaaaattgatgtagttttataaacattaatataatgaacttttcttaccaaatatttagtctttttcccatgtattgaaatatttctttgtaaatctgatttcttatggccccaaagaagtccattatgtggatatttgataatttacttaaccatttccttattgttaagctagaatgtgtgctccatgaatataaagattttttttccctctgttagctcattgcagtttcccagtacctacaacagtgtctagtgcgtagtaggtgctcaatatgtatttgtagcatgagtgaaagaatgtgctctattttttccatattataaatgccttataaaacgtttttgtacctaatgctttcactacacttcaaatgattttctaagaataaatttctagaagaggacttgccagttgaaaagacatagaaaaggttgtatgatttcaaattagttttctaatccacaataatgttacctgtggctatttttctttacactttaattttataaattttctataacatattaggattaaaagagttattttttttcttttaagtacatttctatttattcagagagcagtgagcagtcttctaactggaatataaggtttttgttggtggtggtgaaagatgaggcttgaaaggtcacagctgggtgtggtggctacacctctaatcccagcactttgggaggccgaagtgggcgcatcacctgaggtcaggagttcgagaccagcctagccaacatgatgaaaccccatctctactaaacatacaaaattagccggggtggtggcacgcacctgtaatcccagctacttgggaggctgaggcaggagaattgcttgaacctgagaggcagaggttgcagtgagctgagactgcaccattgcactccagcctgggcaacaagagcgaaactccatctcaaaaaaaaaaaaaaaggaagaaacatcacttgggcaaagcagtgaatggcttggtatgctatgctaaggacctttattctgcaggaattggagtcctataaactattaataagcagaatacaaaaacttcataaaataaataaaaacaaaatacaaaaaagcagagtacagatgccacctgtcttttgaaagtgttatgtcccagtgaacccactgtaaattaaaaataagtcttgaagatgcatttaatatacctaaccatcatagcctacctaccgtagcctagcctaccttaaacgtgctcagaacacttatgttattagcctacagtggggcacaatcatctagcaatactgtacagtgtagagtgtcggttgtttgccctcatgactgcgtgagagctgtggctcgctgcaactgaccagcatcctgaaagagtctcatatggctttctattgaattcatgttgtttttgcaccatctgtaaagttgaaaaattgaaaaatcatcagttgaactattgtaagttggacatcatctgtagtggtatagttagaactcttctagaaaggtaatagtgatagtgctgagcaaggattggttagagaaggggacaaagggaggtgctagatttctcactctctagtctccatatctcaccagtcactgactcagtatttcttcagtttcttcctctttttcttagttagatcctctcacctcaattactgctataactttccaatgtctttccctgccttaaaaccattctccacagagctgctagagtgatctagctaaaactatctgcgcagaatggttcccctgttatctgtatttttaaggttctagtttattaacatgacatacagcttctctgctctttggacccttcagcaccatttcttgctactccctgttgtgctctttatgttcctaggaaaggaagctgcttattgtcctgtgtatcttctcccccacaaatatttcctgcctgtgtgccttgcttatgctgtccctacttcccaaactatcccatcctcagtcacatccatttcagtccccttttttctggagttcactgtgtaagactcaggtgtcagccacttcatttaaaaaaacttttaacatacgtattcacatactatacactttcctcctctactcccactttggggtcaaggatctctcttctttactttttataggaccctgatttttatctctcctttccctgtagtactgttatggtactgtctgtgtactactgtttaggtgtgttttgcacaatggactgtgagaatttggggggcaggaacttgtgggggccaagggtccagcccttgttattggtccaacctttggctctctgaaagtttgctgaaaaatgaacatgcacaaggcagattaataggagaaaaggcatacaaatttatttaacatgtatccgcgggaacctgtatgatgaccccaaaatacaggggaaattgcccattcttatacttaggttcaataaagtatagacagctgtgtagaaatgtgattggagaagaaaaagggtatgatctaatgctaacagactgagtggggaaacccagcaaggcctgtgtgtctaaagtcttcttggcctctctgtgcagcattccttccttccaggtatggggcaggaccctctctggaacgggggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaaagtgctgggattacaggcatgagccaccgtgcccagctatttttttaaagacaaggtctcattctgtcacccaggctggagtgcagtggtgcaatcacagctcactgcagtcttgaccaagctcccatctcagcctcccaagtagctgggatcacaggcatgcaccactatccctgactaattaatttttttttttttttttttttttttttggtagagatagggtcttcctatgttgctctggctggtctcaaactcctgggctcaagtaatcttccctctgcagcctcccaaagtgctgagattataagcatgagccaccatggctggcaataatttctttgtagccagtttttataccaaaaggctgagggaaaactagagtaatatttttaggttttatggctggctttgaggaaagggagttctagtttctgtgacctagagaagagggattctagtttctatggcttaccttgggggagaatgggactgagagacagagcaggagaaggtcaaagaaaaacttctgtgtctaatgcagctgagtccttcattttggagtattgttttctgagcccaacaaactttttattcagctttgtgttctcagcagttagcataatgtatagcatatagtaatgtggtaaaaaaaaaaaaaagcctattatttttctgttgaaataatgaggtcttgaactaggccaggggtagtgggaagggagggtgggtgggagaaacattcaaaaaagtcaactttggatgttagtgataagttaaaggtatgtaatttatagatgatgagatttgcaacttgagtgagtttggtatacagattgttgacttcttaaatttaagacatttgctgaacatgctagagagatgaccagtaggcaactacaaataagggtatagatagtaagagatagggatttaggagttgccagcatattggtattaactgaggctttggaatagataatataagtcaggaaggagaggagatgtaaaaaaggtggagtagagatccttggggaacaatatttaacaggttacagcaaaagaaagattagagaagtatattaattgtcagcagtgtccagtaatgaagaaagggtaaagcagatgagaattgagaacaatttatttggaaattagacagttgttattgaactttgagagaatagtttcagtctagtagagtgaaatagaaattagattgaaataggtgtttgaaagaggttgagaagcaaacaaatgatgagcaagtggaaaaagcaagcatgtactactctttcaaaatgtgctttttggagaaatgtgttgtggaaagggatgtggtatcagttccttgaggaaaaggtaaaatgggggtgacgtttttgttcatatttttgttcttggatggggaatggtcttggaaaagtttttcaattgatatccaggagaaagggggattgaaagcaggaaagaaatttttaatggaataaggacaggaagggaaggaaggagagggtttgggatcaagatgtcaaatgatactgttagccctgaaaagtggtagggttcaaaaggaaaagaggtatgaagcgcaaaaacatttagagttggcatgagggaatgtaaaaggtctgttatctataaagtaggcaaccaggtcattaattgctggtgaagagtagataggacaggaatgggatagtttgtggtggcagggtggcacaggacattttggaagattagtaaagttctgttgagagtgatagaattaatgttaggactgcaggtagatttgagggttcagctgagattgagctatggaaataaaaagcaataataaaaagacaaagtatatatatattcttatatatattattccttacataatatatatttccttatatataaccttattttatatatatccatatatgtatgtgtgtgtgtgtgtgtatatatatatatatatatatatatatataacatgactttttttcattaaagagactgaagaaaaaaagggatttgaaaaattacttgtagttgctcattaggatatgtaaggcagttacttaaggacagccaaatttgctctactgtcctgatacttggaagaattaaagaatggggtacagggctggggagttggtggcagcagagagcagtccagcagtctgtcaagtcctgcctggtcacaggtcagtgccatttaaacctccaggatcaagtcagagcacttgacgcatgactgataatatttgagatttagtgtgaggtgtctttttaaatttttttttggtgtgttcttgctgtatgtgtgtactgattaaaatatgtaaaataaaagcaacaggttgctggtaattaactctgttatttcaagacagaattgattttgtatagaaaggtagtattggctggattatgagctttactgcttattcattcctgatgaaaatatctctgctgggcttacataccctgtagtgtttatgaactagtaggtttagaaatgaagagaccctagagagataatcatttcctccaagatgttttgtcttctaccaggaatttgtcaatagatatataggcccagtgggtaggctcacctctgcatgaatatttgataggagcatttctatcagttatgctctttcttaaaaaaaaacatgaaaataaacgcatcatttatgtaactcttataagaaatgcataaatcatgggaaacagtgagcaagatataattgaaattcagcagctcagtgagttacgaaccttctctctacaactcaattgtgttagttactgcttaacttaacgctgggttttcctttttgctttcaggaaaacctttaacttacgccctgggtgttgcctgtcaacagtttcctggtggctcaccgcttctgcctgctccagccttgctccggcagcttcaaggcttctgggcttcagagcttgttgtgaaagcttgctgctttggcctgctacccctgcttcaggtgtcaaaagcttttaattagcttgcttcctctaattactataactaggcccttacgtgtctgcataatccagttctagggtctgaaaggagaattacctttagccattcattcttctttaaaagatcttttactttggccctcctggcattcatgggagagtaagaagttatattgcatgattcacctttgatggtgctagtcttcagtctgtaggggcaaactggtgtgggcatactgtattttatagccagtgtttgttctgattggttgatgcccatgctgtcccaattttaaagtattttgactattgctactgaatatataaattgtgtctccatagaaaggatatctctagctggtttaataaactctttgtagtgtttttagtttgcttattaaagataatatttagttccctcccccatttttaataaatattttgaacacaaattggtcgctcacagaacagtttttaaaaatgcagatacagtgatttctatacattttgtaatgatcaccattaacatgtgtcaataggtatcagaattataggtatgatgaatgggaagagctcttcagtacttatataactattcagtacttggagtagtaaagtatactagctctcttatcagacagccaggtacatattctggttctattacttattaattttgtcactatgagtaagttaattaacttctccaaacattagtttactaatttaagtggggattgtagaatctgctttagattggtgtaaggattaaatgaggggtaatatatgtaatatgcttagcccagtgctaggcacagaataagctttttataaataagagttattttttgttattattattaatcataaatgatagtagatgatatgtaggggaaattaaaaggtgaaaaagacaataagtaatgagcagcaacagacaaaagatattaaaggccaagttgtgaagtcaggacttcgatgcctgttaagagagcagagtgagctggaataagctgatagatgtttaataaatcacaaaatacacagttgtatctcttttgtcataataccttatttttgagttttagtgtcagtttagttgtatacttgcagctgagaatattgatgctgtaaactttgcatgtatatacacccacatagattaccagtcattcatcattaattcagctaatgtttattgagtagctatagattcccaattactaggtgtgtactagtgaacaaataggaaaaaaaaatccctgccctcattagcttatattgtagtgaatgaagcaaacaatgaacaaagtacttaaatagaatacatagttcatgaaataatgacaactaatggtaaagggaagcaaagaaatgggttagaaaatgtcaaggggtaaagtgacatttcattgaaggagtgagagagaaagttgtgtggcttcgtggggctagaatattccaggcctagggatcaacaagtgcaaaggctagttgggattgagtgtggtgatcattatagctggagcatagtgaaccagggggagagtagcacgaggtcagggaaggtggagggccagaacatgttggccctataaggcatagtaaggattttgacttttacttggagacagatgggaaaccattggaagctgtggagcagaggagtgtcatgatctgagctacatttcaagaggatcaactgtggcttcagtgttgaggatgggttgtgggatgagagggcagaagtagtagagaggtcaggtaggacaatccaggcaagattttcttttttttcttttctttttttttttgagacagagtctcactcacttcagcccgggctgaagtgcagtggcgtgatcttggctcaccacacctccgtctcccgggttcaagcaattctcctgcctcagcctccctagtagctgggactacaggcgcccgccaccacacccagccaatttttgtatttttagtagagatggggtttcattatgttggccagactggtctcgaactcctgacctcaggtgatccacccacctcggcttcccaaagtgctgggattacagacatgagccatgtaatagtagcttggaatgggttggaacagaggagatatggtgaatgaattcttgctatatgcaggaagactagatttatagaactccgtggcaactgtttctgtattctacaacctgtaacttaagaatgaacataaaatactgttacagcattctgtaactgcaatttgtaactagtttgtagcttcaaatgataatacattgtgtttaagaactgatttgtatacatttgtcacttagtgattatttctgtagtgtttacagaaataattcttgaattattattacaggttttctaacatcatgtttttactatgaagtctttcaagacattgctagtgtttttaaaaatatatctttgttctgtgttaaactatagtcttgcagttcatactaaatgtacttttaattttgatcaagctaaacaagaaaggacattttaacagactacactgttatatgttaagctgtggttcttgaaaatacaggacctgaggttagagttctaagagaatcctcctcttcttgatttttagctactgaaatgaatatcagtatgacttgcagtgttaaaggagaaaagcaagatcagtttgattttattgtattactttgtaagcctcatattcttttctcatcatttatcaattcaataattcaagaatatttcctgaactgacttttatttcaccacactcaccttattccagaaaagattttaggtagctcatgaaactgttataagataggtttgaaaatgttttccaccctgcagcagcatggcattcctgataaccacatacatgtgtagtctcattttagccatgatcagttataccacaataccttgataattagcggtcatttcatgaccaggatgtgatgtgtggtatcccatactacctcattccatgcttcaaattttatgtgttttatatagaaaatgtagaaaagcaagtagaaattgcatcacttagaaatacctgatcttttgataaagcatagaaatttatggtacatattttatgtgtgtgtgtgtgtatatatatatatagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtcataagtctaaaattacagaaagttagaaattaaagagatgaaagatttttttattttggtagttaaactgaagaaattgagagttatattctttgccacatattagaggtagagttggcagtgaagagattgggctgtaatgtgcttagtgcaatgcctggcacataatcatagctaacacttattgaatgcttactaagcaccagacccttgaaaaacttgaaattatttttcaccctgtggcagcatggcatccctgatgactgcacaggtgtgtagaatgggtctcattttgtccctgatcagttacaccacaatacctcaatagttagtggtcaataatcccgagtacaaggattatacttgtattaatttttcaaatctttaccacaatgatataagtattgttattaaccccatgatcatgacaaggacactgaagtattgaaaggttaagttttttgcctagagttatacagctaaggacaaaactaggattcaaacccaagtagtctggcttcagaatccatgctatcaccactccccaaaacagccacaataaatgctagctaagtgtttgagtgttcaataaatattaggcgtcatcattattcctactgcacagttgcatattccagaggtggttttggttccaatatttttggattttagaaagataatttagtttgtatactctattttatgtaacattctcattggggtttggagcagcccttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactcctccttctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctatccatgtgcactcccagttgtgcagggtttgattttagagtctaagcaatagctcacgtggtgtgttcaccgcttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaccacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccaacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgagaaagggattttatttattgtatttgatagtttttgatctgcaattgaaatataaaatacagaaatagatgttcctttttttttctttttggaagggatgtgtaaagtttagtttttgtaaaatcgttagttttaattgctctctatgcgtatgtatatgtgtgtatgtggtttgggggttatggtatagtatgtaagagtatgtgatatgaaaaataggatcgttttcagtttatttcatattgtttgatcctcacaaaacatatttgttttggcagctggccttccttgtaacatggtgttggaattttgcatgcattatttaataagctctagttctttcctgttgagcattttgttcagtttcttagtgatagtagatattgagtttgaattccagggcagaaaagttggaaagggggattaatgtgtaattaccaactaatacagtgttcaaaaataccaactaatacagcgttcacaaataccaactaatacagcattcacaaatacagttattagtttggcacatgttcactaactttttcatctggcaacattatttaatttaggatcttagaatttgaactgcattgacataattgataattggtatttatttttttacagaggaaaaaggaaaatggatggctgaaaaaattatttgtcattattttaaaatttatatttcctttatcttttctaggttgctgtagtaaaactaaaaaatgcagataaagtgtttgccatgaaaatattgaataaatgggaaatgctgaaaagagctgaggtaagagtcttatgtattggaatatataaatattttagaaatatttttcaggaattataaaattccatagagctcattaaatattacttggtaacattttgtctgtggtgacattttttaaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgattatgcagtcactttgtattttgttttatattacaggagttgtagtaaaatctagtaatggaagaactgcctgcatttttatgtagatttgagggaaggattgactggagtgatgttaaaaatatccagcagctggtatggcctggtcagaactgctgtcacacatagatttggagtggacttctggggggtccgctgctgtgctgtatcatggtgaagggttgaatgggataggcattctggggcttcagggaagcagaacttaactggtgtagaattctgtcagtattttaactggtaaaaggtgatactgacgagcaggctgagtaatagccctggaagttagtaagattagtaagaaaataatgacaaattcgcctttagaaatctttatctgtcagtacttgtagcaacccaaagatgaacaaacatacagggaaaagcaaaaagtgtttccatgatgacagatatggtggcagtgaaagtaaatacttcattatttatttatttggagaaatttgaaaacacaaagaagaaactaataatcacttttgttctgttacccagaactaataacattttggccaagtttttgcttttagtttttttttttaaactaaaaaaaacaaacaaacaaaaaccctcagaagtgaagcacaaatatattctctgtaaaacaaataatagcatattacagataaagccaaagtgttctttcaccacccaagtccatcctttctctaactcccagaggtcattattacttttaaaatactatttcttcattaaacattttttttgtttttatatatttaggagatacaggtgcagattgctgacatgcatatattgcattgtggtgaaatacccatctagtgaacccatcacccaaatagtgaacattggacccaataggcaacttgtcagccctcacccccttcccaccctcccaccttttgtagtctgcaatgtattattccactctgtatgtccatgtgtactcatggtttagcttccacttataaatgagaacatgtggtatttggctttctgagtttttttcacttgggataatgatctccagttccattcatcttgctgcagaagataagatttcatatatttatttatgtgtatatgtacacacatatatacatacatacatacatatatgtatacacacatcacattttcttcagtcctgcgttaatggacagcaagattgagtctgtgactttgctattgggaatagtgctgtgataaacatataagtacaggtatctttttgatataatgattttttttcctttgggtagatacctagtagtgggattgctggatggaatggtagttctgagaaatcgacgtactgttttccataaagattatactaatttacattcctactaatagtgtataattgttcctttttatctgcatccccccagaggtaattattgtatagtaatatcctgtttgacaaagtatctgggagctttaatgtcacatgtatcactgggatatgtgccagtgtccattatattcaacaccttagtttttacttttaatttccctaagactgaattgccttactgtcactggttggatttctcaaggagtaaataccgagattgagtttattgtgcagatatttgtttgggatttcttttgagaaatccctacctgtagaagggaagggagggagataggatttgtacagttgtcccatcagcctcagttgattccactgggagctctgtagcagaaatggctcttgagaagtgtcctacattggatcaaaatgtctagacctttatacacctgcctctactagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcagagttagaacttttaaaaaattgaattaaagtttatacttttttcaatgaagctggatatgttggggaagaattgtgaaaaggatgaataactgggttagctttcattacagctggaagtggcaaaattcaaaataaaacagtataatttaaaatcaaatattttattcaattaacaagtatttatatattctgtttctgagacaagatggaatagactcacttctccctgttctcctgtgaagtatagctgaagattctggacatttatatataaagcaaacattagaagaacccaaaaggtagagagaataaggtagaccagctagggacctcaggaccttacggtataagacccattttggaggtcagtattatgctgatagaaaaacctgacaaggaccatacaaagaaagtttaagataaatagtcctcgaaataccatttgacccagtcatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtgtgacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccggccagagacacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaatatacgcaaatcaataaatgtaatccagcatgtaaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatggacaaaagctggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattatatatctagaaaaccccattgtctcagctcaaaatctccttaagctgataaacaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagagtatacaaacaaatggaagaacattccatgctcatgggtaggaagaatcaatatcgtgaaaatggccatactgcccatggtaatttacagattcaatgccatccccataaagctaccaatgactttcttcacagaattggaaaaaactactttaaagttcatatggaaccgaaaaagagcccgcatcgccaaggcaatcctaagccaaaagaacaaagctggaggcatcacactgcctgacttcaaactatactacaaggctacagtaaccaaaacagcatggtactggtaccaaaacagagatatagatcagtggaacagaacagagccctcagaaataatgccacatatctacaactatctgatctttgacaaacctgagaaaaacaagcaatggggaaaggattccctatttaataaatggtgctgggaaaactggctagccatatgtagaaagttgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaacatttttgcaacctactcaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcgtcatcactggccatcagagaaacgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccagatgtccaacaatgatagactggattaagaaaatgtggcacatatacaccatggaatactatgcagccataaaaaatgatgagttcatgtcctttgtagggacatagatgaaattggaaatcatcattcttagtaaactatcgcaagaacaaaaaaccaaacaccgcatattcttactcattggtgggacttgaacagtgagatcacagggacacaggaaggggaatatcacattctggggactgtggtggggtggggggaggggggagggatagcattgggagatatacctaatgctagatgacgatttagtgggtgcagcgcaccagcatggcacatgtatacatatgtaactaacctgcacaatgtgcacatgtaccctaaaacttaaagtataataaaaaaaaaagaaaaagaaaaaaaaagatgaaaaaaagatatgccagtaaaaaaagaaaaaaaaaatgtgtgacatatacaccatggaattactatgcagccataaaaagtgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccgggggactgttgtggggtggggggaggggggagggatagcattaggagatatacctaatgctaaatgacgagttaatgggtgcagcacaccaacatggcacatgtatacatgtgtaacaaacctgcacattgtgcacatgtaccctaaaacttaaagtataataataataaaataaaataataaaaaagataagtagtccccatgcatatagatgcaaatatccttaacaaaatattagcaaatacaatttagcaatatgttaaaagaattatataccatgcccaagtgtgatttattgttgggatgcaagactgattccatatttgaaaggtactctcctcaaactatttgagaaaacttttatcttttagacagaaattctgcattgaaacttttaaggaagaattcactttaaaatagaaattgtatttctattcttgaataagcagatctttttaaaaacaaaaacatttctaaaaatccttctgaccatgacttatccaactttggaaaacaagacctaccagtgatgcttaataaattacaaatgagcagcaaaattccttattttttatttgtgtattgttgatgctttaaaacaattttttcagaggtttatgtacaacttatttaccttattctgtttcaagccatatgtcaaatatataattaatgatatacgggttactcaaaggtgctaggaagcctcctctcttttctatacctgggcagaaaggtataataatataatgtccaataatttcacagatttatcatttacaaactttgctagtttatcaccaataactctacaagttcatcatttacagactttgctagtttatcaacagcctcctaaattaacaaatgaactactgctctcaatctgttctgtaaattttacttctgtcttcacatttgttcagtgagtactgacttcgctcattaacagatgtccttactcatttcatgaggagatgcggtatagtttacagaaacactcactgtcttgagagttaaacctttttataaaaccttttaaaaacattttatttattgaggcagagtcttgctctgttgtccaggctggagtgcagtgttaggatcttggctcactgcagcctctgcctcctgggctcaagggatcctcccaccttagcctgggagtagctgggactacaggcacatgccaccacactcagctaatttttgtattttctttagagatggggtctcactatattgctcaggctagtctcaaactcctaggctcaagtgatctgcctgcctcagcctcccaaagtgctgggattacaggtgtgagccactgcactgggctgagagttaaacctttctaaggctcaattttctcatgtataaactgaagataataaggtctcataagtagggtaacagtatatcttagtttatctgtgacagtgctgatttatgcctattgttttattagtttttctattgttgttatccttgtttggctatttttataattgttagtaaagtactacacaaagtaaaaaatgaacaaatgcaagttcccttttctccctcaaatacccctaagtccttctgtcttaagtagatcattagtaagggtttcttatttatcctcaacagaaaattttattataatgaaatcatattacaaggctgatttttcatattgctttttcactaaaatatgtattgttttttcacttctatgtatttaatacatttataatatctcattctttgttaatagcttcattatactgaatggctctctgtgtgtgtgtgtgtatatatatatatatatatatattttttttttttttttgagacagagtctcactctgttgcctaggctggagtgcagtggctagatcttggctcactgcagcctcctccttcagggttcaagtgattctcctgcctcaccctcccaagtagctggctgagtacctcccaagtacctcccaccaccacacccggctaatttttgtatttttagtagagacagagttttgccatgttggccaggctggtcttgaactcctaacctcaggtgatccatctgcctcagccccccacagtgctgggattacaggcgcgagccactgtgcccggcctgaatggctatattttttattaggttgattttttttttaagtttatgggaatttagattgtttccttatttttactattttgaaccatgttgtaaaaatctttatatatactggataaacttttgtgagtttatcggtagtgtgaattcttacaaagatgaagtgtcaaactgtcaatacatttcattattttaccatttatctatctgcatgtgtttggccaagagaaatttcaaaacaggagagaaactagtgcttcaaaactagtcatgctacccaaaaagtatatgccatgtaaaatttaaaaaaattttactatgaaatgctgttagagatattggtgtgggctaccctgaggcacttcagcttgtgtatactgaagttgaaatgatttcaaggataatttttacatgaagggattatcattttatgcttgacctagaacttatccactccctaaattaaactccttgctagtcaaactctgggattttagttggggaggggagacattaaaactttgatagctattgttccaataaaattatcttctataaaagttggactattatctttgcactcatagtatgtaaacatgtctgttttctcacacacttggcagttgcggatgttaccaaattatttctatatttaaaattacatttaaaactttttactgaaaaataagttaaaaatgatacatctcatgtttgatttggccatgaaatatatattaaaatgaagacttaaaagtgaattgatgccatggtaatacttggaattcttacattttgcaatttaaaatttcactgatttagattttaaaaatgaaaaatgttgttctttccctcaaatattagagaaagattcagttattatttgaaagagtttctctgtgatagtattctatggaagagtgaagtctttattcctactaaatgataagccaaagtagatataatcatcagtggattttgtttctttttaactcatgctttccaagtatctgtgcaattttgatgagcagtataagcttgttagtctgatgagtgcatcttatcaatacgatgaagagaatcctgtgtcaactttccagaattaccatttatgtatgtagtccttactaacttgtgtttcaagataggcattcctgttcctgtttatcccaatagtccattaaggataaaatttaaataatatagactgaatattttttaaaaaggaaaactgtataacagttgaaaacatcactgtggcaagctgaatgtttggatgaacatttggttgagaaagtgagtgaatccgaggaagtgatatgatctacagtagcccttcctacatgtttgttattaatacattcttagatatcaaatattctgtttttaaaggggggagatattgtttagttttttttaaaaaaggtaatgaagtagatgttactaaagcctttaagcatgttgaatccacagagcacctttatgaatatatatatacccagggtatatgtgcatcatgatttggttaatattgatctagaacagggcttctcaacagggacttcattgacaactggggccagataatgctttgttggaggggttgtcgtgtgcattgtagaatatttagcagtatccctggcctctacccactaaatgccggtagaacccatcctttcccaattgtgacaagcaactgagagcagtgtgatatgttgaagcaaaaacgtagcctgtgctttatatctagactcaggattcaaggcattgataggaatcatttaatagctagatatttatggataaaatcatatgctgtctggggtttgcttaaaaatatgtatatgctcctgtgtgtgtggtgctaggggatggtagtaagtaggtgagggtctaaatgaaataagattgaccaagaaaataattgttgaagttgagttcattagtaggagggggtttttatactagtttctctacccttgtatacgtttgaaattttgtatcataaagagtttatattgtttattttcttattttaattaatgtttttgaagagacagtcttgctctgtggcccaggttagagtgcgatggtgtgatcatagctcacttcagcctcaaactcctaggctcatgtgatctttctgcctcagccttccaagtagctaggactacagaggtgcatgccaccagcctggctgatttttttttttttttttttgcctgtagagacagggtcttgctatgtcaggcaggctggtttcaaacttcaggcctcaagcgatcctctcacctcacttcccaaagcgtgggactgcagatatgagccactactcctggcctattatttttatttttaaaaaataatttttttagttaaacagattagcatagattagaactcaaagtttaatatgttctgttgactaaagtctttggagctttttttagttttgagttattagtcaaattaaataacgaatgtttattaaattctaactagaatgtttataaaatttcggattgctattatagtgagatgaagccaggagaaagtagtcttctaggctctgacagtctttacaaactctctaaaatgttagcagtaaaccataacctcaggttggttaaatcataaaacaggacttggtagtaagtatgtaaagtgctttctgttttccccttaaaaagaaccagagcggccgggtgtggtggctcacgcctgtaatcccagctctttgggaggccaaggtgggcggatcacgaggtcaggagatcgagaccatcctggctaacgcagtgaaaccccatctctactaaaaatacaaaaaattagctgggcctggtggcactcacctgtagtcccagctactcaggaggctaaggcaggagaattgctcacacccggaggcagaggttgcagtgagctgagatcacgccactgcactccagcctgggcgacagagcgagaaaaaagaaccaaagcatagtgttgtatagattttagtaatttaattgttttgtggatcatggctgttgaattttccttgtgggaaataataatcacttattatatatagcatactgtgtgataatgtttttagtgtatctggaatatggtgtagccattaagaaaaaattaggtagatttctgtgtactgatacggaaggatgttcaaattcattgttacttgaaaaaaaaaaaaaacttacagagcactataatctcatttgtataaagaccaaaaaatataggggaggtgggataccatgtgaatatataatctgtgtgtgtgtgtgtatgtgtgtgcacgtgcacatgcatgcttatatagacacagattttctgagaggattttgaccaaagagttaataatggtaacctctgcacacaacaattgggcaatgaaactatgggaacatgactcagggagacttttactttcttagagttatctttgaagtttctgtcatagtgttatttttgtttctttttagttaatgtattacaaaattatgatacataaaattgatttttaggctgggtgtggtagctcatgcctgtagtcctagcactttgagggggctggaagattgcttgagcccagtagtatgagaccaacctgagcaagatagtgagacctcgtctctagaaagagataaaaaaaattagctgggcatagtggtgtgcacctgtagtcccagctactcgagaggctaaggtgggaggatcacttgagcccaggagcctgggctgcagtgagctgtgattgtaccactgtactccagcttgggcaatagagtgagatcctgtctcaaaaaaaaaggttaaacaattatttttttatttttgttcatatatttctaaggttcttcgggatatacttttatagtagtggaagtgtattctcagaataaactacaactttaaaaaatcaatttgaaaaaacaatccattagagaaaatggacaagggaagtgaacaattaaaagacaaagttcaggtgtccagtaagtgtatataaagctatttatctgcacctgtaattaggaatatgttaattaaaggaataatgatattatttcacacccgtcatgttggcaaccacttaaaagtctaataatgtcacatatagttgaggatgtggggaaaagcagagctttcatattctgggtggagatagtaattggtatagcactcaggaaagacaattggctaaatggtggagttgaaattttcatttagcatttctacttctaagtgtatacagtggagaaactcttgcacatttgtacaaatatgtttattccaacattgtataataataatacaaaactggaaataacctgtgtttccacggttgggggttgcataaataaattatagtgcattcaaacaatggtacgccatagcagttaaaagaagaacagtcattcttgagaaaaaaaaaaaatcaaattgcaaaaggataaaattataccattcacatagattttttttgtttttgttttctttctttctttcgttttttttttgtttgtttgttttttaaggcaaggtctcactctgtcacccaggttggagtgcagtggtgcgatcttggcccactgcaacctgtgcctcctgggttcaagcaattctcccgtcttagcctcctgagtggctgggattacaggtgtatgccaccacaccctgttaatttttgtatttttgttagagacaggttttcaccatgttgcccaggctggtcttgaactcctgtgctcaagcaatctgcccacctcggcatcacagagtactgggattataggcgtgagccactgcgcccggcccatgaaaattttcaaaacacaaatctgttgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatgtcttataatatcaggtgtattccttttccagaacagaaataatataataaacatagtaattctttgtatatttcctagttttacataaagtatgctctaaaaattttctttttgtgtttcagacagcatgttttcgtgaagaaagggatgtattagtgaatggagacaataaatggattacaaccttgcactatgctttccaggatgacaataacttagtaagaatcatttttgtatttctatatactgtttttttgttggaagaattagcattatttttatttaagcattgtttaaatgtaggtttcatatagaaaattaagtgcatttcatacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagtttttcatgatacctttaacaccagtaccattcctcttcccttgttcctgttgaagtccagctagtactttaaaattgtgctcaaattcatcttaaaataatcatttccagaattttccactgaaattaatctttctcatctcattctaactttacatttttaaattatttttattacataactaacacatgtatctctgattttttttgatacaactttaagaaacatttaaataggccggatgcggtggctcacgcctgtaatcccagcactttgggaggccaaggcgggaggatcatgaggttaggagattgagaccatcctagctaacacggtgaaaccccgtctctactaaaaatacaaaaaaattagccgggcgtggtggtgggcacctgtagtcccagctactcgggaggctgaggcaggagaatagcctgaacctgggaggcagagcttgcagtgataatgccactgcactccagcctgggtgacagagcaagactcggtctcaaaaaaaaaaaaacacatttaaatatgttacatggactgtaccatctttacctaaaataaaattaaaggtttttccaaccccactggaaacaaggaaaaaaaataaaggtttatgcaactctataatgctcatggggtttatctgatttcaggccagatctaggtgttcaaacagtgtcattactagtcttttatatcccttacatgcttatagagtataataatgtttttttaaactacagattgtgacccattagtgggtaataaaatcaagttagttacaagcaacattttttttctttctttctttctttcttttcttttttttttttttgtttgctggatcttgctctgttgcccaattagagctaactgctgtatctgattcctgggctcaagcagccctcccacctcagcctcttgagtaactgggactacaggtgtgtgccactgtgccccactaacttaatttttttgttgttgttgttaagatggggtctcagtttgttgctcaggctcgtcttgaactcttggcttcaagtgatcctctcagcttgaccccctaaggtgtgtggattacaggcatgagccaccatgcccagccataaggaacatttttaaagattaaatagaatagaaaatgacagagttcatgacaagtaagtagtaagagtgaatatggtctcatgacacatttcttttataatatactgaattatcatataagccatatatattattgtgggttatagtgagaattgtgtaaaaaccatagcatagagttttttgtatgtgctagatgcatagttgttaaattgaatagaatgatgttttaactggatttattatacttaatatacaaaattttagggatgaatgtatcatgcaaagataatctgcatgggtttgttaataacatttgtaagaacaaattaaaacacatcccacatctttgcctagaaaaattatagcaatgtatcatgataattttcaaaatgttttcaaataatgaataaaatccactatgacagtgtattctgtaatagataaatttaacactgcagatttgtgcattgcttaaaagtctacattttggtataaatatagaaataattatataattttgtaggtatattaatagaaataaagtacccaaataccaaattttatatagcaaaaaaagcctgaactgtgatttatctctctcctcttgtttagttttatttgcattcttcgtatttgacattaggattaacatttctttttcaaagacatttttcagggaaaaatagtctgtatatacccctcaataattactaaaatagaattaaagacgtaactggaggaggaatgaaacactctagtagtcaaatctcctgtaacttgccagtgtttctttaggggagccttcatcatatattcattcatctcaagagtcagaggtcttggttatcatcaaaggttgccttttgaacatttatacaatattagcaaaaatcattaaaaaatgtcgacaaagctaattttagataccaaaaaaggaaattttattatatataattgtttttcaaagtaacttttaaccctgatagcttttaaattgccaagtaaagaacataatttataatgctatatggttctagaaagctgtggcaaataactttcatttctaacctacttactacaatagtttatgaaaaaatttgcaattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaatatcttgcactgacatatgtaacttgtttaaaaggtgaaagatacttgaattttaaattaattgtagtaactcatatgaactctaaattctttataggaatccaatttgtgaagacagaaattattagaaaagtaatttttttaagaaaagtattgtttagggccgggcacggtggctcatgcctgtaatcccagcactttgggaggccaaggcgggcggatcatgaggtcaggagatcgagaccatcctggctaacacggtgaaacccggtctctactaaaaatacaaaaaattagccgggtgtggtggtgggcgcctgtagtcccaggtactggggaggctgaggcaggaggatggcctgaaccctggaggcggagcttgcagtgagctgaggtcacgccactgcactccagcctgggcaacagagggagactctgtctcaaaaaaaaaaaaaaaaaaagtattgtttaatagtaaaaagaaagcaaggaggattaactataaggtgaggctctaaagattgactgttaatctctttgttatggcagcatgagaattaaaagagtttcctgatattcctacgaagacttctagaattatatctgttccttgaaatgctcattttgggacacataactcatttattgcatgttttcagatgttttagcattgtttcattggactggagctcttttaaaaaaaaaatccccaaagctgccatggtctttttagtaatttaaccagtgattcctcaaatcaatgattgttgctttggctttcatttccctagtgactattgaggttcagcatgtattaattggctgattgtgttccctcttatgtgaattatctgttaatattcttagcctagttttgttggattgtttgtccctctcttaacaattggaaggggctctttattttaggattatatccttgacctattatgaatattacctctcagtctatgttttttaaaaacttgtataaatataccttagctacattgggtaatattttaaaagtagtttgtgattaggagtaccaaatattcaattttactataaaattaaccaatcagaacaatatgatataataatataggaataggtaaccatagcagaatagattaggaacagatataagtatatttgggatcttaaaatatgacgaagggacatttcatttgaattgaggagaaagaatggattatttaactgttactttagacttttagtcttatagactctgtctataagaaaatagtcttcacactttaatcaaaagtaaattgtcaggatagggtcagttcaacgttagggtaccccgacgtggtggctcacgcctgtaatcccagcactttgggacgtccaggtcaggagatcaagaccatcctgggcaacgtggtgaaaccccgtctctactaaaaatacaaaaattagctgggtgtggtggtgcgtgcctgtaatcccagctacttgggaagctgaggcatgagaatcacttgaacccaggaggcaggggttgcagtgaaccaagattgcgccactgcactccagcctggcgacagagcaagactctgtctcaaaacaaacaaacaaacaaaaacgttgggcctagtaaatacagcaagtaggccaaagacacaggattttaaatatattctgcttccctaattttcaaggctttaaatatgcgaaattagtttctttggtttaacacacatttcctatgtttgtaattttaacatatagtaataaaaggaatttgaattttttcaagactctttaaatcttaatgtcaactcagtaatatccctgaaacaatatcttcattctgtaataaaaccttaatttcaaggcattcatgtgtcttgtactcactagccttcatgctaagtgctacattatcattattgtagttaggtagatgagaaaatgaaatgtcacagagattaatttttcaacatccacttacaacatggagtcagtatttgaatacaggtttctctgactacaaaacccatttttccactatgtctagttttctccctcacttaaaaataatatataatgtacacacaaatacacatgtatatgtaatacatgcttataaagcaatgtagaacataaagttataacatcagctgtaatctaacaacctacagaatctcagtgaacagtttgatgtactcttctcatcgtttctttacaccacatacatacccataaggatccatatctaaaattagttggcttctgtttattatatacacctgagaaaagcccattctgatatttttacagtattagaaatgggaagagacacatatggtgataattactatattctacgtagtagtggtttctaaatgctgatctataggctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgccccagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtcaaccaaaaaaaattattttgagatgattttggttgttttgctttgttgttgttattatttgtcagcattacagaaccgatgtgcctgcttatacatacatgtacatgtatagtatctaaaagttgtcactcctagaataatagacattggagactaggaaaggtgggaggaggtgagggatgagaaattacctatgggtacagggtacactattcaagtgatgggtacactatattgcataactcacaaccacacaatatgtccatgtaacaaagctgcacttgtaccccctaaatctatgaaaaaaaaagttctcggccggtcacggttgctcacgcttgtaatcccagcactttgggaggtcaaggcgggcagattacgaggtcaggagatcgagaccacggtgaaactccgtctctactaaaaatacaaaaaaaaattagccgggcgtggtggcgggcacctgtagtcccagctactcggagaggctgaggcaggagaatggcgtgaacccgggaggcggagcttgcagtgagccgagatcccgccactgcactccagcctgggtgacagagcgagactctgtctccaaaaaaaaaaaaaaaaaaaaaagttctcacttccagtcagcatttctagaaatcacttcttaaaaaaccactcttgtttaaatgtacatatgaattccatctcaaaaggagtatgcattggtcagtttccttatagttgagtcttacatatttaaattagctggaattctagaccataagtcataggttcatttgctaaataagtcctgtattatatattttatgtttctcaagaaaatactttcaaggattgtatgtgtcaaaagagattttttttgtatgaaagtgataattttgatgttcatggagtaattataaactattaatactttatatttaaaaattttaaaaataccagcatgaatttggaaggacacacaaaaaataagaaataaattaaggatatattggatgatttaaaaggtaccctcacattttaagaggaaagtaggaaacagcagaacgttgttggtgaattaatcattcaaatgagagtatctttggatggtgcaaaatgtgagaaagagaaagatgctgaggagaagtacgtaaagggatactgccaagttagaaataaactaaaccattttctaagagtgattttcaaactttggcatgcatctgaatcctatggaggaagggtggttgaaacccagattgttgagtcagctgcagaagtgctgattcagtgggttgggtcgggctggggaattgccatctctaacaagttgccaggtggtgatgctgctgctggtgtagtgaccacactcagaactatgctctaagacagcagtgactgtttcttttaagttttgggtggtgagagtgatctctgagaagaacatgaatgtggcaaggagtagaatgtttctgtttcagtgtttgctttttaagatgtgggtgtcttaattgctgtttcatttaattagtattgaagttctaagacattattaaaggaagactactttaattaaacaatttgtattttatcagatctctgtttggcttttgcctattcgtgtgcttttctctgtgggtatctgattgtcacagtttttattgaaaataaagatatggaaatgctttgaaaattgtacaatgcagttttttttttttaatttaaatttttgtagagatgggggtctcactgtgttgctcaggctggtcttgaactcctggactcaagtgatcctgccacctcagcctcccaaagtgttgggattacaggcatagctaccacttcttgccacagtgcagccttaaagatggtattgtggtctcaagagtcagttatagaatgagaaacgaaagtgctattttgtggcttaaacagtaatccaaaatcctagctgaggactatcatttaaaaatacttacagaaaatactatttcgttgaatatttgaagaatgttactaaacatagagtcttaggcttgtggaattgagagatttcacccagtttatatgtaattcttgagaaggaataactgcttctgaaaattatatgcctagattggtgaaagtaaatatgaggtatttgtagtatctttcattctgccaggcttgttagagatactgttatgtggactgaaaaccatttcaaccttgagctctgcttaagtacatctaattttacaaggtacttttaaatgaatcgtatttattccattgttgggcagctctaatattataaaattttattttatattaagctgaatttcttctcttctcttttttttgagacagagttttgctcttgttgcccaagctggagtgccgtggtgcgatcttggctcactgcagcctccgcctcctgggttcaagcgattcttctgcctcagcctcctgagtagctgggattacagtcatgcgccatgaagcctggctaattttttgtgcttttagtagaggtgggttttctccatgttggtcgggttggtctcgaactccctacctcaggtgatcttcccgcctcagcctctgaaagtgctgggattacaggcatgagccaccgtgcccggccttgaatttctttttattttagtcattggttctagttttgcttttagagtcacatataatttatttctcttctagttatcatgctttctgaagtcttctttaggttaaacatctaaacatctctagtttctctgttataacaatttgtatacacttcctaccttccttgtcttaaccccccaccacacactctgcccattcctacacctcttctccctccctccttttctctacttttacctttctgtggatgctccattgtgttaatgtgctccttaaaatgttattctcattttctggatagactattttcagcaaatgctttactgaggaaatattttttgagtcctcttttataagtaacattgtgctaaactatgtggaattgtaagtaagtgggtatagcatatagttgtggcttttgaaaaggtttcagttgtttggaggcacaaaacctaagatagaaataaaacttaaaataccacaagttaaataatcatttaaggccaaagtataagagatgatggagtgagtccagactgtggattgctaaatgagttatacaagcaaattacagtgagctcaagaaatgagtaataagtttatttctaatgatcagttctaatccttatttaactctttgtgctattcactgtattctaacacaaattctgtgattcagatgtcatctaaaatcgacgttgccccattttatagatgaggaaacccagcttcagagacattagttagtaagtagcatagcctagattaaaatctaagtcaggcttgtctccagatttatgttctttgcacaacatcatgttttccatagaagactttaatggaggggctttgaaggatgagaagactctgtaggcagataggaagacattcaagataggtgaatggtaggagaaaagcacataagaaggtaaatagtagttttggaaaatacttaatagactagtttggctagagaaaagagttcatgttgagtttagtaggagattaatttgtaaagagattttggttcttatcatggaactcttgaatgtcacagactttgtatcttggtagctaataaactacaatgaatttcaggcaatgaaatttgaaggtaaacttcatgtcttagagttttatgaaatttatcaaatttccaaatgtgttataattcatgaacttaaaatatagggatgtggagaatacaacaagggactagtgagactgttgtgtttaaggaaggagatactctcctttttcttgtgttctttttaaggaaatatatttctagacttgtaaaagtatgttgtttgtcttctatcagcacaaaaactcgcatatgaaaaaatttgcacaaaggtttaacaagagcaatggaaaatagcaaatggtacgaataattaaagtaaaatattttctaataacattgagtagccaaaaagcactggactaggaatcagaagatttaattccatcacctatcagattccccatgtgttaaaggaggataataaataatgtttactctgcttgttttgccagactattgggaaggtgagatgaaatgtgtatatgaaagtgttttgacagtatagacaatatgccattgcaattagggaaacatctttttgcattataaatttgaggcattaaaattattataaataagatagtttcatcctttggttctataattctaaatacatttttctgtctaggtctattgagaatatttcttactcttacttagttttcatttctgattttcccttcctttctttgggcagtatttttcataagcttttgtgtgtgctaaattttatttaagaaatgcaggggtataagcatatatttctaaatttgcttgcatttcctaaggaaagttttacaactgggatacaccggcagttgtaaaaatggttgcctaaagagagtagggtggagagaaagtgggatggacagggataggaatgaaagctcaatttctaagtgaatacccttttcatatatactttttaaatcagtaaacttccttatttagagcagttttaggatcttagaaaaattgagtggaaagtatagagttccccttatatctactcccgcccaccacacacacacacgcacagcctcccccactatcaacatgccttaccagagtgtggcacatttgttaacatcaatgacccttcattatcacctaagtccatagtttacatgtttacattcgtgttctctgttggtgttgtacgttctgtaggctttgacaaatgcagaacaacgtgtatccgccataatagtattatgcggaataatttcactgccctaaaaatgctctgtgttccacctctttattcctcccttcccgctaacccctggacatgactgatctttttactgtctcataggtttgccttttccagaatatcatatagttggaatcgtacagtttatagacttttcagattggcttctctcgcttagcaatatttaaggtttgatagctcatttctttttagtgagtaacattctattgtcggcatgtaccatagttttccatttacctacttaaggacatcttggttgcttctaagttttgggaattgtgaatgaagctgcattttatatgattgctttttttttttccctctctctctttttagcatttcaattatacttctattttttaacttttcttaatggttaccctagagtttgcaatataaatttacaactaatctcagcccactttgaaatgacatggtactgcttcataggtagtgaagtaccttgtaataacagaataatcctaattccttgttcttgtcccttgtatcattgctgtcatttatttcatgcataagtaataattcatatttgagtacattgttggcattcttttgatcaaactgttatcttttagactaattaaaaataaaaggtaaaagtttttattttaccttcacttattcattctctgatgctgttcctctctttacatagttctgtttctgatttgtatcatttttcttctttttgaagaacttttcaatttttcctgaaatatagttttcctggcaacaaatcccctcagtttttgtttgtctgagaatgtatttctctttcacttttgaaggataattctgcagtatatgaaatcataggttggtgaggctttttttttcttttaaatatttcacttcactctcttcttacttgcatgatttttaaggaatcagatataattcttatctttgttcctctatgcataaggtgtttttttcctctggcttctttcagggtttttttctttatttttttatattctgtagtttgaaaatggtgtgcctaggtatagttttttttttttggggggggggtggggggtgccatttatccttcttgatattttttgaatttcctggctctgtggtttgatgtaggaaaattttggggaattatcagacattattgcttcattccatttccttctggtattcccattacatgtaacttataccttttgtagtaatcccacagttcttggatattctgttctgtttttttttttttttccagtcttctctttgcttttttcattttgaagtttctattatattctcaagctcagagattcttttctaagtggtgtctagtctactaatgagctcatcaaaaatattatttatttctgttagtgtttttgatctctagcatttctgattctttcttagactttccatcttatttatctgttcttgagtgttgcctactttaaccataaaatctttaacatattaataatagtttttaaaattcctggtctgataattgcaacattgttgccatatctgactctcattctgatgtctgtccagtctctgtcccgtttttagtatgccttgtaattttttgttgaaagacagatatgatgttgttaaccttaaataacaagattagaaaataagtatagactttgagcccaaagcttgaggatggccaccagagagcatagattctatttgccttgaatatacattctgattagcagtgttacaagtgggtttttaaggaaaaaagaaaaggcagttcctaagttgttaccaagaatttacattaaaatatcagaagctcttggttagctatacattcgttctttgtatcacaaactccaggaacgagaagacgatgggtgagacaggtagccagtaaaatgccttcaaacaattgcccctgggtttgaggggccagtgactgaagtcccatattcatgtctctctgggcctactaaattttgcatgcctcacatagctcagactgctttgagctctttttcttttctcaatgtattgggcaaaaggaattgcagtaagtgggccttgagtgatgtagtggcaaggggcgtgtgtgtgcatgtatgtgttggtaaggggccattctgtggtcctatgattaggtcccaatctttagtgaggctttgagactgcacagtgaacaccagggcttctcagcttctcagtacccctgccacctctgtacctcccttcctgccttcctgcttagttgggacaggatggctagaaggtgccagacttgggtattgcccctccttctggtaggttagtctctgataataccccagcaggttaggctctgaaaaattccaaacagattaggctctgttaaaatagtttctcctgagggcaggccttcttaagaagagaatactctggcatatttcagaatgcagcagatattctcttttctcctccctctgttggaagcatgagggtatgtttctctggtattcactatgaggacctggttgagctcttagtggtaaaactcaaaaataaatgtgcggcctccctatgactgggctgcctttggagtttttaatctttcaggcttgtccacactgaacctccagcaattcttcagtcacagtttaggttttcctaaccaggcactggttctctgcaaggtttctgctgtgggtttttaaactgccaagttgtgattctccatagccacctgtctgtccaatttggggacaacagtttgccctgtgaccttacttctcttacatatctaagaagagttgttgatttttcagtttgttcaggtttttactttttgttaggatgctgtggtgacttctggactccttacatactggaagtggaagtctccccataatcttttaaaacttagatttcaaaacaacatgttttatcattgtgatacggctctgatgagtggaggaacaccagattcttcctcttaagttgaattagaaaaaaaacgacatggacacacgtggagtagttttaaggagcagggagtttaataggcaagagagaagggggaggaaagaaagaaaaagctcgcctctacagagacagagggaggggggctccaaagccaagagacagaaccccactttcaggtagtatcaaccagctatactggaaggctggaggaggcagtgtctgatttgcatagagctcagggcattggtttgaccaggcatgtcattcacgtagccggcgaaaaaactggccctcccaccctctctttttaatatgcaaatgcggggcaccatgatgttccaaacacgtggggatatgtaggggcagccatactgccaggcacatgtgggggcaagggcaagaggacaacggtgggaatcgccatgttaggtggacccagtttctaatggctaacatttgcatatcaaaggttgccagcccgggtctaagacccaaggctttcattctagataagagctgcgaaaaatcttccaaggacccctttttttcctatgtgcctaaaataatttcttaataactcctacctcaattgagggtacagcaaccaagaactttgtttttttaaaaaaaaaaatttcttgtaaagatgaaaagatttccaaagatgctaattaaagtgttaaatgactagctggaaaaataacagcttgttattttattgagaaacctaagaacggtatgatgttataaagataaacactcaaaggggctattactattattttctactgagaattaccccagtagccttctcccttttgaaggaggcagggaaatgatgcagtggtattgaggagtgaagaaaaatggtattagtagagcagctaataatactggtgcatattgtttggaggaagtagaaataatgagtggctagtagatttgaaatgctttaagcattaaagatgtcagttcttcccaaattgatctacagacttagtctttattctttatttttttttcatgttctttcatgaggtggcaaatctataggtttattgcagtctctcaaaatcctagcaagattcctttagatagagacaagcttattttaaattttatatggaaaggcaatagaactggagtagttaaacagattttgaaaaaggagaataaagtggaaagaatcactctaccagatattaagccatgctatattgccaccttaagcaggaccatgagataattgcgatgtaataaacacacagatcattggacgacattagcaagcccagatgtaggctaacagaggtattttcaactgattttgagaaaggtgcaaaagcaaaaataatcttgaacaaatggtgctcaaataagagaccaaaaaaaaaaccccaaataacttccccaaagctctcataaatacaaaaattaattcaaaatgggtcatggatttaaatgtacaacataaaactataaaactgttggaagaaaatattggagaacattttctggatctagggcttggtaaggagtttttagatatgacaaaaaaaatcaataaaaatgaataaatgggacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttacgaaaatgccagttaaaaccataatgagatattattacccacctgtttgaacagttaaaataaaaagtagctaatactaaatgctagcaaggatatggagaaagtggatctcttacatgttgctggtagaaatagaaaatggcacagctactttggaagacagttggacattttttaaaagaagttaagcatgtaacatgatctgacctgtcagttacattcttgagcatttatcccagacaagtcaagatttatattcacagaaaaatctgtacttgtgtgttcatagaggctttatttgtaatagcagaataccggaaacaacacaggtatccttcagtgggtgaatagttaacaaaactggtatatccatgcagtggagtactactgaacaataaaaaggaatgaacttctgatatatacaataacccggaggggcctcaagggtgttatgctttgtgagaagaattaaatctcaaaatgttacatactgtatgtttccatttatataacatacttgaatgacaaaattacagagatagagaacagatgaataatttccaggggacagggcctggggaaaatgaatgggggagtaagtagaaatacaaagaggcagtcagtgtgagggagttcttttgtgataatggaacagttatatattgtgattgtggtggtagttacatgaatctatacacaagataaaattgcacagaactatacatgtacacacatgtacatttttaaaatggcatgtactaggcttctccagagagacagaaccagtaggatatatgtatatataaaagggagtcagttagggagaattaactgacacgattacaaggtgaagtcctatgataggatatctgcaagctggggaaagagagaagccagtaatggctcagtccgagtttgaaagccggaaaaccagggaagccgacatggcagccttcagtctgtggctgaagtcctgagattccccgggaagctgctggtgcaagtccaaaggctggtgaacctggagtctgatgtcccagggcagggaaagcggaagcaggcttcatgcactggaagaagaaagagccagaagactcagcaagcagaattatcccaccttctaacacctgcttgcccacattgagggtgggtcttcctctttcagtccgttgactcaaatgtcagtttcctctggtaacactgtcacaaacacacccagatacaatactttaccagccaattaggcatccttcaatccagtcacactgacacctaatattaattatcagagggtgaaaactgaaataaggtctagtctaacactaatgtaccattgtcaatttttttgttttatattgtgctacagttatcatatgttaccattgggggaagctggtggaagagtacaagggattcattgaactatttttcaatttcctgtgagcctattatttcaaaataaaaatttttaggaaaaggaagggcctctatgacttgcttttctaaagactggaaaccaagcccaagaaattctgtaccttatatttcacctgcagtgcatataaatttggtgagttcctcaagattgccaaatttggttaggctctttggcctacaaggaagtgatttttcttaccagctataaggctgggatctgtaattcaaacttttgggtgttattaacatgtagatgctatgcaaatcatgggataagatgaattcactttgcgaaacagagtaggtaataaagagagtgcaggaccgatgagccatgaggactccaggtgttagagactggatagattaagagtagccaataaagaaaactaagaaggagcagtcagaggttaggaggaaaatcatgatagctgagagcatacctacaatgtcttacggaaaataaaagtaatcattttccccttatatttaattacattaatgtcttaatggatgcatttcaggcaaacatttattatgtttttcctgtggatgctagtgtcctgggtgttggaggttgaagtagggaaggctgtagggtattgcctgcttttatgtaagtaatatactttttaccttcaatttactgtctttggggaaatgataaaagcttaagaaaatacttctacttcatagttgtgcccaagttggacagatgttcatctcaattttaattttgtaaattcattcatttatcatgaacgtattaggctgtacagtttttcctgatattctagctattttcttgggtaagaggtgccatagaactggaggaaatactctttagaggagctacttgaagattaactgttataatagagagtaagcgacaaccaaaacaggtttaaaacaaaaagctgcaaaaactatttttacgtctccatataaaataaaagaaaatagtagatgaacaagtgaatcaggaagatctcttggaaaaagccatgtttatcataggaagaagatacttcaaaaaattgaaatagcttaaagaaggaggaccaaagtaaataatatgtacaaaaaatgaccattgaggttctgaaataatattttatcattattttaatgttaaagatgtcacttgaatacatagaaaaatgcaatatgaagatcttaatattatgaaaatatgtccatctttatgctttttaacaaaatggtgggtttttttccctgtgttaattgaaatactattttggcagtcatatctttttttcaattatctgtaaacttagatttgtgcatctatgcactatgcatctgtaaagtgaatagatgcactttaatttcagctgaaagtttgaatcctagcattactgtttttgatttgctgcataggcagtttgcattttaagggtgtaccctttcttttcaattatttttttgttcaaatacaaaatttgggagtagaggttatttctaatgacttaacagcatcatgtggtatgtctgattaaggttgattaaagtttatgccaaataggttgtggtaatgtaaggcctaatttcaggttgaaaaaaaaaaaggccccaagttatttctaaccatgtttaaactcagcactagacttgctatttagattgtgaactataacttcaaaaatgctaatgatttaagacacagaatcctactagaacaagaaagaaaaactaagtttcatctgattagaatgttatgttcgattatcatgcgcttcagttttagatgacaaaaatgggaagatgaggaacttttgtggtgtttttcagcactacgtagataatttacatagatagtcagaatgttgattctggcttctggcaccaaaatgttaccaactgatattgtgtgtccttcagtgacttagatcttaccttgattctgtttgtggtatagtttcctacaatatcaccatttaaacaatgttgcacactttgccttcaaactggaaggaccctattagaagccattttgattgagaagggtcattgctggttggcgtattggtctgttaaagagaatctttattgttgtaaaatatataatgctttaagcttgtgtattagagaggataacagtttcttttcttagatcacctgtcatttcataaaatgaaattttatattaatttttttttgaaaagttcttagtggaaatagtagaatatttaacagctttttggaaaaaattgagaattccttctttattttaaacccttcaaaggcagattgattgattgattgattgatttatgacggaatctcactctgtcacccaggctggagtgcagtggcatgatcttggttcactgcaacatctgcctcctgcgttcaagcgagtctcgtgcctcagcctcctgagtagcttggattacaggtttgtgccaccatgcccggctaagttttgtatttttagtagagacaggtttcaccatgttggccaggctggtcttgaactcctaaccccagtgatccgccctccatggcctcccaaagtactgggattacaggcgtgaacctccgcatcctgtccaaaggcagttttaaaaaatgatctaaaaatggtgaacttttctttattagctttaatcataataacactagatattatccttgatagttaatattaatagtagtcatttatatattactacttcttaagactttttttttttcaaacttttttgccctttggaggaaagatgtctacctttttgtataacttgccagtggtattcagtggatcctcattaaaaattattgtgagattaaattgtaaatagtcttttaaaatagctttttttttttttttttttttttttgagatggaggctcgctctgttgcccaggctggagtgcagtggcacaatctcggctcactgcaagctccacctcccgggttgacgccattctcctgcctcagcctcctgagtagctgggactacaggtgcccaccaccacgcccggctaattttttgtatttttagtagagacggagtttcaccatgttagccaggatggtctcaatctcctgaccttgtgatccgcccgcctcggcctcccaaagtgctgggattacaggcgtgagccaccatgcccggccttaaaatagctttttgagataaattcatataccatacagtccactcattaatgtgtacagtggtttttggtatattcacagatatttgcaaccattactatgatctattttagaatattttcatcatttcagaaagacactcttctctataccttaagtctctacaccctgtttccctatttccccagccttaagcaaccattagtctaccttctatctctgtagatttgcctattccagacattgcctataaatgaaatcatataacacgcggttttctgagtggcttttttcacttagcataatgttttcaagattcagtcatgttgtaggatatgtcaggacatatgatctcaaccaggtagactgcctggtaagactaagacaccaacattttccagagttttgagaaagaaccaaaagtgtacatgctcatagcatacacagtgcagtccaaaattactcagtctatcaggaaattatgatttagtctcaagagaaaaaacaactaatggcaactgtatttagtccattttcatgctgctaacaaagacatatctggccaggcctggtggctcatgtctgtaatctcagcattttgggaggccaaggtgggcggatcacctgaggttgggagttcaagaccagcctgaccaacatggagaaaccccgtctctactaaaaatacaacattagctgggcgtggtggcacatgcctgtagtcgtagctacccaggaggctgagtcaggagaatcacttgaatccgggaggtagaggttgtggtgagccgagatcatgccattgcactccaggctgggcaacaagagtgaaactgcatctcaaaaaacaacaacaaaaaagacaagacataccccaagactgggcaatttataaaagaaagaggtttaattggacttacagttccacgtggctggagaagcctcacaatcatggtggaagtctaggagtagcaagtcccatcttacatggatggcagcaggcaaagagagaatgagaaaccctgataaaagtggaaatccccgataaaaccatcagatctcatgagatgtattcactatcatgaaaacagtatggggaaaactgcccccatgattcagttatctcccactgggtccctcccacaacatgtgggaatcctgggagtacagttcaagatgagattttggtggggacacagagctaaaccagcaactcaagatgatccacgtatgagaattattggacaaagactttaaagcatttagtttaaatatgttccatgaactcaagaaaaacacatttgttttcttccaggtgaaagacatgatagaagtatctcagcaataaaataaaaactataaaagaaacaaatggaaattttaggacggaaaaatacagtattggaaaaaaaaattaaatgtctttgagaggacaaaggagattacataggaataaagtatattcaaattcaatttggatatagatcaataaaaattatcccatgaaaaacagacaaaaagattgaaaaaatgagcagattctcaggaatgaaaaggtgtaacatgcaagtaattggagttccaggtagagagaatagagacaataggacagaaaagaataatagctccaaacttcccatgtttggagaaatacatgaatttgtagaataaaaaattgcatagtgttacagctcttttagaattgcaccagaaccctcccctgccctccaccccacggaagaaaattgcagcaaacccaaaacaacataaattctgggaaaaccacacctagctcatcaaaatcaaagtacagaatacaatggatagagaaaaagtcttgaaagcaccagaggaaaacagtatatcacatacagggaaaaaaaaatggaatgatctcagatttctcatcaagaccacgggggctaaaaggtaattaacatcttcagagtattgagaggaagaaaactatcaatgcagtattctgtatctggggatattttcttcagtaatgaagtgggggtgagggggagacattttcagataaaggtaacccaaaagaattcattgcttcaggccttccttacaagaaatgctgaaaaaagcacttcagaatgtagggcaaagatagcagaaggcaacctggatttttaggaaagaagaaagagaataataattagtaaatatctcagtgtatatgaaatactgtatatatatatattttttttttcttacatctttaaaatatatggctttaaagtaaaagttgttttttgggatattgaatgaatacataatgtatatgacagctatgagataatcgagagaggtagggcataaacaaattctagaataattatttacctttaaagttaaaaaaaaaagtagggggcataaagagccagtggattagaggggagagaaaactactttatcattagacttcccagtgatgaagctttatgataaagatttataataccctagaaaagaaaatgtgaacaaaacagactttcaggtataaaagacatgtacaaatgttatcaaatacaagaattttaggaatgttgtttccatgaattcctcttgaagaagatactaatctagttagtatagtgtaataatatatactagttagtatagtatacattttctagtataacctactagaaaatgagcttcagatgactaacatggctatagagatatcagtataaggactggtattgctcattaaatagtcagttgtagaactaaagcagaaaaaagttaaaaggagtgagcacaggattaatggctatatgctgtggcatgagcatgtagtataactgtaaaagtaggtagtgataattgggagaatttatataaaatttttttcaaactgtttgcagtaatcaaattagtggtgacagtatagttactgttattttgacattgttgtgtttataacgtgaaatgaaacagaatgattatggagtattctaattttatcccttatgttaagaatcagaattcttggtgtagaagaaaggagatgctgatgtaatctggaagagatcattaaaaaccctaatgtcgtgaatttgaattgaagatatcattgtgggctgggcatggtggctcacacctgtaatattagcactttgagaggccaaggcgggcagatcacttaagatcaggaattcgagaccagcctggctaacatggtgaaaccctgtctctactacagatacaaaaattagcccggtatggtatcacacgcctgtagtcccagctactcaaggagctgaggctcaagaatcgcttgaacctgggaggcggaggttgcagtgagccaagatcgcaccactgcactttatgtcagtatgaacttctgcagtatttcatacacacacccagtacaccatacatacagctctgtgtggtgaaaataactagaaacagtgaccagcacgtagcagtgagcatccctattgacagattatcgtcctcacatacgatttcctactgcagggaaaacaggctacttggagaaattgctgactcaagatctagataggaagtgtacaagatgagccctgtatgtcttgtcatgccaaatagcaaataagctttcaaagacttttagggtcatgtttgaaggatacaggagtcaaattggaaaggttactagtggcgtaagatgggaaaatttcaaatttaatagggataataatagaaagaaatagaaactcatcagatgtgcctgtattaatgagttttaatgagtgcataatgtacctgtaccagcctcagtgccttggagatgaactgaaaatatgaacagtacatgtaatgaatgattacttggtagtttatcatatgctgtgttaaagtataggatactacccattatccagttatttatttatatatatatatatttaaattagacttcaagtttgcagaggcatagactatgactttttttctattgtactcagtggatatattttatgatgtctctctggaggttttcttcatctagacctgcagccttgtggtttcaagggcttctttctgggtgttggttaataggttgctgcaacacagcactacagttgtcaagtcatattttaggaacagttgctgttatatctggaatttagaccatgaattctatataagttccaaaaggggttatatcagtcatgattgcatggaatgtacacgaaaatatatttcctgataatcaaattatttatctagttatttattcctttcatcttcactgtgttccataatgaatttagataattagaaataagaatgcatgcaataaatcaatggcagaatataaaaaggaataaagaatcacaaaatggaaattatattttaaaatgaagaccccaaaccaaggagaaataatgaacagaagtcgagtcatatgcttgaggcacaccagctttctgttgcgtagaatctctccctgagggcaagcaggttacatgaaacttagtgaaacttagtggaatatacgtgctttcctatctttgttttaaatcttaaatactggattgaatagattcttaggatggaatgtatttttaaagtaatttttctttaccctagtccaaaaaactaaaatgaaaaaccagttaacttatttatggttttcttcataactctttttatctcatgtagtttcatagtcaagatttttgattacagcttttattaacctcatctctttaatgttgataatattttatataatgtggttgagtaaagtgtaccgatataggaaatagagcaatcctattttaatagaatttgttgggggggaaataccacataattcatatctagagagtttttcatctgttatcccataagaatttcatgaaggattggtatgtgctttgcctataccagagctttgcgctgatttcttctctttcagcttagatttgtgggtatgatttggcagttatcctcttggaatgtgtaaaatcattacttttacaatgagatagaaatattttgaggcctaaggcttactcaaaattctctcagtctcttacaggcctgagtcacatttcaaaattggaatttttcatattgctaatggaggaactatttttatagtattgtgaaactattaaagaataggtaatgttatatggatgctcctcgacttacagtgggctatgttccagtaagcccatcataaagttgaagaatcataatttgaaccattgtaagttagggaccatctatagttaaaaatatagttaaaaactgttacactagagtataggtgaactcaggatgtgcacaattaggaatttttaaatataaatatagttactatattacagttcagttggtatttcagtaactacaaggaatttggggcaactacagagttttagaggaaaccttccagttagaccactccaagttctgacaccaattggaagttcgaggggttcccaaaaccacctcttagttttgataatttgcaagactcacagaactcactgaatgctgttatacttaacagttgtattttattacatggaataccgattttattacatggataccgatttaaatcagccagaggaagaagtattaatatatagggtagagttaaaaaaaaaataccacatgtggagcttacatcattctttcttggtggaattaggacagcccagcatacatatatgatagtgcttaccgagtattgccagccagggaagcccacctaagcctttagtttttatagtttttttagggtggcctcaattacttactgcctgtgtgactgtctttagtctccagcccttcccaaatgttgggctgatagctttagtctccagtcctttccagaggcaaaacatagtatgactcaaataaattacatgtatcataaattacattggtagattgtctagtagtcaaagacactcctatcagttgtgctattccaggagcctagcgaccatcttccagtagctgaggataaaagccagacctctctttgggcaagattaggccttcactatacagataattccgtggtctttaggcaagctttcctatgatatttggacatcttcatttagtgtaatgttcatatggcagatacagcaatagtatcggtttgaatgtatctgtcatttggaggagccaatgcagggtaattgaacgaaacttctggtctatcctataaagccattatatacgttttcatatttttgtactaatgtaattacttgtttcctccttttatctgtcactatttgtacttgtacagaactatttagcatagaagttacttgataggtagctaaatgtagttattcctcaggctggccatttgattagatcctgaggagcctttaactgaatctcccagtgagtattcctgagatcagatgctattggctatactgtagttttagaaggtttttcttttagtgatatattatttatctacatacaagtatttgttaaagagagttagtgtaaagacatgttaatatataacaggataatgagaagcataaaataattctataaatttgctcaagatgatttttttttagcttagaaaaccttattttgaaataagtttggaatcacaggaaattgcaaaggtagtacagaaaggtcccatgtacctttcgcccagtttcccccaactatactatctatcctactcatggtaggacttcttccttccgtctcagtgggcagtggtttaatctgcattttattgccccattactccccgcttttctcttctttttctcatttgctgaatttgaatgtttattttcataattacacataatttgaatttcatagtagtctttctttgaattacattttaaatgtggtatgtgggttgttttacttgttctccttgttgattgtatctggatggtttttggaaagatgcagagaaagattaggatttgtataaccaccattattttgcagtacctggaattatagaatcattagttttttattcccataattcttaaataatagcttcactacccagtggaaaagattagtttgagaaaagtttactgacagaattttttgaataactgttttctcaaatgtaggatgaaccccaaattaatgttccataaagaattctaatttctgactgacagaaaggctgttggtgatgtaattttaccagtgtggactttcttttattactgatgtaatatttctttgacaaaattaagagacaatttcaaaaagcagtttcattttaatataatgcagtatgctgtttttatgagtataaaaaaggaggagtaggaaaattagaaaataaaagtattgttttagaagagtccactaccctaacctatataaatgataaaaaggaaccgaatgggagatattaatgtgatgttgctgggaagagaaatgcctgtcttaaattagtggttgtcagggaccaatcccctgtgcaatattttgattagtggtgtctgggttggggccaaggtacatgcaattaaaataaccctctatagttgaattcagtgtccagccagaattgaaactatatagattaactaatgtcgtatccgcattttggtcttatgggggtaatatttgtaataatcatgcttttggtactgatgttctagtgaagttaaaaaaaaaatcacccatagaatgttgccctttcaatgtaatcgttgttttagaatgctttttttttgagacaggatcttgctctgtcacccaggctagagtgtagtggcatcgtcacggctcactacagctttgacctcctgggcacaggtgatcctctgacctcagcctcttgggtagctgggaccactagcgcaggcgtggaccactattcttggctaatttttgtagtttttgtagcgatgaggttgctcacgctggtcataaactcctggactcaagtgttccactggccttgcctcccaaagttctgggattataggcgtgagccattgtgcccagcatagaatgcttttaaagtttttaaaactattattttaaaactaaaatcataaaacttttaacccaaatcttatttacttttgtttagggacaaggaaaattattcattttagaaactttaattagtgtacatgttttgactaatattcaaattatggaaaacttgaataatgtttttacagtaatagatattttatctcttccaaacatttctcagttttcatgaattatcaaagttgaaaataatgttttacctgaactttcctttcactccttttattgacaattcttagtatctggttgtctggctgccacgttatttgcaagacgtcactgactcagagtggttttgaatgccagatgttattttgctgcttcttccagaaaatggaatttgttgggctactgttccacttaacaattgctgtgtaacacattatgttctccagaagcaggcactgagacagaatgtgtcatgcagggtatttattaggggttaacacctgtagaagggaattggagaaagcaggtttgggtggaggagaagtcagattacactgaggccaaagcttcagtcagccctactaggagttctgaagcgtctgtggtcacctgaattgttgctagtttagtagaaatggcatggtctttcttatttccttatcagtcattcaatgcatatgaagttctccaagaaacacaggcagttgtttaaagaggctctctgtaactttgaaggaacctggcagtggggagctatctgttgacatctggggcaaagctcatcattgagggagaagataatacatctctgtccaccatacaccctgaaacactatagtgactaatataaaacaacaacaattttttttttcttttttttttttgctcatgagtctgaaatttgggcaggactaggcagcacctaattgtatcttctctatgcagcatgagttgcagtagctcacctgtggttggaagaatcactgtcaagatggctcacacacatagctagccaattggtgctgcccatcagttgggagttcagccagagctgtgggcatggggtttttgttcttcccatgtgggctgcttgactttcttaacaacatgataagtatgttctctagagcaagtgtctctagagaacaaagcagaattgcatgacattttaatgacctagccttggacgtcatagccagcctaagttctatcatactgtattgattgagacagtcacaagagtccatccaggttcaagctgaagggacaatcttcttgatgggtgagtggcaaggttctagatgaaaatgtggagtgagagatattattgaggccatgtttgaaaaatatggttttctgtattcataaaacttaaaagttcagggtgccttaattagaaataggattggctacatcttttagaaaattcaaattaataatggtccaaatgtatgaggagggctagtgactgaatgaggtccttctgggctacggccctcacagaagcaactaaaaatctgagcatagcacaaagaccattatcctaaaggcactaaagagtgaacagaagcggggagaacctgattgggaatacatcctcaaagaagatggaggtatatgaaatgacatctcatgttttgcagctctcagcctggggctgggtgaaaatggcatggtgtacattgtggcatgggagaagataacaagaagataagtagaagaactctggtctctatggcctgtgaaagctgaatttggggaaactatgtttgttagagaggggatccaaaatctgtctactgacagctcacatgacccctgagtgatagcttcactcagagctgctcagctaaagacaaaagataagaaacttcttcccaagaaacagtttgcagtttaaatgtgtttaatcagctgattaaaaaaagaaagaaaaaaatgctaactggagaaaaattaaagaatccagagtttcagaaatttaacatttattatgttcagggaacattcagaattacccaatgtataaagaaaaaggagtatgtaactcctttacaagagaaaagagtatccctgaaatgacccagatgtagaaattattaatagcagactaggatttttaagtggctgttaacaactattctcagtaaaggtaaataaaatgtgttcacaatatatgaaaaaataggaaatctcagcacagaactagaaacaaatcaaatggaaattctagaaatgaaaaatacaaaatctgaaatgaaaattttcactgcaaaaaattaacagcctagtggagatgacaaagtaaagacttgaagttaaataagccagaagttattgaaggtaacagagaggaaaagattaaaataatagtagtccaaggacctgttagaaaatatcacaaggttttatgtacatgtactttgagatcaagaaggagaggaaagagaatgggccagaaaaaatacctgaagaaataatggcctcaaatttgatgaaagatataattttatgtatttgagatgctcaagaaacaccagggggccgagtgcagtggctcacgcctgtaatcctagcactttgggaggccgaggcggatggatcacgaggtcaggagatcgagaccatcctggctaacacggtgaaaccccttctctactaaaaatacaaaaaaaattagccggacgtggtggcaggcgcctgtagtcccagctactcgggaggctgaggcaggagaatggcgtgaacccaggaggcggagcttgcagcgagcggagatcgcaccattgcactccagcctgggtgacagagcgagactctgcctcaaaaaaaaaaaaaaaacaccagggaagataaatatgaaaaaggccatgtcaaggttcattatagtgaaactattgaaatccaaagacagagagcaaattttggaagcagcaaggaaaaaatgacaagttacatttgggggaactacaattccattaagagatgaattctcattagaaaataaagaagctaaaagagagacttaagaattctatatatccagtgaaaatatccttcaaaaataaatgtgatatgatatttttaagtaaaagaagaacaaaaagaacaagaagccaggggtgatggctcatgcctataatccctgcactttgggacactgaggcaggcggatcacttgaggttaggagtttgagaccagcctgactaacatggtgaaaccctgcctctactaaaaatacaaaattagccaggcttagtggcgggcacctgtaatcccagctactcaggaggctgagggcaggagcattgcttgaacccaggaggtggaggtttcagtgagccaagatcatgccactgcacttgagcctgggtgacagagtgagactccgtctaaaaaaaaaaagaacagaagaatttattgccagaagacctgcactgtaagacatgctaaaggaagttctttaggctgcagggaaatgatactacatgaaagcttggatctgcagaaaggaatccaaggcacttaaaattgtaaatgtctagatatacatactagactataaattttttattcttactaatttcttcacaaaccatatgactgcttaaagcaaaaattataacattgtcttgaactcatcagagatttgaggtcatagggcaaccaactaacctgaaatctaagaaatgacaggtacttccaaggaaaagatcattgaggtacaaaggagagcagagagctgcatattaagaaagggcagcattaggggaatggaaattatgcttctgggaaaagaggaaccaggaaaggaaactgagaagcattaattttagatgggagaaaaaatagagaagaaagtggtatagttgggagaataaccagcagtgtcagatgtcatagagaagtcattacaggattcaaactaaaaagatgctactggatttggcagtgaaaaggtcatttgtcatcttaaagagtattttctgcataatgaatagggaaagggaaagccaaaaaaaaacttttggacaacttcttttcagcactcaaattccttttaagaattgatcatacatttcagtggtaatgtaaggacgaggacttgcattttcttggagcaggtataatcataggtaactttatacttatgaccttcattatttaaaaagattttaccaaatatggaatgcaaaacattttctaggaggcctctagtttttattcttatgtagtattgtaagatgccaaaatcttagctcagtgatcaaattatttgtacagagaataggtagatgtttatctacctacttttctttgatcctacttcttcaagatgttggaaccttttgggtttgtgggtactgtcaattaagtgtaaccttctttctgttcaggtgacactagagagctcttgctattcctcctctcttgagcccccctcccccaagtttgaatgaagtatctatgcttgttttactgcctattgagaacatccttatggagtaattaagagccttctttactcagttgatagatgttggtcagcagaggcattgaggcacccccactcccgcccctagtgagcactaatgggaattggaatgtgtggcttctcctcactttgtttacactttagagtacagaaagaaccagggtggtccttgtataagttcagcttagttcacatcatactttgccccaaacatttttcttatgactactataaatttagatttaaatgaaaataataggtaagtctgaaggaaaaaggaaacctcagaaggccaagctatagtcttggtcaaatgttttcttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactagggagaagaaatagcccaccctcctgaggcctcgttatttcgaaggttaggagagtttccgtctgcccaaatagtgaccattttaagaacagagacttcagccatggaataaaatgagtaaggatgtggagtgagtcagtaggctacatactttattaaatgtataattgtactcattgttggataaacagagaccaattaatattgtcattttaacatcatggtgcttatctgtgatattgataaccattaactgtttggactaaaatatattgcggactgcagatgatcttagtggcttagtgaaaacattttcatattctttgattaaatgattcagacatttacacatgtatttttggtttttaattaattttaatcaaacaatacttaacacagtaaagaaaaaactaatacaaaaaaaggttatattgaaaagtagtctctccagcatacctcttatgcctgctccctagtggcagctatattcaattctattttttaaaagttatttagccccatatctctaatgtcctgatatgttgatgtttctagatttgcgaattttggacagtttgtaaagacttcttttgcctgccttctatgctagtggaggatttagctgtttgtattcctctttctacttttcctccctgcattctctcactatacttttatcactatttttgatcttcttggtagataatggttgcatttttgagactttgtaaatattgtttattgctgagccaagaaatatactataattttttcctttcttatctaacaatttttcctataattaataataggctcaaatttgttttcagttgtttgtcagtactcttaaaatttccttttatgtgtactaaatgcctaacagtacattttcaagtattcgagtacatcaaatcatgtatcaagtcaatttagttcctttctcccaaccttgtaggcagttataattcagcttccttggctctgcattatttatcatatgtatgttctccatctttgaaaattgtgttgacacccatcatcttccattgtcttttcttacattcacttgtgagtttctaccttttagttcttgtattgtcattttactgtagttctggagggagcagagataaacatgtttactcccataaatatttttggggtgatgagggaataagaagaaggatttctgttttctacttttatgtactcctatagtgcatagtattgcatttaattcagtgctgttgcatgctgtaaatgtttaattaatgcttattgaatgttttactttgtcagttgttacattcttatcccaaccctcactctacccccaacatgcttatgggatcctgaaattttatttcctaaaacctgtctttctctcagctgctaatatataacataagattatttatacaagaagactatgtattgatttggaagaaaatgtgaagtgataagagtaatgttgagccctttgcattttagtgatttattgagagtttactgaatgttttgaaactaggatctggtttccagagtctgaatttttaaaaatttagttaggggtgtgtgtgtgtgcgtttgtgtgtgcgtgcacgtgtgtgtgcgctcatgcgcacgcacttgaaaagagataggagtcttgctctcacctaggctgaagtgcagtggcatgatcatggctcacaacagctttgaactcctgggctcaagtgatccttccacctcagcctcctgagtagctgggaccacaggcatgcaccacaatgcctaagatttaatatttttttttatagagacagagtctcactatgttgcctatagatgagatatgtaagttctctgtggaaaataattcataactgaagaatataaaaaaagacttataggtttagtgtatatacagatgggaagtgtcacattgcaaagatgtcagttctcttcagattaatctataaaatcatgattcccataaaaatttcaatatgtattatagaacatattaagctaattccagcattgatctagaagagtaatggcaattaaaaaatatgctctgccgataggaagctcattattttataattaagacactgtggtattggtgcaggtagaggcatatggatagggtggccattcatcttggcttgtgtgggagagttccaatttatgcctgttatcctggcaattattaataggctccctttcactgtaaagattgtcaactgaaaaaaaatagagtaatacagtaatatttttgctcttcttgagagtcctgaaacaaacccactaaatttatgacgtatgtggtattagataatagtggtgaaaggatatcattcagtaaatggtgctggggtagaaagaaatgtaactgccctttatctcacactacacacaaaaattaatccccggtagatttaaaaactggaaaagcataactttaaaacttacacaagagaaaattaggacaccatccttatgatgtctgggaagacagaaatcatagtataaattataagactacattagtattttatatatatatatattttttttttttacaaataagaaggacattaaaaacaatggaaaaacaagcccacatgcagggagaagggatttgtaacacatcatgaagaactaagttcgagtaaatagaatccctgaagattaaacaaaaaacagtgcacacacaatttttacaacggcaagggatattaacaggcattttatagaagaggaatgtaaaatgaccaatgataccagtgataatatgaaaagattctcaactgtattcgtaatcatgctagcacagttgaagatgtccatatctttcatctcagaaatttcacttctacatctatagtctggagaagcattcatatatgagtactagaagacatttattaaaatattcatccagcattctgtgttttaacaaaataaaaatgggcaacaatcaaaattccgttatcaggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacatacacacacatatgtttggaaacatacacacatatatgtttggaaacacacatgtttggaaacatacacacatttatgtttggaaacatacacatatgtttggaaacacatatgtttggaaacatacacgtttggaaacatacacatgtttggaaacatgtttggaaacatacacacgtttggaaacatatatgtttggaaacacacacatatgtttggaaacacacacatatacacacacatatatgtttggaaacacacacacacacacacatatatatttattttattttatttttttcttttggagacagtttctcattccatcacccaggctggagtgtagtgacacagtcacggctcactgcagccttgacctcccaggctcaggtgatcttctcacttcagcctcccaaatagctgggatcgcaagcatgtgccatcctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtgtaaaatatgcatggatacagtaaacaccaaatttaggatagtagctatgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatagcttaatttttaagataaagaataaaatattttttcctcatctaaaaatggtcttagtaattgctaagcttccttccagaactaaactgtacttctttgatgtttcctctacagcagatctttttcaacaggttagaatacagtcaaatgttgaggattataaagctaataccctatacagattgttgttttcaatcaccctgtctctctttagcaaccatctatcatctacaataggggtttgaaaactttttctataaacagcctgagagtaaatatgttaggctttgtaggccatgtggtctgtgtcacagctactcactttgcctttgtagtgtgaaagcagacataggcaatacctaaatgaatgggcatggctgtgtttcaataaaactttatttacaaaaacaggcagcaaaccagatttggccgtgggccataatttactaactcgtgatatacaacacactcagagaaattgcttcagtaatcaaagtaatactgttataatattttacccttattatgggtggtaaaactgaagcatagagatcttaaatggcattattcaggttaaagtagccctcccatattcctgtaatttacatggcaatgtaattttttaaaaaatatataggttctccagagattctttttctccctctaaaagtagagtgagttgggtgggtataatctcttagttattcacaattacaacctttactatgattagaaacttaatattgttaagtccctgagaatcttctttacagaaccattttatatatgattatttttctaaggtttgcattcacatgcaaaaacaaatacaaaagctggtatatgatatagtttagatttgggtatcttacacaccattgacttaacatccaaagacaatgaaagctttaaataatatagacagtctattaggcagttgttttagttcttctgtaaaatcaactttatgaagcaatttctttgtgttgtcatgacctgcagtaattgagactttatctatctgcagttatcttaaggtctagaaagtatatttttccctgtccagtttcatgggctagaggatagtattttttgtggttatcaggtaatgttgactcttctgtatgcagaaagtaggtctaccatagtcacattggaatctgtgtaaatcaaaaggaaagatagtaagattaatttaaccagaatgaaaattaccacactactttttatctctagaagaatactgaaattacatgtgtttgagaaagttttaatatgaatcagaaccaggatttgaattaataaagtaattaaatagattttcttagaatattacttttaaaataagttgagatttttttctgacaaaaagaatatcttaccaaacaatgaattgtttatttttccactaaaaattgaatttatttattttttcagagacattaaacctgacaatatactgatggatatgaatggacatattcggttagcagattttggttcttgtctgaagctgatggaagatggaacggtaaataaagataaatcctaaattattttgttcacagacatttcccttgctatttgtctgatatatctgttttagaaaccatctatttatactatctacccatccatccatttgtctatctatgcgccacctccttccacaaaggcatttgggcatacttacagtggggttgtctaaaaagtcacaagccatttcagctgcttatatcagtgatcttaagattgataaaatataccctttatgagacccttgtttgctccttctttagttggtgacttctgttgtactttagatatttcaaagttcaccgggggtaaaagaactaagtctcacatagaaaaagaaaacgcagctttgcccgcacttttacttttttgtctttctttcctaaattgcttagttattctaagggatagtgttcaacaaatgaatccctttttcagaaagttcacaagttgatttagtttcatgttcccatttgcttaacttttgctaaccctaaacccgtcagttggttttttttgtttacttaatagctgggcatggtggtgcgtgcctgtagtcccagctactgaggagtctgaggtgggaggatctcctgagcatgggaggcagaggttgcagtgagccaagattgcaccactgcactccagcctgggcaacagtgaagtcctgtctcccaccccctcactcccccagagccacccagaaaaaaaaggctgggcatggtggctcacgcttgtaatcccaacactttgggaggctgaggcaagaggatcacttgagtccaggagtttgagaccagcttaagcaacatagtgatactctgtctctgttttaaagaaaaaaaaaagtttatatgccacagttttattctgtttttttttttttttaacttcatttttttctggccatataggagaggtccaaaaatatatcagtttaattgacagaaactttttggaggacagtttagtataatacattccaaaagccatgaaaatgtcacattactctagaccagtaattttaactttggaaaaattttattattttttttttagacaaagtctctgttgcctaggctggagtgcagaggcgccatcttagctcactgcaacctccgcctcctgagttcaagtgattcttctgcctcagcctcccaagtagttgggatacaggcaagcaccaccacgcctggctaatttttgtattttttgtagagatggggtttcaccatgttggtcaggctggtctcaaactcctgacctcaggttatctgcccacctcggcctcccaaagtgctgggattacaggcgtgagccaccgtgcccggccaactttggaaaatttgtcctacagtgataactttgttaaaaagaattatgtgacctctgtctctggccatgatagagggattaaattggtaccaaattagcactcccactgtaaggaactgtaaaactggatacaatagttgaagctactgttttccagcagtggacaacaggcagcataatactattatccctgacataaatgaactcgtgaggtattcctcacgattgcgcaaagactggggcagttcctgactctgatgcagaaagctagagtgaaagcagagctggactacctgcagcagctggaatatgcagggcttggcattggagaggagggaattgtgcagagagagggcataaagtgcctcatgaaggttgggctgtgcattgtaccacaagaccatatgaggcttgacaatagcagatgatagcatttgaaaacagaccagaatactaatgatcaagcagatctcccaggcaggaaacagtgctaggggaaattgaattttcatccctggagagccagctaacacctttgtatcacctaagacctactctctaacaacctaagtccaagccctgattagatccatagagtttggaagtcttccttccaagtagaggggcttatgacaaatcttagatttttgtatgaacctacaatcacagagtgtatctgtaagctaactcatggtcaaggagatcagtcagtaatttttttatgtgcttacataagaattgtttttcttcataagaagataatagaatcaatactctctataacatcttattcacaatgacaaggattcaaaaaaaaaaatcactgaaccaaacaaaaatgggcatgtggatagtgatacagagtcagataaaagcagtcagtagaggcctggctggcacacatgttggacttagcagacagagaattaaagaagtgatcataggtcggtcacagtggctcacgcctgtaatcccggcactttgggaggccaaagagggtggatcacctgaggtcaggagtttgagactgcctggccaacacagtgaaagcttgtctatactaaaaatacaaaattagccaggcatggtggcacatgcctgtaatcccagctactcactcaggaggctgaggcaggagaatcgcttgaacccaggaggtggaggttgcagtgagccaagatggtgtcattgcactccagcctgggcaacagaatgagactgcgtctcaaaaaagaaaaaaaaaaaaagttataaaaatatttaagaaaacaaaggaaaatgtagccttaaagattacacaaataaggaatttcagcagaaaaatgagtcaaatggacattttacgattagaaagtacagtaactgaaatttaaaattcactggatgaggttaaaagtggactagagataggagaagaaacagccagtgaacttgaagacagatgagtagagatgagccaatgtgaaaaacagagaaaaatattgagactaaataaatagaggcttagggatccatatagaagaagagagtgagatgtggggaaaaaaaaatgtgtacgtaatggctcaaccttcccaaatgtgatgaaaaactcagatctaagaattttaccatatctcaaacctataaagagaaccacatctggccatgtcagatgtggttaaagtgccgaaaactaaagattaaaacatttaaaagcagccagaaggaaagacatattacgtacagaggagaaatggtaaggactactgacctgtcatgagaaatcatggagtgatgtctttaaagtgctgaaggaaaaaaatgtgtaaactgaggtttctgtattaagaaaaatatccctcaaaaatgagagtgaattagacatcttcagataaatggaagatgagaaaaattaatctctagcaggcctgaatgctaaagaatgtcctccatgtcaaaggaaatgatactgtttggacatttggatttatagcataaaaatatcatatgcaataaataagtgggtaaataaaatgtctatactgtctttcttatttaatttacataaaaggtacctaactgttaaaagcaaaaataatgtaatatgtaattatttgtaatgtgggtttatgacatgtagaagtaaaggatatgacaatagtcacataaacaatggaagatatgtatatggaattatactgctctaggataactgtatataggaaatataaagtgagaagtgggtagtgccaggtatgacattggaagagggaaatagcatggtggtgttgctgagttgagaaaacagagattgaaatcagggaggctttagcatctggaatttggggccaccattccagagaggatagagctgcagggaaaaataactccacggagagagctagtgattctccagtcctgcatattacaagcccgatggactcaaagttggagatagagtccctgtagtctgatgtttgcctctctaaattgcttttgaatgcattcgaaatgcaaattccagaatgcatgagtaatatttctgtctctgagtttcctccaattatatttgttcttgaaagtctggtgtgtcctcccagtcattcattctgatttttctggacaataggataatattttatgttttgtttctagcatacttattgatgaactcaaaatggttttcttggacataatatcaagttggacttccattttcaaaaccataggctttgagaggcctatggcaggcctctcaaagtctttgagaggcctatggcaggcctctcaaagtctttgagactttgggaggccaaggcaggagaattgcttgagcccaggagtttgagaccagcctgagcaacatagcaagacctcatctctacaaaaaaatataaaaaattagttaggcatggtggcatgcacctatagtcccagttactcaggaggatgagatgggaggatcgcttgagcttgggacctggtcaaggctgcagtgaccgtgatggtgccattgcattctagcctgggtggcagcaagatcctgactccagaaaaataaataaataaaaaataaaaataaataaaaacaaaaaaaaaactataatgaagaaactttattttatttcagatttttaaattaatttttagattttattgtcttattttttgaggcagggtcttgctctatcacccacgcaagttcagtggtgctttgagcatttcatttacttacatatttcccataaccatatttgtgctgctgtctcttgattatttatttttagatactaactcatactatcctaccatggtagatgaggattcaggtcttttgctctgctcttgcccatccagtacacatcctctctatcctcccaatgtaattatcacacaatacctcgttaaatcctgtttggtattttattatgacaatacaaatactcatcgtcgtgtcatagtttttttaaattgcatttcttttcttcagaacctttttattcttcctggtgtaagtgaccactttgctctgcttaatttcccgtgtaattgtcaccaatttatcctcaaactctccaccacgttgaattacttaataaaaggaatttagcagttcctttttttcccatggagatattcatactggagtcttgcattctcctaatctggactgttcgttctagagacctactgcataggtactatcctaggactacctttcatcgtcttcatggaatttatgttgttctctagtattggactctgtttcctggatcctgtgtggtgatagctgcctgaggaaggttccattggaagtaaatatttcataatcttccatgtctgaaaaatgccttcatattgtattgatagtttgtctggacatagtattctagatttgaaactattttcctcttagaatttagaaggcattatgttgtcttttaacttacagtgttgctgttaagacatctgacaccattctgagtctcagtccttttattacagcctttctctctatatctggaagcttttagaatgttttatttattcccaatgtcctgaaatgttatgattgttgactttgtgtgggtcattatttattatctggacagctgcctcaaatctacgagcttttcccaagtttgtgactttcaaattaagtttcaacttactttttctgttatatctcggtcaaaaccataccagctgaatcaatttaccttaagaagtcaatttctgatggtgaggtgtttgctataattctttttcttgctctaaaattatcttggctattcttggcccttcatttttctatgtgattgttagaattagcatattggtttatatccatacatgtacatacatgtgaacaatccttcataaacactggcttatgtatttaagacctgctttgaaattagcttaattttgggaacatttatgtctataacatggaatcttctcatctatgaatgttgtgtttctttttattgtttcaggttttatgtctgttaatacagttccatgatgtttactattaatccattacctagatgagttagatttgctcctaaacgacttatggattttttaatgttacctgtattataaatgatacttgtttaaatttgcagtttaatagtgtgttgctcttctttaggattagaattgattttgtatattcatcctgaatctagcaatcttgctaattttttatcggtttaaaatagtttatagattcttctagatttttcatataataaatcatgtaatccgtaaattatgagaaactttgggtttgtttcttcacaatctttatatgtgctatttttttctcttaccatggagtctaatgaccttcagtacaatgttaaataggtgcagtaatgtttctgtagcttcaaattaatttaatgtttgcagttagcttttggtatatatatcttatcaaattaagaaatcccttctcatttctgattaccagagtttttttgttatgattctggttgtaactaaattacttctctgcatccatcaagatgatgttaggttgtttttcctttaatcagttaatctgataaatgacagcttttccattgttaaatcattcattctttgagtaaatatgactttatcaagatgttatattgcagtattttaacacattcctagttgactctactactattttatatagtattgttacctggcattcatacatgacattggtcatatctcagactggagtataattttttttccttaaattgttcttgtctgatttttaggtttaggtcattttagccttataaaataaacagaggacccatattttccccttacccattttggctctagaacagtttatagtacagttgtctgttaacttatgtcattggtagaatttacttttaaatcaccttagcctgggtgaagttttgttttcttctattttattttgttttgcagatagattttgtactattgattcaaatttttaatgattataggtctgttggactttctctttcttcctgagttttaatacgttatagtcttttcaatgaaaattgtccattttctctgagttttcaattgtattgccataaagtagttcagaccaccttcttcctagttttaacatctttgttacagtgtcattttgccccccttttcctagtattgtttatttgtgcttctcttttccttcgtaagttttgatacagagcattctactgttcaattctaaatattttccaacttaagttagaattcttctatgggccactatttagtgatatgcctttttaatattcatagtattatatttatttgtttagttagttattcctggtttcagtttactgtagattgggtctatttggtatcagatttttttggcattttttgaaatttgctttgtgattttgtaacaggccagtttttatatgttctatgtttatttgaaaagaatactttttttttctaacttttgggtacagatgtatatgcccataagattaaaattgctaattttgtcattcagtttttttgtgttcttaaccattttatttctctgatctatttattcgttttttaaaaatccttatgatggtaaatgtgttaacttttctttgtaatcatcaatgttttgcacagctcttttgtagctttgctgttaggtatatattattcagaattgacatttcttccagggtattttcttttatattatattaatgaatttttaaaaaatctcacaatgattttggcatgaggatatatttaattgatattactgtagctaccttaagtttcttttctttatcatatgcctgatatatccctttccatccatttacttttaactttcctgcgtccttatgttttaagtgcatcccttttaaacagattattgctgatgtttttcccatttgttcattttggttttgtgtgttgtcctgtgtaacaggtttgtttaacaggtgaatttaatccatgtataaattttgtgattattaatatacttatttctagtatcttacgtgcagtttattattggttttgcttgtttctttgcatgtatgcttgagtttgttttcttctttcttgccttctgttgacttgatcaagtttagcttttaaatttctctttgtttggaagttacatttctaagtattttagtgtttatctttacatttttaaacatttgtagtttacctgctgtctagagtttatcggtttttctgccacattccctatcaaaacaagaaacttagattacttcacactgtaattaactcaacgtgtaacactcacaacaaaaattaactcaaaatcggtcaaagacctaaatacaaaaactaaaactgtgaaactcttagaaaaaaaatagaagggatacttttatgaccttggatttgtcagtgatttcttggggatgacacaaaattacaggcaacgaaagaaaaaaatagataaattcggcaatatctccattaaaacttctgtacatcaaagggcacgatcagagtgaaaaggcaacatggaatgagagaaaatatttgcaaatcatatgtctaataacaggttagtctctaaaatatgtaaaaactcctacaagtcagcaacaaagaacaaaggaccctgttaaaaaatggacaaggtatttatttatttgtattttattttattttagagacagagtcttgctctgtcgcctaggctggtgtcagtggcgtgatctcggctcacttatcctgcctcagccacccgagtagttgggatttcagacatgcaccaccacacccagctaattttttttttttttttttttttgtagagactgggttatgacctcttggccaggttggtctcaaactcctgacctcaagtgattgacccacctcagcctcccaaagtgctgggacaaggaacttaaatagacatttctccaaagaagatatttaaatggccaattagcacttgaaaaggtgctcaacatcactaataattagagaaacacaaaaccacagggatacaccatctcacactcagcaggattgctactatcaaaaaacagaaaataacaagtgttgtcaaggatgtgaacaaattaggatccttgggcactgttggtgggaatgtaaaatatggaaaatggtataggtagctcttcaaaaaattgaaaatagaattaccacgtgatccagagttcctcctctgggtatatacccaaaagaagtgaaagcaaggagttgaacatacatttgtacactcatttttagagcagcattgttcacagtagccaaagggtgacagatgaatggataaacaaaatgtgctgtatacatacaatggaatatcaatcaattttaaaaagaaaggaaattctgacacgtgctacaacatggatgaaaccttaggacattatgttaatgaaataagccagttagaaaagtacaaatattttatgattccacttatgtgagataactatagtaatcaagttcaaagaaacaaagtacaatggtggcttccagggtctaggggaaggggaaatgggggaattactgatgggtacagagttaaaattttccaagatgaaaaaattttagagaaggatggtggggactggttgcacaacagtgtgaaggtacttatgccattgaactgcacacttctaaaaatcattaagatagtaaattttatgtctatttttaccaccattaaaaataataattaaaaatttaaaaaacctaagaaatttagaatacttgaatcctgtttacaccctcagtaatatgtttttgtttttccagtgtttaatttccaacttctttttttttttctttttttttttttcagggaggtaaagtgggtggtttttaaaaatttttatttttctatttgtaaactgacaaattatagttgaatacatttatggggtaaacttatttttcagccctaaggtggttactcctgcctctttttctagtccttgtcctccttcttcttcattatgttatccaattaaccaccatttaaatgtattagtaaagtttactaatatctttgttcataattgcttctagtatcacattcttccatcttggttaaatttcttgttttccgaagtataccctttagtgcttgtttagccgaaaggaaatgttagcgatagtttactcagtcttgtgtgaaaatgtatcatttctgtatcataatttaggtaggtaggtaatactatattgacaattattttttcttatcactttgaaggtacaacttcattttcttctgactgcaattcttagttattaataattcagctgttggtctaattgtcatttcttagtagataatctctattctttaatgtttttaaaatctctttggctttggtattctgtagtttaattccaatgtgtatagacatgagtctggttttatttatcttctgagtactttttgttttttttgtttttttttttttgagacagggtttcactcttgtcgcccaggctggagtgcagtgatgccatctctgctcactgcaacctcaacttcccaggctcaagcaatcctcccacctcagcctcccgagttgctggtagtacagacatgtgccaccatgtccagctaatttttgtattttttgtagagatgtggtttcacgatgttgcccaggctggtctccaacttctgagctcaagtgaaacacccgcctcagcttcccaaagtggtgggattactggtgtgagccactgcgctcaacctcttctaagtactttatgcccttcctgcatccaggaattcgagtcttatatcattcttgaaaaaatttaagctttgtctctttggatattgctttccactattctctcttttatctcattctcttatactatgttgaacttgtccattctagggtctgtacgtcttagcctttcttccaaattttccgttttttaagtcttcatattagatgctagtaatttcttcagctcttcttcaggtttattattctcgtcaactgtatctaatccactgtttacctatttattacgtttattttatttcagtgactattttcatttctaggacttccgtttgatttttaaaaacttttgtgtttgttgatttttttaggtctttaataattttaaacatgcttatttcatagagtggatctgattgttgttagggatctattgttctgtttgttgggatttctgagttactcataatagacagtttactcatttggtttatattattggattgtgagttcatattcagcaagattttatgtttaagaattatatctgccaaatttgagcatgtgtcctccagagtagatttgaatttgttttgcttcctagaggcaactaaccttgggtcagtgttaatgccggtttcttggcttgggaacttttcaaccacagaagcggtgtgcatttgaatcccaaatgttgagactatgtgatgtaatgttacgaatttctacaggaacaatatttttcattcatcacacattagtcaagatagatgaaatgtcttgtccgtctctgctttgtggcagatttttataatgtaccgtttttcttacagtatacgttttaaggcaaaaggtatgtatatagggcagcctttgtcttcaaactcgccccctcatgtaagctaaggataaggtcttttcttttgttcttacctcatataagcataaggtactcgcttttgtgtatgttaaaatttgagtacctaggaaatgaaaaccaacaattccccaaccctactcatctctaatgcttattatcctgattctcaagcatttcttgattactgacctctaagaatctctctttgtaaaaaagttcttttatatgtttatacaaataattgttatattttatctagctttttttttttttttttttttttttttgcttttgagaccgagtcttgctctgtcgcccaggctggagtgcagtggcgcaatcttggcttactgcaagctccgcctcccgggttcacaccattctcctgcctcagcctcctgagtagctgggactgcaggcatccaccaccatgcctggctaatttttttgtgtttttagtagagatggggtttcactgtgttagacagggtgtttgtctagcattttaagagtttgtaatggaagggttttcaagtcatttaatctcagtattgctaaaatgtaagtttatcctaattattcagaattggaaatgtagtctagaaaatccaaaatattaactggtattctactttaggaatgttcatgttttggataagttcttctaaaacatgtaaagggctaatattcttttacttcaaagtaccttacaacatgcatacccaggatttttctagttacctgttttattttttcttccacttttttacagagatagggtcttgctgtgttgcccaggcttgtctcaaactcctgggcccaagtgattctcccacattggcttcccaaagtgctgggattacagatgtcagctcccatgcctggttttaattacctgttttctaattaaacctaacctgctataacaagtactcaactttttttctctattggaactttagattttgaaggatatacctcttcttttatagttttttaaattagtaagtagtttgttgtacattattgacgtgtattttcttaggtttctattaaggagtttgaacataatctccaggcttctcatagtgttggcctaaatatcaggagctttttccccccatctcattgtacaattttgacggtttcatttttttttttttacacgtataggtttgacaggtaattatcaataatgagtgttctaaaccaaatattcagtttgttcttaattggtatgatggtttaaattaaattgttcctctcaatgtcatcagttaagtaacactataataaaagttctatagtgttatgaaatcctgaaaactattaatgtggggataatatacaatttaacatatatacaaggattattattatttttcagataatgacaaagatgtgtttatgagataataatgtctattgtgtatcttaagtaactatttaaaatattttatttctaatataggagattaataaaaatgtaaatttcttcaggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagttagtatgttttacttttgttcaaattaatgtggtaaataacacatataataaaaccatttttaaagagaaaatatttttctaaaaacagtgaacaatcacatttctatcctagtatgggacaggacaacataaatagtcaaaatccataaattattcataagttattagttctaattttcttgtattttattagagatgccgctaagtaggaaattaagtggtctccccagtagaataacaaaggtcgtaagtagagaatttagatcattgcttactatagtatatgtataatcatgactagaatatgtgtaaaaaaattttcaactttagtggtaataagtgcaatacaaatttaaaataaggatgagatacttttttttcttgtcaaattagcaaagatcaaaagaaaaatagtactctgtaccataaataatgcagtgagatgggcattctaagacattaataggaatataaattggtgtaacctttctgttcaggaagtttacaggtgtgcacctagagccttaaaaaatggttagaggttttgattgagcaacttcagtctaggaatctaccctatgacattctcagtagaacaaagatatatgtacaaggatacctattctaacgttatttatgatcacagaacactagaagcaacacagacacacaacaagaacaaattaatgaaacgttaatatatttagtactaagtgaaatagactgttcataataataagaagaaaggttttattagcagtcttagaagattgtgagcagttgcaaatacttagaatatgaatatccgatagaagggaatgataatctattctttttaatttgttctagtgaagcaattatgattagttgctttacatgtataaaaatcagttttatagggtttatattcttcttcctgtttgcaaagataatgtttcatatagttataaagagttgaaagactggaaatagcagcagggttgtaaatagcatgtacatcatttgaattagaaaaaaatattgtagtatatatttaacagcacagattacagcttcagttcaaattctggttctgccacttcctagatgtgtaatgttgagaaagttacttgaattctgtgtgtctttatttcttctataatattagcatagtaggagtacccacctaaaatgactgttttgagggttaaatgagtaacgtactttaaatagtgtcagatacatattatgtcctttaaaaatatttattattagttaatcattagtatgtaacttatatgaccattatcaatcatctatcttgatttaaatagagtcaaattccactactttgaagtaatttctcttcattctgatagcagtttaagatatctaaggtacaatgtattcttctttctatagcgcatgcatgattgagtcatatatgaaattaaaagtcctaggaaaatgatcttctgtcattcatccctgtattcctttagtattagtactttgcaccaacatgcagttattagatatatttaaaataaaatgtatttttaagaaaataaataagtcaaccaactacttagtatgttaaacactgatttatattttgtttctgtttttctctgtttaggagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgtaagtatgacactgtgaagaagttctgtccctctgtttctttctactatggttatatagtaattttttggtttataagtattttgctaggatgattttacaatgatcagttattagtcagtgatcatggcttctggtgcttattctgtcacaaatcaaattaagaagaaagttaactgaggtgaacatagttatttgtgactaagaacaaaattaaaattcaaagttttacctcttagataagttatgccattaagcttcgtaagagaacaaattagatatttaaaaaagcagattttatgattgtaaagtgcagaggttggcaaatttctccctaaaaccataaaactggacaaaattatcaaaatcaaccatgtcagggcctgatacaacaattgaagagaaataaattgagaagcatttatttgtgaaaaactgctgaactttagtttaaagtcacatataccacacacgtccatccccactactgacttggtctgggacagtagtactagtagcatggaactggatagaaaaatcagcagctttgctgatacagagggcagattccaggactaaatacccaagcccagtgtgttgctgctaacaatagcaaacttggtaggaaatcaatagggaaaatagtccacagacgtggtatagctctgaggtatagccctgcctgaggtgaatacagacctcaagccaattattcggccagtccaatagccaaataattcaaccattcttaacttgtgagccatgccaaaacaggccaacatagtatattgacctctgctataaccctttaggttatatgagattaaaatttaggaaaataagaacttaaaatttttgagttttttgcctttttagccttcctcttttttttttttttttttttttttttttttgagacagagtctcgctctgtctcccaggctggagtgctgtggcacaatctcggctcattgcaagctccgccttccgggttcacgccgttctcctgcctcagcctcctgagtagctggaactgtaggcgtgcgccaccacacctggctaacttttatgtttttagtagagacggggtttcaccgtgttagccagaatggtcttgatctcctgaccttgtgatccgccctcctcagcctcccaaagtgctgggattataggcatgagccactgctcccggcccctttttagccttcttaatttgagcttttatttttattcagttattttatttactatggctttaatcctgtactaaaaatttttatgttaatgttatatgacttaacaaaatctttatttttaatttttgtgggtacataatcggtacacgttatataacttttcactgaaacagtgaatactatttcaatacaataagctgtgatcactgtttgataactgataattgtaaaaccatcctagtactgtattcaaggcagataaaaatttctcatactttcctgtctaaacttcacaaagaataattaaactgacttctcttaccaattttttataaatagaattatatttactgttaacaaattatgaatcattccaaattaaatacatagtacagttgatcctaattattcatggaggttatgttctatatagttgccttgaacactgttagctaatattgaaccattgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaaattaccacaagtattgatttggggtttacaaataaatattagcttctacacaaatttgcaaatacagaatacatgaataataatgactgtattctcaatatcagactttgaatcttcattttactttaattagaattttagagtagcagtgttcatggtctaaattttatatcactaaacaactataccaaacttaccagtgttttaaaattgaacagtcacaatttttttttaaatatttctttttggcattttatatttatagccaagcctacagatcatatagctatctatttcttaccagatgttttttcctcctttaggaaacgatgcccccaccaacacatactgcattttctggccaccatctgccatttgttggttttacatatactagtagctggtaagtttgaaaagttaacatagtttgggccaagtgcagtggctcacgcctgtaatcccaacactttgggaggccaagacaggtgtatcatgaggtcaggagatcgagaccagcctggccaatatggtgaaaccccatctctactaaaaatacaaaacttaggtgggcgtggtggcaggtgcctgtaatcccagctactcgggaggccgaggcaggagaatcacttgaacctgggaggtggaggttgcagtgagccgagactgcgccattgcagtgcagcctgggtgacagagcgagactctgtcttaaaaaaaaaaaaagttaacatagtttggacaatttaaagcaaattaaattgaattgaggttcgtaaaagatgtatgagaaaactttgtgaattaaaactttttaaaaaatagagtgagcctactgctggaaatagaaagttaagcattacaaaatgaatagaacgcatgaaaatcttaactcgttttggaggggaaagaatggaacagagagctcagaatctaatccttaccaatgaagcagtaattagaagagtttcacgctgttgaatattctctagatgtcaagcaggagaactttcaacccattaattctaccatcctttcactgaccctcacttcacttatattccctatttcccccttaccctgtttaaattccattgagaatgattataatcactccttgtatgccatttcagttcctttgactgtctctcattctgttatatttgttttgctaagtgaacattaactattacaattttattctctacctgtacagttccaaatgactagaaaaaatagctgactattcttactggtctactttaaattcatgattaccaacctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccctgcctcagcctcctgagtagctgggacaataggcacaagccaccatgcccagctaatttttaaaacgatttagaaatggagtcttgctgtgctgtctaggctggagtgcagtggcacagtcatagataactacagcctcctactcctcaagccgtcctctggccttaacctcccctgttgctgggattacagatgtgagccactgcatctggcctatttctttctacttgagtttgaaacctctgtcatcctcactttcagcttgcatctcctttcactgaaaggattgaggcaaaccgcagacaacttccacaagctccagttaccatatttaccgcctacttactgttagacccaaattctctgttcttttcatggatgaactgtgcaagcctctagtaaggccagtatcttccatcccttcctggctagtctagtgcatgttttgctttcatgtcatgaatttttttcttcttgtgtcatctgcatcatcagatcatttctatcagcttacaaatgtcagttctccatcttaatgcaaaatataaaatctggattcctcttcctttacctcttatcaaccatgtctctgctttacattatagaaaatttacttcaactgttgactatattttgtttatgtttctcatactgttgtttcttgaatccattccagtcaggtgtgtgcccccatcacttcatgcaaactacttttatcgatgtcactgttgaccaacatgttgctaaatctaatgatcacttgtcagtcctagtcttacttatttgcttagtctcatcttatttgccacagctccatacttttaaaataccaccttctcctgtcttctagggcacttgactgagtttctctcaccttgctggtcattccttctcagtctccatacctgatccctcctgatttccctggcttgttaatatcagagtgtcctatggctcagtctttggacttctcttttccatctaaactctgtagtgttctcccaaagatttgctgatgactcctaaacgtgcatctccaactgagacctctcctctcgtctacttaaaaatctgtcttaaccacccacttactatgtaaataactttcttttagttctctgatcctgttcaggtgatcctcttaaaagataatcagaacatgtcactcccctgttcagaaccagtccacccatccccaactccagtggcttcatattttaactccaaatcaaacttcttacaaggccctacatgactgccttacttttatctttctgagtttatttttccttgtttactcaactccatccacacaggcctcctttctgggctgtgaacatgccagacatactcttgtctcggggctttagtacttctgtttcatctgcttggaacattctttcttttgatattcccttaactggtcccctcacccttacttagctttttccaaagttactttagcagtgacagctttcctaacttctttatctaaatttttatttcctcctcttcaatactttatttctccctttcctgctttatgttttctccttagcatttaacattttctaatgtaatgaatatctccattattttctttatttctgtctcagtcactggaatataagctctatatgggcaaggatttttgtctgttttgttcaccaccaaatgtccagcagtttcagcatttttatttaaattgtattgaattaaagacagaaacttgcttttgaatttcaaattctagtaaagagggccgtggttggtgcttttgactactactgtttcacctaggtggtcaaattgttttaaactaccagtaacccttcagcaaacttaattttataatttgtggggtttttaaaatcataataatttgggggattttaggttttcattttttaaaatgcttctaaaaacagtttatggtgattttgcaaacaaatttttataattattccagctggctaactgcaagatattcagatctgtgttttaaatgagcaatttaaaaatgtttttgccataaatgtggagtcagttaaaaacaatttttaaaaaatgttaacgtttttcttcaagctttttatcacagtatgaacctacatttttttttcttttcttcagtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaaggtaaatatattttaaatatattttcactttttgaattgtactcacagtgttatgagctgtttattataagtggttgttttatctttgaaaaaaattattttaagtggtgaaaaatcaagttgtagagatgtatgcagaacacagcataataccatttatgtaaaatcacacagttaatagtaaacaacaacaaaatagctttggtctcctgtgggtacatatttatgtttataaaaatgtgtgggaatacctttggggatggggaaatgggaccctcctcacttcgttatagcactttaatgacttttcctatattatttgctcaatctttaagagctctagctcctttcacactgtcattctctgcagcattgcttctgccatatttggtgattttaaaatgcacatacacataaactttttaagattctgagtgagtttcttgagtcttcaccttcagtgattgtttactccacctggtttcatccagtccatcctatggtaataagatatgtcttaagattacaatacctaaaactcttctttaatcgcagtttccagcaaatcttttataatctcctgctcataatttttagtgctctctctctgaccccttaactccagtatttcttcactgccaccgttacctacaagtctatcaccgtttaactctgctatttataccctcatttttcgttctctggtcagccatagtcataccctggcatataccttcaaatctattgttcctctttctctttgtcaaatacctttggcagaaccccaactgtgtttgaatacaactttgtatcttcaactatccagctgaagacagcttgcttaaaacacccacaacgtgctgactaatattaattcagattcacagacactcacctcaagtcagctcttcatgctatttcccctagtctatttccctatcctgtgttgtaaaatccagtgatgatttctgtcttcaccttttaacctatcagcaatatttgaccctatggaccttttattccttctgataacgctctctttttttttttttggcttctggggcactttatctcctggttttctttttcctcataaacctgtccttcccagtctcctttgctaagttttccttaactcttcgacctttgaatgttagaatattctctatttgaagcaagtctctaattgaatgaggccttcagtgaaggttttcctgaccatcctatttataatttaatcatatatatatccccagtactactgtctcctttttctgcttttttctctaaaataaaggatgtaacatattttacttacatattttgtgaatgaaggaatgtatttatggacaaataatcaggaacttttgtaactaatcaaagttttacaatcacaaaactttactgtcatacttttagaggcccagtagagaaaaaggctgtgtagacatcaatagaatggactattttctgtttttccgtaagttgttaagatctctgcatatgaattacttcccttttgtgactgaaatttttctgtttcttttttttcctgtggtgatacacatatagcaaagtgtgcaagcattctacttttaagtataagcctaataaatatttgtatatgtatacactgatgtaaccttcacccatattcatgtgtagaatatgtccagcatagggtaaagtcctcacatgtcccttcccagtttgtaacctaccactatgaaataaacatcatcctaagttgtttcaccattaatgaatttttaccggtttttgatcttcatataaatggtatcatacagtatattctcttttgtgtatggcatctttcacttgttttttgaaattcacccatgttttgtatatatcagcagtttgctctttttttttttgtactgctgtttagtatttcattgtatatcagcaataaaaaattacccagtctgttgttggtaaatatttgggttatttccagatgttgactactgtgagtaaagttcgtgcaaatatacttatctatttattttggtggtcctatgtactatttctctcagatatatacctgggagtacaatttctgggccatatagtagaggattttcagctttagaagatattttcaaagagttttctaaagtgactataccaatatatagttctactaataatgtatgagttctactgtcttcaactcctcaccagaacttatcgtccgcgtttttcacttgtagccattctggtagaagtatagtgatgttctgccatgattttaatttgcatttccctgatgaataatgaggttgaatatcttttcatgtatttactatccatttggatatctagtcttgtgaagttttggttcgaggttcttgcccatttttctattaggtctttatatatctttttcttaataatttgtatgttactacttcacaaacaacgtagaaacctttagacaactccttgtatgactgttgttacatagtttactttaatctgtgttataaatcttttaatacacttttactccattgttgctttatgttttctttactcattaattttaagtatctttttatttacccatatatttacccgtttggtgctttttatttctccctagtgatccatgtttctatctggaatcatttttctttagcctaaaaaacttcctttattgttttcttgtaatgtgaatgtgttgtgacaaattcttgataggattttgttgatctgaaaatgtctttatttttaccttcatttttgaagaatacttgtgctgggttagaattctagcttggcagctttttctttcagagctctactgtattatttcattgttttctataataacttccataatatttcttgagaagccagctgttaatcttaagctcttgaatgtaatgtgtatgttttcccttctggctgctttcagtattatgtccttaacttcaatttcaaatagttggactgtgattcacgtacgtgtcgctttctttatgtgaacagaaaatcctggttgagattcattgagcttttgcaattttctttgatgtcttttatcagttttgcaaaattctaagccataatctctgtagatattattttgcctcatgcactttctcctctccttctgggactgtaattgtgtatatgttagatggtatctcacatttcctttatgctctgttctgttccttccgttctttctgttttttgtgtgcttcattaagatattttctattgatctgccttcaggttcactagttctggcttctgctttatccattttgctgttaagtccatctaattagtcttaatttcagatattgtcttttttagttaaggattattcatttgattctctcagtttcagttttctgttgaaatttccccatatttttatgtatttttttctctgttttctttaacattttaatattttgaggtccttatctgttactttcaacaactgaatcttctgcgagcctgcctttctgtttttttctttcatttgtcatgcttttctgcttttccaaatgtctcatgtgaaagatgtcatgaataaaaataacacagagaaggaagtttatattatttttgccccagagaggtttctcccttttcattccatcaagaattgagcttggacaagactaaattgctttttttttttttttttttttttttttttttttttttttttttttttgggagacagagtctcgctctgtcgcccaggctggagtgcagtggtgtgatctcggttcactgcaacctccgcctcccaggttcaagcaattctcctgcctcagcctcctgagtaactgggactacaggcacgtgccaccatgcctggctaattttttgtatttttagtagagacaaggtttcaccatgtaagccaggatagtctcgatctcctgacctcgtgatccgcccgtctcagcctccctaagtgctgggattacaggcaagagccactgtgcctgcccctaaattgcatttttaattagactcaaccctacctttgatttcaaatgcccagaatcgggagctggatagagcctagttgggcctctttctccttcacttcctaaactatgggagatttattctgttcttcagccttctgccctataccatttccaaatttggtgtcttgatgaagagactggccatgtatttgaagcagattctcttcctcaagcagctctttgtctctgaaataattctgtactatcggagatttctgtctgacttttcaaagctccctaacttcccatgcagcccccaagtacatcaattaaaatataccatgggaataaaagcaccatatgcttagggactttgagatttccaaattgttgcaccatccccacacatcctccagaagcttcagtggtttttctttccagcatgttatctctcaatttaaaggccaggcttgacctaagtacactcacagaaatggataaggcttccaggtaagaagcagttgtaatagcctcttcacctcagaatgcctcacttccctggctcactttcccaactccaactgaaaaagcaaagagaactaagtaaaataaaccaaagatgtttttaaaaataagattttctcaaattatgtattgaatttttactttctacggcaggagaaacaaagcagtgacctgttgcttcctagtccatccccttatgactaagaatttcctatgttttgggttttttttaaatgttttgaattctttaatttgttcttggtatttttacatgtgtagtatcgtttgcacagagcaaagtgaacaaaaatgtaagatcattgccttttggtatgaatacttgtttcatagcagtgacatagattaacatttaaactgattcattcatttattagctgtttattgagtatcaaacagcccaggagctgtactgcccatgaccaggaatgtaataaaaagcagataaaggcaaaaatacctccccttgttatgtttgcattctgttttgaggagacagacaataaatcacatacaaagtagggtcatccactgagagttaggaaggtagaggagatattagatatttgacaagaaaaagagaaaatgtgaaatggtcagtatggagacgaaaagagtaaatgagctagggaaatagtttaggatcgccagatatttccaagttatttaagttcagtaatcatgagttttaaatgactgtgtatttttttcagccattttcagctacttgggtaaaatcatacagtaggaggagagtagaaattatccaagatagagggccttctagaataagtacaatggaggagagaagggtaaagaaattgaaggtatttgcaaaacagtgatggaccaaagaatctaaccagggtaagtaagaaagtaaagaggaaaaaaatggaaaatgttaggaacacattgattggcatttctggttggaatgaaaaattgttgaagtggtccctagagtagtaagctgtacagatgagagagatgattttggaggccatgcagttattgataatgacaaagtgtatagttgaatttcttttttatttatttatttatttatttattcatttatttttttattgatcattcttgggtgtttctcgcagagggggattgggcagggtcataggacaatagtggagggaatgtcagcagataaacaagtgaacaaaggtctctggttttcctaggcagaggaccctgcggccttccgcagtgtttgtgtccctgggtacttaagattagggagtggtgatgactctcaacgagcatgctgccttcaagcatctgtttaacaaagcacatcttgcaccgcccttaatccatttaaccctgagtggacacagcacatgtttcagagagcacagggttgggggtaaggtcacagatcaataggatcccaaggcagaagaatttttcttagtacagaacaaaatgaaaagtctcccatgtctacttctctctgcacagacacggcaaccatccgatttctcaatcttttccccacccttcccccctttctattccacaaaaccgccattgtcatcatggcccgttctcaatgagctgttgggtacacctcccagatggggtcgtggccgggcagaggggctcctcacttcccagtaggggcggccgggcagaagcgcccctcacctcccggatggggcagctggccaggcggggggctgtccgcccccacctcctcccggactgggcggctggccgggcagaggggctcctcacttcccagtaggggcggccgggcagaggcgcccctcacctcccagacggggcagctggccgggcggggggctgacccccccacctccctcccagacggggcagccggccaggcagaggggttcctcagttcccagtaggggtggccgggcagaggtgcccctcgcctcccggacagggcggctggccgggcggggggctgacccccccacctccctcccggacggggcggctggcctggtgggggctgacccccacctccctcccggacggggtggctgccgggcggagatgctcctcacttcccagacggggtggctgccggacggcggggctcctcacttctcagacagggcggctgccgggcggaggggctcctcacctctcagtcggggcggttgccaggcagagggtctcctcacttctcagacggggcggccgggcagagacgctcctcacctcccagacggggttgcggccgggcagaggcgctcctcacatcccagacggggcggcggggcagaggcgctctccacatcccagacgatgggcgggcgggcagagacgctcctcacttcctagatgggatggtggtggggaagaggcgctcctcacttcctagatgggatggcggccgggcagagacgatcctcactttccagactgggcagccaggcagaggggctcctcacatcccagacgatgggcggccaggcagagacgctcctcacttcccagacggggtggcagccaggcagaggctgcaatctcggctctttgggaggccaaggcaggcggctgggaggtagatgttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggtgtggcggcgcgcctgaggcactcggcaggctgaggcaggagaatcaggcagggaggttgcagtgagccgagatggtagcagtactctccagctttggctcggcatcagagggagaccgtggaaagagagggagaggaagaccgtggggagagggagagggagagggagagggttgaatttcttaattggtgaaccacaagcatttggggtgaggtaattttttcacatgagagagagtttcacactctgagatattgaacattctgagtttccagatgttaaatgcttgtagcagtctcctcatgtgctgtgtcaacaactgactcccgttctcctgtccccttacataaggtgatggtaccacctgcagtagagaaccactagtttaggatgtggccagttaatctgatggttatgctggagagaagtctatcagctagattgttttgggctgcagatgtgagaattcttaaataatatggatttattttctcacttaagtcagaagtaaatggtttcagtgccaattttagggtagcttccctattaatttcttggctttccttacatgattccacaatattgtaagcctcaactttcagatgtaaactttggaaggtaagacctcccttcatacaccagattcagttcttcatatatcatctgacagacataccaggcatttcatttatcacacggtgatgttccctgctaggacaaaaaggagctaagtagattcattggcagagtacaccaagaattccatcttcatatctgcacatatccagagacccagaaagtggaaagattcatttagtttcatacatctttcatttaatgggagattaaaacctctccctgaagccccctagtggacttcttctcaaggtaccatttaagttctaactaggtcacatacctaattcttgaccaacacttgcaatgtagaatggaattattatgattaacttaaaccagccagttttgactgggcccaccttacatgtgcacactgtagcctgataattgaatttggttcacaagacagaagagatgaatagatgtcgggtaaaaacaagcagtatctgccgtaggggatttatgtgcctcagaagtcagtgttagatggattatctattttgatgttaaagttactaagaataataagaagagtagtaatggaaagaacagcagagaacaacatgtaaaatccttatttaaaaaagagtaagatagggaagacaagtggataaccacataagcaggaaatggtcatttcagtagacctaggaattttgaggaaagaggtggcaataatgagcgaggatgcctgccccaccttcatacctgtggtaggtggggtacaggaggaaaagtagctcctattaatgtccatttggtattctttggtcttttgtttgtttgtttttttttgagacagagtctcgatctatcacccaggctgggtgtagtggcatgatctcagctcactgcaacctctgcctcccaggttcaagcgtttctcctgcctcagcctcccgagtagctggtattacaggcatgcaccaccatgcgtggctaatttttgtatttttagtagagacggggtttcaccatgttggccaggctgatctcaaactcccaacctcaggtgattcatctgccttggcctcccaaagcgctgggattacaggcatgagccaccgcacctacacctcccctgcattgggtatttttatgtctccccattttctacccccaatttagatgtcttaaaaaataaaaacaatggatgttcttttcaaaataataaatacggaaaggaccagtttttagtatgttttgaacccaaagagaaagaaatgtataagaaatacttataggatgcagaaaatcaacatcagatgcacaatctagtatatcttatacctttaattcaaattaacaaatatttattgactgccaaacatatagggattatggtttacacacacacacacgtacatatgcacacacaaagtaatcagtaatgatttgcactaactcataaagaattatggtaagggagagacttattatgtgagaatccctccataaatagcagaatacctattttagaacaaagggcaatttcatttctgatgtaaaatggtaaaaaatgttttctttgttccatgtcttttgatgatatctgggaataagcctcaatagagttattgtttttttaaaaccttgtattttttaattagaagtgcaagataaattaatattttctattttaactaaatattttagctaaattgttgagccatggttacctgtagctgggcctcaactttcagacataaaatttggaaggccagcatttctgcatatgtatattaacatgcctaactctccatttgtaaaccagattcagttcttcgtatagcatctgactgacataccaggcttttgagttatcacatggtgatgttcctactaggagaaaaaggagctatgtagttgattcattggcagagtacgccaatagtatttaaaaccaaaaattattagaaggtggattcttttgtatatatatatatgcagtggattttttttttttttttttttttttttttgagatacagtctcactttgtctcccaggatggagtacagtgccatgatcaaggctcactaccacctcaacctccggggctcaagcaattctcccatctgagcctcctgagtagcgggacttcaggcatgtgccaccatgccctgccaatttttatatcttttgtagagaaagggtgtcattctgttgcccagtctggtctcatactcctgtactcaagtgatcctcccactttggcctcccaaagtgctgggattaccatgcctggtctgattttttatgacttaatttttgagtattcacatgctttttgtcagtgagtagatgttttgttctataaaattgtataagaatttctctccaaaaaaataatgttattagttttaagaatttagagtatggtgatatttttatttcttttatccttttttttaaagagtcaacacagactgtccaagctctgcagtattcaactgttgatggtccactaacagcaagcaaagatttagaaataaaaaacttaaaagaagaaattgaaaaactaagaaaacaagtaacaggtaaatatctgtgattcactgttaattcaatttaggaaatgtttaaaaaatggtttattcacacaaaaaacatctattgagaacctgtctgtgttatgtgatgtgagttgcatgctagtcagggaagggcaaataagaatgggttctgctctcaaggagttcacattttggtctgggaaacagataaacagttattgcaatacatatgaaaaggctatcaggaaaaataaatggaggtacgtggagagtacataggaggatcacctgacacagacttacgtgaacaaggatggcttttttggaaggcctattcattttggaatttgtctggcaaagcatatttgtgaggagaggaaaaggtgagttaggagtgaggaagaaggacactagagacaagcagagtgcatgtatacaggcatcaagaaaatttattttctttgttaatgcaattattttttcagtgtattactgagattaaaactaaatttgacaagtgttcgtatacctattattcatttattgcattttttcaataaatatattgagcacctactatgtagcaggtgttgttttaggctcttgggattcaacattaagcaaaacagactaaacaaaaattctttgctttggcctgggtaaaggacagaaaacagaaaccagtaaatatataactttgtaaatgatacaatatgttggaaggtaataagtgctttaaaaataagaatagaataaggagaattagtcagatgtgcaaaatgaggagttttatcattttaaatatagtgctccaggggtaggcctgactgagaaggtgacatgttagcaaaaatttaaagaaggcaagggggttagccatacagttatctgcaaaatatgtgttccaggcagaaggactagccggtgcaaaaactctaaaatcaaatgtgccccaggtgttcaagtaaaacagagagtactggatggctagagcagaatgagcaggcagggagaatggaaggaaatgagaactaaaggggtgaaatgggcttgttgcctgatcagtagagccttactgattgttgtaaggtctttggtttttactcagaatgaaatggcagtttttcgcagggtttagaggcattacatgatctgaataagcagagggatagggagagagagcagaaggtactattttaacgagaatggtgaggcctctccagaaaggtagttttaggcaaaaataagtgaaagagaagaaataatctaatgtagcatcttttataaaaatgactatttaaaatgccatattaatactttgtttatattaaatatatggagatcttagttttgagcataatttatgaatgctattttgtgtttttaagaggctctcctcctaagaaatatctatatatctaatctctgttactttatctttccaaaagtaagttattgtagattgggaacatgataagtgaatcatggagtttgctttggtaccaacaataacattaagagtgccactgaatgtctgtgttagagttgtatgacactaaaaaagcagtagaacagaagaccagctagaatggtcagtgattcgtcttcagagaagcgatatcgatttggaaaacttattcataagcatatctctcctctttttaatagtagaatgtggctttgaatggcagtagcttttgaaagcttgctaattaattttaaaactgccttgaaatagatggtattgatgtaaaatattcaaatcaacaatctagttgttatgtcattcactaaaatagttgtgagcttctttgttagctctatgtaagagctgaatttttaaatattaaaacgttttgctgtcattcacaataatgttctggcactatccaaaggaaacctttgttgatgtctaacccagtatatatagaataataataagtaatttcattttctgagcaattccaaatggtatcgtatttttaattttattgttcatgtgtttattgtaatatatagaaatatagttgatttttatatgtttattttgtattctatagtgttgctgaactcacttattagttctaggagggtttttaaaaaatagattctttgggatttttaattctgacaatcatgtcacctgcaggtgggaacagttttatttctccctttctgatctatatgctttttgtttccttttcttgccttattgcaagaacttgcagcactgtgttaaaagaagaatgatgagaagaacattctagcttcttaatcttggggaaaagcattcattttcctctgtttctgtacttctaagggtttttaaaatcattaatgggtgctgaattttgtcagattctttttctgtatcaattgatatgaacatacgattttcaaaaaataacctgttaatatggtgaattacattggttgattttaaagtattgaaccagccatacatccctgttgtaaaccatggtcatggtgtacaattatttttatatattgctgaattccattcctaatatatttttaaggatttttgcatctatatacatgaaggatattagtctttagttttccttttttttcttctttttcctttcttaccttccttccttccttccttccttccttccttccttccttccttccttccttcctttcttgtactgcctgttttctctgtcaacgtagctggtggctcctgtcaccagcagccaccagaggcctgaacaaaagagtaccagcaggggatccacctgcatgcatcctttctgaagcaaccttgcagtcaggagtcagattgctggtacagtgtcaatgacaacctcgatgtgaacatttaagagtttttagtacttaccttgtggcacgtggcacccctggaggccacacacctggaggtcagggagtgcaggcagacagagaactttgagcaggagagcatggcaactagcagtatatattagggaatagggtgtaggtcactttaagtttgtaagccagtgcttgaatggtccccttagaggaggcagctggaaggcaggatcccagtctgctaggtgggagagatgtctcctgcttgagccccttgggtgtggtgtagaactggaaactgcatcaagagtgactaaaccctgcctctgaaacaagaaagctaaacctgcattcaaagtggatgctgaggcaacataaaattattataaaattatacatttattataaatttatgatttattttaaagtaaaattaaatatgctgtaaatttgtaaatacagttgatccttgagcaacatggatttgaactgtgtggatccacttatatgcagatttttttcccaaccaaatagagattgaaaatacagtatgctttggatccgaaacccaacccaggttggaggtagaagtccaggttccccgtgtggtttctactgacaatgtgtgaggagaggcttgttgtcagccagtgagggttaatgtcctgtctttttctgacatcactcttttttttttttttttttttaatttgtagacagagtctcactctgttccccaggctggagtgcagtgacgcgatctcagctcactgcaactaccatctcccaggttcaagcaattcttgtgcctcatcctcctgagtagctgggaccacacccagctaattttttgtatttttagtagagacggggtctcgctgtgttgcctgggctggtctcaaactcctgtcctcaagtgattcgccctcctcagctttccaaagtgctgggatttttgggatgagtaaccacacccagcatttttctgacaccactcttgcagatgtgtttgagcatctcattatagcctcatgaggttggaaatctagctccccctgcacttgtccattgttgacattggtgacatggggccagtttttttttttctgtgatgtttatctcaagtagaattgttactttctgtgagttgtctgtctttctggtctacccctttcctaatcctttggctagaaagagcaggcttttgttggggctttttctctttacagctgttgtcatttatgggttaccatcttctttagttctaattctgggatatatgaaccaagaagaaaccccagaaaactcaccgttatgttgtttatcaggtcccagtgtcctgaggaagtttttttcttcacatttcggagtcgtcttatgtttgttttatgtataatgtcttagggttttaagttatacttaaaatgggaagaatgggaaatatatctattccttcttcccagaacttgaagtctccagagtaagcttttaaagtataagtctgttgaggtcacagcttcaacatacctatcttcagtggatcctcattgcctccaggataaagtagaaatttctcaattctaatacaaggcccttcattattatgcatgtatttgcctctcgagctttgtctcttgttactacttccttgcccagtgattccagccatgctgaatcacccagtgatgctccacttccttcacatactgtttttttcctaccctttctttctttccttccctttttttaaaaaaatacaaattgaagtctccccttaggacctgcctgatgagtagccccaactttaatttggctctgaagaaaaaaatatatataccttcaaagaaaaaatatatacctccaaagaaaaatacatacctctgaataatatatacctctgaagaaaaaaaatatacctccaaagaaaaaataccttcaatctgtcattcctccagatacttcttgagcaaagtctttgtgtatacaaatacccaccattaatgactgtttctcttgtgtttcccagcagcagtgttctccaatatttttaagtttctggaaaaaaatgcgacagttttataattattgacaacttctttttaatatttgcttctttaccatactctgagcttctaaaggttaggggtaggttatagtaggttttcccactatattcctagtgccaagcttattgccagtattgtataactgacactatatatatatttgttgagtatctgcagacaaaaataaaatttttttaaataaaaaattcatacctcatttaatatttttgtatgagaaaatagaatttttttgtctcctaaatgaaaaatttattataatctataatgtacttctgagactctcgttcttatgttgccttgaggttggggatatgtgcctctgtgtactgtttctgtttctccaaccccaaactaacacacacacactctctctctctctcccctccctacctcctgtgaataggggcattgataataaaggagcctatttttactgattataattagaaataaagtttcttcgcatctcagaagagttacataatgggaaaaatgaaactatccatcttgtggatcagggagatgttttggttattctgccaacctcccactgggtctagtcttaactcctttccagtttatagtgttccactttgaatactgctttaatcatgcccattttttgacctcaattcctatagcacatacagcctgccacacaatttgcatttgattttctactttattatttttttaaagagtgttgctgttgtctaacttacctccttcaagacagattccatgttttatatttctcttccatgccatacagtgccaagaaaataaccccatatgtatgatgccttcattaagtcctcattactaacaagttgaattttatagtcctaaatagcacccgtgagctaagaaccatttagttggtatcagctaacccagtttcgtagtactgttttttcttttgagacagagtctcattctgtcacccaggctggagtgcagcgatgcaatcttggctcactgcagcctccgcctcctaggttcaagtgattctcccgcctcagcccttctcgagtagctgagtttataggtgtgcgccacacctggctaattgttgtaatactagtagagatggggtttcaccatgttagccgggctggtcttgaacccctggcctaaggtgatctgccagcctcggcctcccaaagtgctaggattacaggcatgaaccatggtgcccggcctagtacagctttttctatttgttcactataattagtttttaacaactttatctaaatgtcatggctaattgtgttgggtatttataatagtctctggatttctttcagaattatagccatatttgctatttgttgtagtgaaagtaaaggctctgctgccttactcattttatagtatttgaccaaagttcagagcattctggatttttcgtgatatggggttttcatcttttgggaatgcaacattctgtgttttccaaattacaagtgctgtgtttctctccataatggaggattttattaaatattaggggaggggttatcttttccaacacttcttaatctagtacattattttttacttctcataattcacatactgttgtttaaatgaatgttttgagcttttttcacttttgaaaagtgactgaagtataaaacagggaaatttgacatatattctctaacaactccattgcaaagcagccagaatgaaatggctgtggtgagaactgaaattaacactatattgaaacaaatcagtaaaaatatccttaaagcttttagaagctatcccctgtgatatcatctgttacaaactttatatggtagagaaattttatgaaatactgaattttttgtttctcagagctgttgaaataagtcagtaacaataatttctgaaaaaacaacatgttagagaagaacacttcagaagtagaagaaagaaagtgtgctcagaatggattactaaatgtactatattgctactctaaattgattttccttaaccataagattagattaaaatgaaccaggaagtgacagaagtcagctgccttacaggctacatttttactcttaattatgagaaataacaaaagtaaattaatatttactttagaaattgttgaaatccgggcaaggggcagtggctcatgcctgtaatcccagcactttgggaggctgaggcgggcggatcacctgaggtcaggagtttgagaccagcctggtcaacatggtgaaaccccatctctactaaaaatacaagaattagccagacgtggtggcgagtgtctgtaatcccagctgctcgggaggctgaggcaggagaattgcttgaacctggaaggcggaggttgcagtgagccgatatcacaccatagctctccagcctgggtgatagagcaagactccgtctccaaaaaaaaaaaaaaagaaaaaaaagaaattgttggtatcctaaaaatgttaaaaacttaaactagaaaatatttaaatgtgtttgaaagaaattgatttaaatagaaatattcccatatgaaatgccaaaatttgataaagtgataaaatacagttttctgaatataagactaaacaccatgattaagattaaacaccctatgatttttagttttcttcacataagcattcattaattgatactgttcagatactatgaaaaccagttaatacaactttacatcttcaaaagttaactatgctattaataactatactttcaaagtaggttttaaatctatcaatttattgcactgatatcagttatttatggaatgtagaactatacaatgcatgatacactaatacatttaagtaatttttagactccaggattcatctacacaagtgaattgctcttcccaataggactaacatattaacactgcttcatttattgaaagcatcagtctcaacaatatacaacactttgtgcactggttcccacacattaatgtacaaatgaatgacttgaggatactgtatagattctgcttcattaggtcttgactggggcttgagattctccatatctaagttcctaggggatgctcatgtcacttgtctggggatgttacttagagcagagatccccaattctcgggcgacaaactggtaccagcagactgggccgcacagcaggaggtgaatggcaggtgagtgagcattagcgcctgagctccacctcctgtcagatcagcggtggcattagattctcatgggaccgtgaaccctattgtgaactgctcatgcgagggatctaggttgcatgcctcttatgagaatctgactaatgcctgatgatctgaggtagaacagtttcatcccgaaaccatctcccggactcctgggctgtggaaaaattgtcttccacaaaactggtccctggtgccaaaaaggttgggtattgctgacttagagtaataatgtgtaaagaacagaaaatatccagagcagaaccgataatgagtgttgtttagatttctctgtatcactgacttcaattctttactagtttacttttgataccaggaacatttcctatcaatttattacattttgaggcataggttaaaatcaataatgttgtttcttaaaagcccctcttatctgagaatgttaaacattatttaataacattatcttgtaaggtggaaaagtcagtgcaagatttcctgggctctagtcttagctctgatacacattttgcaatgtgactgtaggcaaattattcaactccctgagtttcttcatctgaaaaataggagaattgatttagatcaggagtttttcagatatttgctctttagaaatcagagtttattcttcagataaatagtggtgaaactagactgagtgatttggaaccaccctgttagaatcaaaaccgtcttacacggtaatttgactaacatcagcactaggatgcttaccaacactgcagtaaaacttgccctttttttggttggttttattgttgcttgttagttttaaatttttaatttttccgaaggtgctgtttttggaagcatgctttttttttttttcctaatgagtatgtaaggcattgttgcacatcttcacactggcatacaccattcaccgtctttacagtgaactgataatgcatttaatttgtcaagagtcatactggtatacactgtcagatctaacactaaattgaaaataccaattttaaaaaaaattttagttgttttaccttaggttcaatcatttgcttttatacaaatagtaaaagaaacattgtcttttgtttttagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggtaaaatatgtgactagatcattaaagctttttctctattttgaatcttgtataataagaatactgaaagcattcataatgaattacaataatacatagtatattttatcttcttaaaagttggtctaaaaatttaggattattttggtgtatgttatttggttagtagctagaaattaagaaactttgttgaagcttgaaagttcagaatcttttgttcttttagaaagttaatagtcaaaggactagattaaaagaatgttattgaaaaagaaacatgaagaaataagaaaatagtagaaactgtttagcatctatagaaaaaatttaaaatacaggcatattttcattataacttactgatatgaacattcttaaaatattataatttaaaatttatttggtgatttgttttaaatgtcagtttttatctttcaaagcagcaggggtaaataagctaaagttattttcataagaactttgtgaaacatttaaacattattttaaacatcaaaaaaatttattgatagctaagcctctgtaacacagcccaatagggtaaataatattcaagcactagagaaaacacttttcttgaaccacatgctgctaagcaccgtgactttcattaacaaatagaaaaatgttgggactaatactagccattgcaaacaagaaatcagtagtttgtggcatagcataagttgtattcaatgatgtaatatattaatataatgcactgataatatagaatgaatgaagtcctcctggggaagatttgaaagtcttggtgccaggaaggagatggagggaattaaaaataaaacaaataacctttagctgatgaaactaatcaaaaggactaaaagagaacgctattaaagaatagattgaaatagaccagtacatttttactttctgcttaatgaggtttcaagcaatttttttgtataggtccatttaaattcattgccaatttaataatatttgtcatttaaaactgttagtgttctatttgctttaataatattatagtaatattaatggtttaccatttttattggtaggattactcagccaaatttagttaacataatcggcgttatgcttcctgctttctactcttctgagcgatttccttggaaatctaaagagaaggatcttggattctttctctaaccctttggaaagaggatgaaaatcagatagctagatttatagtgacaggtggtcaccaatttttaatgttttagtattaaaaatcctttttatatattttgagaagatgatagtgctgacgaaaagaaacagattataccaataaaggactttgagtgatttgcttaatatcctataggcagtagaaaatgatttttctccacattccttgccaacacttgttatcctttgtcttttaaaaaaaatagccattccaatagatgtgaagtgacagctcattatggttttgatgtttacttctcttatgactagtgatgttgaatactttttcatatacctattggccatttgtatgtcgtcttagagaaatgtccactgaggtcctttgcccattttttgattgagttagcaaatattctgattttttataatgccaaactgttttctagcataccaacttccatttccacgagtagtgtagagtttctgtgttcatatttccagatttattacttttggccaatctagtctaaattgagattttaggttttagaaaatgtttggttgtggtcttaatttgcatttctctaattagtaatgaggtcaagtatcttcacatgggtctattgtcgtttacatttcttttgtgaaatgcttcttaatatcttttgtatatttttctgttgggtttttttcttactggttataagaattcttggaaatatttgggcattctaatcttttgtgagttatatgtgttacaaatatctctcagtggcttatctttttgcttttaggaatctttttattaaaaagtgttcttaggtttgttgtggccagatttatcaatatttttatggttagtgtatttgctgtcttgtataaaaaatctgagattttaaaaaattctcctaaatttttatcttaaagttttaaatttttaggtctgtatctcaactattttttgaaaactgtgaagatggaattttgattaaaactgcatttaatcagctgggcatggtgacttatgcttgtaatcctggcacttttgagaggctgaggcaggaggatcacttgagtccaggagtttgagaccagcctaggcaacaacagaatgagacccagtctctacaaaaaataaaaaagttagctgggtggtgcacacctgtcatcccagctgctcaggatgctgaggcaggaggttcacttgagcctggtagattgaggctgcagtgagccatgatcatgtcactgcactccagcctgatcaacagagcaagaccctatctcagggggaaaaaaatgcactgaatttataggtcaatttagggagaattaacatcattacaatattgtctttaagttcttactatctatatttattactatttttctgaatatacacacagatttccagaatagaacggattgttattacttacatacagcaaagaataactacatggctcccttctgtgccaagtcttaccccaagagaaataccctgagagctggcaggataaaaccctacacataaggagtctgtgttgtaaatgaggagccttgaaaacatttatgcaggtgcttatatagaggaaagaagcaactgcttcctgctttctcctgttctgagagagttccttggaaatctaaagagaaggatcttgggttctttctctaaccctttggaatatagataaatattccctctggaaatataagcccagagtctcctgctccatcaaaggaagcccccttggtccaggctcctactctctcccaccccaccttgaaatgtaaacacataacctccagaaggtaaatctcttagttttctcactactaaatcagttataagttactttttaagactttcatttagcccaggtttcggtaaaatttgttcaaaagggaccagctgcaaaaacataaaagtttctctgcattcctaaagtctttttatttgtaaacatgatatctctccatatatttaaagttcttttaaaatgttcttccataaaatttcatacagaaaagactttcatttcttttcttgttttactgtattagctagaacctcagtacagtgttgactagaaatgataatagcaggcatccccatcttgttccccgattttaaagaaactgcctctgatatttcatcgctaataatgtttgctgtaagtttttaataaataatttttatcaggttaaagaagttaccttctattcctattttgttaataccttttatttagaatggatactgactttattaaatgtgcccttctgtgctctattgatatgattatatgattcttgtcctttaataagttggtgtggtgaactacgtttgtagactttttctaatattaagccactgttatatttctgggttaagcccaaatttcttataatactgtgatagtatagataacatttatgtagcaaatatctgttctaatagcactgttgtgaatgctttacatatattaaattatttaatctccatcacagccccatgagttaggtgttattctcattttatgaatggtgagaccaagcacagagaagttagttcacttgctcaaggtcatagaaatagaaagtggtggagctagattttcagcacaaggagtttagctccagacttcatgcatatctactttatatatcactggaactgatttactaattttcaaaaagggttttcactgttttttataagtgagattgacgtgtttttttttttcctcttttcttttttttgatattcagattatactggtccatagaaagagttgaattgcattcctgctttttctcacggaccaatgagttatttataagtatcttttaaaattttcaatatatggagttttatctttttttgttgacttctaatttagttgcagtgtcattacagaacttgctctacgtggtatctgttctttgaaatctactgagacttgcttcatggcgtagcctgttccatttttaaaacattcaatgtgtgttcttgaaaatagttcgtgttccaatttagagagcaagcttctgtgtatgaagcttttcagatcgtctttatattcactatttttttttttttgcctacctggtttatctattaatgactaagaaattaaaatttttcattatagtgatgtttaccaatttttctctgaagttctaacagtttctttttaatgattttgagactctcttatagaaggcacaaaagtttaggataatatttcttcttagtgtattgaattttatcattatgtagtgatattccttatccttagtaatactttttctactgaagtcaagatttcatttcttaatccagtataatagatggcctttaactggttactaatgtatatggatgtgtttctactatctttttttctgtttgtcatgatttttgcatgctgctttttatttcctttcttcccttctcaaaagtttttaactgtggtaaaatacgtataacataaaattaccatctaaacaattttcaagtgcacagttaagtaatgttaagtgtatttacattcttgtgcagcagtctccagaactctttttgtttgcaaaatcatttcttcttcactgaaatttgttgttgttgttgttgacattttagtttactctctagtcttttggtggttactcttggcttctaccatgtgtattaaccaagtttaagtttaagttaaatatcctaaaactatttcccacaaacaatttaaagacgtttaattttacagattgagtatcccttatctgaaatgcttgggaccagcatttggattttggaatatttgcattataccaattgagtatttctaacctgaaaatccaaaatctgaaatgctccagtgagcatttcctttgaacatcatgttggcactcaaaatgttttggattttgaaacatttcagatttcaaattttttggattattcaagctgtattacctctttacagctttatgtgttgttattggccagtattttagctgttatcttttgtttactgtacaaagttaacatttttatagtataatcttatatacacatttgtttacattcacattcatgttaaccattttattagctcttcatttctcttgcattagatctctaaaatcttttttttttttttcctgaaataaagctttactggttcctttagtgcagatctgattatggtaagctctgtcagttttgtttatatgaagcctcagacttgaaaagtaatttttggggtatataattttaattatcttctcatatctttgaaaatattttaccctgtttctgttgctgttgttacttcttcagtgtctgttcttagtctaattttcctcctccccgccttatttgaggatggggaataggtgatttgtctttctttccctctgatttctttacggtcttttatttctctttggtattacccagcgtcattttttgaacacttctggtttgggttttctaaattttttcttgattcataaatgtagagcttcctgtggtgatggatgcatgtctttaattttaacatttatattttttcacttcttttcttttctttttttttgagttggagtctcactgtattgcccaagctagagtgcaatggagtgatctcagctccctgcagcctcagcctcccaggctcaagtcatcttcccaccttagtagctacgactataggtgcataccaccatacctggcctttttttttttttttacattgttattttttgtagagataaggtctcacaatgtcgcctaggctgatcttgaactccttggctcaagcaatcctcctgcctcagcctcccaaagtgctgggattatagatgagagcaactgtgcctggccttatgttttctatttctaaatgttccatacagttcttctataaatctgcttggtcatttttaatagccttttgtcatttttttgtttttattatttcatcctttattccttgaaatatttcatatgtagcaattttgtgttgatatctaatgattttaataccaagatacctttgatgtttatttttattgtttttgttgtttgattgtggtgctttgttctttgagtattttggaatctgtggttgtgagctcattcttgtttgttcttaatatgtgaaaaattcagatttcattgcacttctttcccccaaagaaaatttgcatttccttttgctgggaggcaggtagtggtactgccctgagtccactttagctctcctctaagtttctcattttaattagggagtctccggtttagtttctatctccttgcttctggcttgaggcgtagcctccatgtcaagggcaacacttgttttttatgaaaacaacctcacacatatttattaaatttcacaaatatttattttgaccatcatatcgtttattcctaaactttttcctcatttgtggaaactaaggtactataaggttaaatcagcagctcctgtgcatttactgtattagcataaggaattgagactatatcaggacaccatgccgttaatatctgttcagaagtagtttatttcttttaatttgtcctaaggtgaataattttggctcttcttgacttaatgatagctattctgatggccaaatttggtctctaggttgcagaattggtaacttatattctttttacaaaactgtaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagaggttagtagtcaggcaaattttgtagtgcccatgggatagtgattaaagctgctttttgagactagtaatataatatataatttttaaaatatttctaaagttatttttatagttcattaatattatttaatatggatttaaacatttgaattatcttcctgttacaaggtaaattctcattgggataaatgttttgtttggaaaaaaattataaccgtgaaatctgcatttttcattctgttttaaagctggaagttcatacagaagctctagctgctgaagcatctaaagacaggaagctacgtgaacagagtgagcactattctaagcaactggaaaatgaattggagggactgaaggtatcttttgacttcacatttatgaagcttaattgattttcttctctttaggcttgttaggagtgttagcttgtatactgtattcggtgtgcagtgaaaactagcctttcttcaaacctactattcataattctcgttcttaccagtaggaagctaatacagatttcttaattatgctgaagaaaatggaggactatgtttagtgggaaatatgaatctatcaggagggagttagaatgtttatgcagacctacacaagatgtactggtaatctgcatgggagtcatggttagatatccagaccctctatatatctcataaatgactcaggagaagctcaggggtagctttgcagacacttgtgtctgttaggataagatgataatgggcatagtctaaaacatctcagcagaaggtgctttgcaagggaaattcttgagccgttctggagttagactacctattcttaacttcttgctttcaccagttacttgctgtgtaacatgtaacattggacagaacattatggggccgggcacagtggctcacgcctgtaatcccaacactttgggaggccgggatgggcagatcacttgaggtcaggagttcgagaccagcctgaccaacatggcgaaaccccatctctactaaaaatacaaaattagccaggcatggtgcgcacgcctgtaatcccagctactgaggaggctgaggcaggagaattgcttgaacccgggaggtggaggttgcagtgagcctagatcgcactattgcactccagcctgggcaagagcgaaactccgtcttaaacaaaacaaaacaacatttaacctcattatactttaattttctcctctataaaactatttcatgtcacgagtacatacatacatttgtaagctgacacattataagtgttcagtaactgttagtataatagtattatgtatattacagtgagtgaattaagatcaaattgacgtgatatttttaccatactaagtaatagtctgagtgtggtatctgccttttatcttttttgactggaaactttttccatcctgttttctctgctatatctgtcagcccccatttcacctacttcttttaggaccatgcttagtctagtgtctaattatccataacatgtaagaatcatactccttaaaatctacatactcctgtactgcttcttggaattctgttaatacctgtagcttagctcttattgtaattatttatttgcaaatctgtatatttccaactaaactgtgacctagcttattgaaaacacagacagttatattgttaatttggccctggcaaaggaccagatattgaatacttgtttaataaacctgttaagttaatgaatgaatcatgtggtagaattggtcagagcttactttgtctgacaattgaatttcagtggttgcaagtcaaattcctttgctgtaaatagaaatataaactcttgattttattcttgtttttgttttgggagttttagttcatcatgaattcatagtcctggttagctttacgaagtagagatgtgtcttctatatacctctagagcaggattagtatgtagaagtaattacatcaccatcccagatacttttcagtcagggcctgctttgtttccagcactattctgggtgctttggatgataagaataataaagtacaaactggaagaaatcttaggcattatttttatttgagaaaattgagggtcagaagagttaaatattttagagtcataagtgatagagtacaatgtaaacccaggttttctaactttcattcacatgatttatctaatggtttgctttttatttttttctacaataaacattacttcattggagactctgtatcatgtttacctacttgccaaacacatctctgtgtcatttagaaatttgagataatataacacctacctagtaaataagttaatgcatttaacatgtatagaccagaacctggcatgtagtaaagggttaaaacatattttggcccttttaaagattgtaggaatcttcacttcattgagaatacttttgacagacttaaagagagaaatagccctacaaaaagagttaaggacttcaatatctcacttctaataatggatagaacatatgcacacaagatcaataaggatattgaggttgtgaacaccactataaccaactagacctaacagatacagagtcagcccttcatatccatgagttctgcattcgtggattcaaccaaccatggatcaaaaatatttggaggaagaaaattagatgggtgcatttgtaccgaacatgtacagatgatttttcttgtcattgttccaaatgtaaaacctacttatatagcatttatatcacattaggtattgtaagtagagatcgtgacgttttgatcagccacagactgcatatacaacaatggtcccttaagagtataacggagttggaaaaattcctatcatctagtaacgtcttgatgatcttgaccctgtgtaaaccctatattaatgtgtgtgtttgtgtcttaatttttaacaaaaatgtttcaaaagtaaaacaaataaaaattttacaaatagaaaaaagcttatagaaaatggatataaagaaagatagccaggtgcggtggctcacacctgtaatcccagcactttgggaggctgaggtaggtggatcactggaggccaggagtttgagaccagcctggccaacatagtgaaaccccgtctctactaaaaatacaaaaattagctgaacgtggtggcgcatgcctgtaatcccagctactctggtggctgaggcacgagaatcgcctggacctgggaggcagagattgcagtaagctgagattgagtcactgcactccagcctgggtgacagagtgagactctgtctcaaaaaaaaagatacatttttgtacatctgtacaatgtgtttgtattttaagtgttactacagaagagttcagaaagttttaaaatagtaaatagcttataaaggtatagtaagccaagttttttattggataagtaaaattttaaaaatagtgtagcctaagtataaagtgtttatctatcaggtctccagtagtgtacagtaatgtcctaggccttcatgttcactcaccagtcactaactcatccaggccaatttccagtcctgttaagttccattcataatgctctatatgacataccattttttattttttataccttacttttataccatatttatatgcgacataccttttttatcttttatatgatgtttttactgtatcttttctatatttagagacacaagtgtttactgttgtgttacagttccctgcagtattcaggacagtaccatactgtacaggtttgtaacctgggagcaataggctataccatatagcctaggtgtgtagtaggctgtaccatctaggtttgtggaagtacaacttatgttcacacaaggacaaaatcacctaatgagatgcatttctcagaatatatccctgtcgtttagcaatatgtgactgtaatctagaggtgatttaaagtatatgggaggatgtgtgtaggttgtatgcaaacactgtaccattgtatatatgagacttgagcatccgtggattttaggtattcaagtagggtcctggaatcagtgccctatggatactgagagacaaccatatatagaacttttcacccaacaacagcaaaatatacattcttttaaagtacacatggcagattctccaggatagaccacatgttaggccaaaaaacattttagtaaatggaagaagattgaagtcgtatgaggtatcatctccaaccacaatggaatggagctagaaatcaattacagggaaaaaaaaaacctggaatgctcaaaaatatgtggaaatcaatgaacacactcttaagcaaccataggtcaaagaataaatcaccagggaaattagaaaatacgtgaatgaaaatgaaaatacaatacaccagaacttacagatgccataaaggcagtgctcaagagagaaatttgtaactataaatgcctgtattaaaaggaaggactaaaagggaagaaagtaaaaatcactaacctaactttatatcttaaggtactagaaaaagaagagcaaactgaatccaaagatagcagaaggaatgaaataataaagagtagagcacagctaaataaaataaagactagaaaataatagaatcaataaaacaaaaagttagttggttagaagtcaacaaaattgacagcctttaattagactgaccccttcccaataaaaagagctaaagagagagagatgttgcaaataactaaaatcagaagtataagggaaaattttattactgaccaacagaaaacaaaagaattataagaggaacaactgtatgcccacagagtagataacctagatgaaatggacaaattcttagaaggatacaaataacccagtatgactcatggcaaaatagaaaatctctgcagacctataacaagtaaagacattgaatcagtaatcaaaaaccttctgacagaccctcctgcactccacaaccccactccagcggcttgttaaaaaaagacaggccaccttctaacaaagaaaagtccaagaccacaccacttcactgctgaattgaaccaaacacttaaagaaaaattaacagcaatccttcccaaactcttttttgagaaggcacctgtcgtcccagctactctgggggctgaggcaggaggatcacctgagacttcggaggtcgagacttcagtgagccatgattgggccactgcattccagcctgggtgacagagtgagaccctgtctcaaaaggaaaggtacttgagacttgagcttaaaataaattcacccaagttccaggctgcaagatcaacacatagcaatcagttgtgtttctataaggcagcacgaacagtctgcaaagaatgttaagaaagcaattccacttaacaattgcatctaaaggaataaaatcccttgggacacatttatccaactaaaaatgacaaaacattgctgaaaggaattaaagaaaatctaaataaatggaaagacatctcatgtttatgaatagtgggatttaatattgttaagatgcagtactactacctaaagttatgtacagcttcaattcagtccctatcaaaattcaaagtcttttttgcagaaataaaaagctgatcctcaaattcatatggaattgcaaaggacctggacagccaaaacaatcataaaaaaaggacaaagttggaggagtcatacttcagaacttactacaaagttacagtaatcaaaacaatgtggtactgtcataaggatagacatacagaccaataaaatataattaagaatacagaaataaatgcatgtatctatggtcaattaatttttgacaaatgtactaagtccattcaatggggaaagaatagtttctacagatgttttgggacaactgaatattaacctacaaaagaatgaaattggtcacctgcatcacaccagttatacaaattaactcaaattggatcagcaactgaaatcttacagctacaactataaaactcaagagaccttggatttgataatggattcttagaaataatactgaaagaagaattaacaccaatccttctcaaactctttttaaaatagaagaggaggaaacacttcctaactgattctgtgaagctggcattaccctgaataccagagccagacaaaaaaatcacaaaattacagaccaacgtttcttattaatatagatgcataaataacaaaaaaagtataaattgggctttatcaaaattaaaacttaatgtgtatggtatcaaaggacattattaagaaagtaaaaagacagcttaagggatgcaagaaaatatttgcaaatcatatatgtgataacaatttaatatccagattatatgaagaactacagctcaacaacagaaagacaactcaatcaaaaaatgggcaaaagacttgaatagacatttctccagagaagatatatataaatggtcaataagcaaattaaaaaatgctcaacattactaatcactaggagaattcaaattaaaaccaaaatgagataccacttcatatgtactgggatagctaaaattaaaaagaaagaaaaagaaagtaggtcttaacaagaaggtagagaattggaacccttatatgttgctaaagaaagtataaaataatgtagccacttttgaaacaatgtggtggttcctcaaaaagtcaaacagaactaccacatgatccagccattccactcctaggtatatacccaaaatatttgaacataggaactctaatagatgctttacacaagtgtttattgaagtattattgcagtagccaaaaggtggaaacaatccaagtgttcatcaacagatggataaagaaaatgtggtatataaatacaatggagtatcatttatctatgaaaaggaatgaagtcatgatacatgctacaacatggctaaatctcgaaaacgtactaagtaaaagaagccagacacaacaggacaaatactatatgattccacttatatgaaataatttagaataggcaaattcaggcccgatgcagtggctcatgactgtaatcccagcactttgggaggccgaagcaggaggattacttgagcccaggagttcaaaaccagcctgggcaacagagtgagaccccatctctacagaaaattaagaaattagctgggcatggtggtagatgcctgtagtcccagctactcaggaggctgaggtgggaagattgcttgaggtcgaggctgcagtgagtcatgattgtgccagtgtactccagcctggacaacagagtgagaccctgtctcaaaaaaaaaaaaaaaaaaaaaaagagaataggcaaattcacagatacaaagtagaatagaggttaccagggtttgggtggagtggggaacagggagttaattcttaatggttacagaattttttgttggaatgatgaaaaaattttggaaatagatactggtgatatttatatagcattgcaaatgtaattaatgccattgaattgtgcatgtagaatggttaaaatggaaaattttgttgtatgttgttttaccacttaaaaactattaatgcagtataacaagataattgaattttacacttttaaatgagtgatttgtatgatatgtgaatcacatttcaataaaaaaaatttttaaagaaaacttttaagttgttatatatgatgctgtgatgttactagaggtatttttttttccctattgtgttagtttgttggggatgctgttgtgaagtaccacacactgggtggcttaaaacacagaactgtctcagttctggaggctagaagttcaaaatcaagatattggtatggttggcttctggtggcatgctgacagtctttggtattgcttggcttgtaagatacatcaccctgatctctgctttcatgttcacatggagttctccctgtgtgtctgtgtccagatttctccttttataaggacgcagtcttaatgaattaggggtgtgccttaccgttttgattcgatttacctcttaaaaccatattttaaaataaggttacattctgaagtactggtggttagggcttcaacataggaatttgaaggtaatacagttcaacccatacacttacatttttcacttaatagtgtaataagcatttttactttcattaccaaattgtcacaaacataattttaatgattttaagtagttcaagaagaattttcacatacctagttatttctatttgttattacaaaattatcacaaacataattttagtgattataaataattcaagaagactatccgcataaccaattttctattgttacctttaaaaattctttgcagtattataattgccaaaaacacctttatgcactgctttttctgtatcattttcttagaacaggcacccagaaacgaagttagcgattattttaaggctaatttatgtgataaatcccacaaatctttgcaaatacgagaggccaaaaaagttgtacctctttatttcttggtttattagtggattgttttattaataatattttctgttcataaattctctctttatttgctaatttaatttagtagtcttaatgtttttcttaccaattcataaaactctctgcacagtaaaaattttactttttgaagtgttttcagcaactatttaaccaatttatcatgtatcccttaattttgatcttgtttctttttaaaattatagaagatttgttggtttttctcagtgtttcttctgtcgcttcaaagcttggcttgtccttctctcagagttttgataagtatttaattctgctttcttttggatgtttgttgggtctaaaaataattaactgtttaatctattaggagtttgttttgctaaatggtatgacatgagattgatttttgttattttattgctagctggtgattccaatttcatttattaatcattgccttacccaatgactgaagatgtctcatatattgaattaaattatttcggggagcagatctgtcatagtgatactttagtaaagagttatagtatgttttaatatttgaaaagtatattttcccatgcaccccttggtattttctttgacatttttaccagtttattcttatccacggagtagaaacatgtctccatgcccttctatctccacatttataaagaacttttaattagaattatgtggaagataacatgaaaaatattgaatatgtacatttaatcttcccttttaaatactttgtttcaagacttgtaggtttctcatataaatcagaaatttctcactattatccttcaattaacaatgaaatttttgttatgtttattgcttattttaatatctggaagtattgatttgtgtttatcttatatgctattgctttactcaactatcaattctaacacatttcactagatttatttgtattttctgggtgaacaattaaatagaaatgataaatatgttatttttctttacaatattcatttttttaactattttacatgttggtcagagagacaattttatatgttggtctgaaatgaatgtcgcataagagtggtaatggaagacatcctttttgttgatatttctgaatttactcgatgtatctctgatgtttcacgtaaatagtattttgatagctcaaaatggatacttttaaattaaaagaattactggttttttttatgtaatggttttattgtgggacttagagtagtatttggaattattactggattttataaaatgctattgggtaggggtacatactgagattatcatttggatttttacatactgagattatcatttggattttaaaatttaatctattaaaataattcattttatgacacatttattaataagtttgctgacattaaattatcttcggtgtctgcaataaaacctattatttcttggtaggtttttcttttttacagatggtttaataatatcatttgtgttctatttggcttttcacattcttatcaataagtgatatgcatctgtaaccataattgttggtatctttgttaggttttgatttcaggggaatttttttttcttgaaacttactgtacatgctgctgccatcccaacagtcatcacaataaacagaacatcaaactaaaagtgttcttttctttaagtagttagaaaaatgcaagaatagtacgggtcagtggtaagtgccacagatgtcaatttagttctcattttcatagcgatgcttcagagcaagaatctgccttgctctggttcttctcaagttaagcagacttttgcatgttaggctgcctcataaaccattggacgatctggatctggcacatgaaaagtattttttcgataaatggttaatattgcagtggacacgccagggctatttctctggcccacatcacttcctttgctctttttaaattatatacttcaaacatgaaggagtcagggtatttttccttctactttaagtcaactacgcttaccagtttttattgcccttatgactgacttcaaaaaagaatacagtgacctccagatcttgattctttgttgtccctaaacttaagtgcatagattcttttagttttaaaagttttattgcaactggggagacagataagatataacaaattaatgacctttggaaaattacaaagcttaggaaatcttacagtcataatctgtagtctgtatgtttctgtttaccctttaggcagtacctggaagaatctttggactttacattttcttttctttcttattactgagaggatatttcagccttatttctaaaaaggtagatttcaacccaatttcttctccttcttaatcatacctaaaagtgaagagacctaccgttttttttctagtgtagatatgaaggagatgttagtttagacctttgccatttctcacaggactattgcaaaaggtttctgtctttatttttgtacattctactctaccattcctttgcccattttaatttttttaagacacagatatccttaaaactttttatcagttcttcatcagatttaggatgcagttagatttttctctcactccatacaccaacaataattgtaaataaattagaaatttaaatgtaaagcaagaaatcatgtaagtcccagccaaaaatttgaataaatatgtaatctttgtgtgaagaaaactttttaaaaacagcaacaaagacagactattaaggaatgtaaactgaggaaaatatttgcaatatatggcaggcaaaaagttagtagatttaacatagaattttatttttgttaggatgtacaaaaaatgcagttatatgaatactcatttatattacagaaagaagttatttaaatattttattattcttgtagatgcactaatcttttgttattatttctatagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaaggtaagaatcacattatttactatacagtaaatacttactgagtacctgttatgtgtcaagtattggagatacatagacaataaacatatcctagacctaaaggagaccaaagtcaggattggcagatagaaaattataatacagcatgatagaaaagcaaatgggatgataattctgaacaaaattacttctagctgggtatgatggcacacgcacacacacacacacacacacacacacacactagctgggtatgatggcagacacacacacacacctataatctgagctacttaagaggctgaggaaggaggcttacttgagcccaggagttcaagcccagcccaggcaacatagtaaaaccctatctctaccagggaaaaaaagaaagaaagaaacgataaacttctaagctgagatataattagtaagaaagaagtagctagggaggagtgtccagggaggatgtgctaagatctaaaggaaaagggggacatgccacattcagaaaatgatagctgtttactatgactgaaacataaatagatgagagtggtgagaaatgaagctggaaagtaaaatagaggcaaagtcatgacagaatacaaggcatttgcacattatcctcaggccattgaagaaaggtgacatgattatatttacatttttgaatcaccactcttgctactgtgtggagagtgaagtgggaggagcaggctggaggtaggaatccagctgcgagagatgaggtgtgggcctcaggtggtgatagtgaagatggagagaagtggatggattccatctactaagaagatagaacctggagaacgtaataagcagctgtgagaaatgagggagcaggagaaattatcagttatactcagctttctagatttcaggcaactgaatatatgttattgtcattctcagcttatattggaagcccaaatttattcaatttggtgcatttattcattcagtaatattttttaacctaccatatctgacgcactgttgtagggactggtacaaaaagacaataacaatgaaaaaaattcctgtcccatagaactttctataagtaaaacatagaatacattagataatgataaatgctaagaacaaaaaagtaagaggaaatccgttctatgaagcattcaagggagggttaaattatataaatacaggatggccagggaaaactatactgagaaggtgattgatttcttagttaaagattaaaacaagaagagatgtttatacagatgtgtgaaaagagcattctacatggagaagaataagttttttacaaaatagtgaggaggccattgtggctcaagtagaatgatgggaaaagaatagtagagacgagagaggaggcaacagggggccacatcatgtaaagccttgtaagtcatatttagtggatgcatagtttcttattctgagtaaaactattgcagggaattacagtcatgcattgcttaacaccagggatattttctgagaaaggtattgttatatgattatatacaagattttttttaaaaagggtacacctatataaggcacttaccatgaatgaagcttacaggactggaagttgctctcggtgagtcacaactagaaggtcttcagggacagttacatacatgaaattgtcatttcctatgacaacagtgccttcttcgggaatacttcctgaaggacctgcctgaggttgttttacagttaacttttaaaaaaatattaagtagaagctgtatactctaagataacgatacgaagtatagtaaatatataaaccagtaacacagtcatttattattaagtattaggtactgtacataattgtatgtgctatacttttatactgccgacagcacagtaggtttgtttacactgacatcaccacatacacgtgagtaatgctttacattagtacttaaaacagttacaatatcacaggtaataggaatttttcaacaccacatagtgttcccataagattataataaagttgaaaaatttacgcagttatggactaatgcattatggactaatggcagtccatagttgatcaaaatgtcattatgcattacatgactatattgtagaattctgagcagaaaagtgacaactgatttgtgttttaataggatcactctgaatactaggttaagagtagtctgaattaggtaagagcaaaagtgatgagaccacttagaagacgattgaagtaatccaagcagaagatgacagtggctttggcctagagtagtggcaaaagggataagaagggtttgaattttaatgatctttaaaggtaaagatagcaatgtattgatggactaggtatgggatgagggagaaaaaggaagactcaaggatgatactaaggtttttggtccaagcagttgggagaatatattactagaaaggacgactacaggagaggcaagtttgggattgggagtgttatcaagggcacattttttcccctgacaagactctttcataaacagaaagagctcattttaaacagttacagttgagatgcttattagacattcagttggagatgtcaaataggctgatgtatagaccagcctggatttgggggcaggaggtaaaatcctgagaatatttatcacttccatggcatttaaacctctgagactgtatgaaaacacttagtgaatggatatagatagaaaaaaatttcttagaactgagccttggggtactccaatttttggaagtcaagagatgatgaggaaccagcagagtggatagagaaagggcagtgagaatgacagcataataacaggcaaatttagtgtccttgtgttagcagcgccgaatccatatgtgtttgcagcagcctcaattcttgcctcctcagaataaagaattagaccaaggggcataagacagggagagactgaggcaagttttagaacaggagtgaaagtttgttaaaaagctttagaacaggaataaaaggaagcaaagtacacttggaattgggctaagtgggtgacttgagagattcaagtgtatgatttaacctttgacttggtgtttaacctttgacttggcatgcttctgtggggttgcatcccttctctgattcttcccttggggtgggctgtccacatgcacagtgacctaccagcacttgggaggggctgcatgcacagtgtgtttactgaagttgtacacgtgctcatttgaggcattcttccctgactggttgagtgctcctagaagaaggtcatatgccaccagttaaactccaccattttgcctcttagtgtgcatgcttgagcccacttgcctaactcctgagtcttattgggaagctgctgatcaccagtttcaggcttttctatctagtggtagactgccttttcctggcaccaggtgtgaccaattattattttagagagacagtttaacaaccacctgatcatcacctgatgtggccattcctggttgggggtgtcctcctgtcctgcttatgtctgcctgactgcctactgtaacactggaaaccaagtgaagaaagcatataaagtctgtcagcatgtcaaataaaatgagttctgaatcaaatgagataaggactaaataatgacattgagtttagcaatagcaatatgaaggtcattggtgcctttgataagaacaattttgtggaaaagtagaggcagagaccccacagtaggatcaaaagagactggaaggagagcagttagaggcagaacatagaggtaaaactattgtactttgttgtgtgggtgtgtgtgtgtgttttaagatggaaaaaataacagcatgcttgtaatctgatagaaattatagatgattggaggagagaggagaggaggaaagtactggagcaaagtacttgaggatgttcataatgaaggggttggccttactcgatcctgttttgttttttttaacctatcatgaaaagagaaagtagagtatatggacatagatggggtggtgggaacttgtctgtgtgttgagctctcttgttgagttgggcatattgaacttgtggtgcttggaagacatctttgtggagatgtcaggtcagtttgaaggccacaaaagcttcaagtgtagattcagagatcatcagctgaatacataaataaaaccagctggtgtcattgatgagctaactcaggcagcatgtgtagagagggaagagacagcacctaagacagaatactgaggagcattgatatttacaggaaggatggaagagtcacaaagacagctgaaaagaagccaggaatgtagactaaaactaggagagcatgggatccctgaagtcaaagccagacagcatgtcaagagggcaagagtggacaacactgtcaaaagtggccagcaggttggatgtaatcacaggcagtgttgagttttgagagagctgttttcttgagatggtggaggcagaagccagattttggtgtggtggagagcaactaagcgatgaaaaagtagttacagaatctgtttcaggatgcttaccagtgagtgggaagacaaggatttaggaaatgaattgtgacacagggtatggggagagtttctttatttttaatatggaagagacttaagcttgtttaatgctaacaggaaaaagaatggttttacatgaaaattttactcaatttatttgtgtacatatttttctgaaagtctttgcagtttttttattgaagttgcttctgtgttaggaaagcttcctaaacataactaaatttaacatctgtctatagatagtagtgaagtgacaaatttgcttggagatggaggttggcttattttccttgaatttgtcatttaaattataatttatcttcaataatgttatgtaggagatttttaagattacacttttaagatcaaccattacttacattgtttgttcaccagaaagcaatcatataaaattacccagaactgatccacatggaatttcatttattgctaacatcctatagcatccatcaaattgctgtagatatatgcctgtttgtcacataacaatatagtcttcaaaaacttattccttgctgggcacggtggcccatgcctgtaatctgagcactttgggaggctgaggcgggcggatcacctgaggtcaggagttcgagaccagcctggccaatattgtaaaaccccatctctactgaaaatacaaaaattagccagacacagtggcatgtgcctgtaatcccagctactccagaggctgaggctagagaattgcttgaacctgaaaggcggagattgcagtgagctgagatcgcaccactgcactccagcctgggatacagagtgagactcttgtctcaaaaaaaaaaaaaaaaaaaccaaagaacttattccccttttttccttagaagattttttaagtcttattaaaactgtgtttacttctaagggtaaataagtcatcatgatccacagaactatcattttaaataagctttgtaatattataataataatgtgtatatatgtagatgtaagaaggaatggctgaaagtattgatagaactgttggaaatttaattgaacttttaatacaatctagggttgagaacaaggaatcattttgtggttcatatatcctctttccctaacctctcctttcaccatgctttctagtatatacataatcaaataaggtgagcataggaagtctacacatcacagatgttttcctcagatttccaaatgaaacacaaatagatgttattaagtatacgttcattgaactcattaaaagtaaatgagtgtgacttttaattttaagggaaaggatgaggatttggaagcatcaggctataagtaaagcagatggtgcaatagccaatctggaatactgttattttcaataaaatcaggcaatgcagttccattctggcattttctgctgtcatttgcagactgtcatctgaagacacctaccatagtgtttctccaggatgctaatgtgccctctcactggtgtatttattaatgccttggtgaaaggagtgctttgtgggtggctgaccaggttgcacataataggtccactctgacattctcatctctttgagccagtagaccctttatgctcagtaagtcaaatatctcgagctaattgactgtaggccactattgggtccaaagtccaggcttcaattactcagcctagcagtgaaaaactacacctgaatattgagtcaacacattaaaccacaaatcctagatgagtatgtgcatttgataaatttggctgtatttaattttttatttacccaccttggggtaacacccttctgacctgaaggaagaagctgaggcacaggatatgtttaaagagtttgtttgagccaaagtgaggacagctgccaggaacacacttccaggttaccttgaggagtgctccattaggtctttgttacaagtagggttttaaaagcaaaaggaggcaagggctgggctgatacaaagttgtttgacaggcattttcactggtttacaaaataacattgattagtgactggctattcattgttgaactatagcgtgtgagtcatggtctccagtgtatggcattttatggctacttggcatcagtttagagcccacatagcaagtggcctcaagaggtgattatttagctcaaggtgggagtgagatgtgactgctctcacattttaaatacctctctgggcctgataatttaaatggtctcacattcctcagataaaaaaagtttattttctttctcagctcttagaattcatttctgtatgctgcccatactccttccaatataaattgccaaaatgctttaacaccttcattgcttttatatctagtctctgctgtgatcttaactgtcatcataggcctgaagacaatgacaagtgattgggtaggtgttaaagatagttggcctccctttttgatgtaactatttcaggtgaagttaataaatgatttatgcaaaaacaggttggttgcctcaggttatagctgctttgaggaaggggatgagattgcttctacctgcagaggtttgaagcaatacgagagttcagagttctcagcactgtcttttgctgcctgaaggttccaatatgttgtccaaaagacagaaactgagacaaaattaatatagagtttatttgggccaaggttgaggactgcagcccaggaaacacagagaagtgctccagagaacaaaaaagaggctcaggtttttaaagaaaaatcaggagagggaacatacaaaagtctttggtcaggagttctcactggtttgcagaaataacattgattaatgattggctgtacattgttgaactatagggtatgagttatggtgtccagaatatggcattgttgggttaatttatagctattggtgacactcagtctggagtccacatagctggtagattacttagctcaactgggagaataagatgtgactgcagtcacatttcagtgcctgtctggccctgctaatttaaaggggctcgcatttctcataaaaagtttcttttctttctcacatctcatgtcttggggactgcactcattctgaatccacacccttagcctaagaggtttggtcagtgttgtgcagatcaacattttgcaccttctgatgggatgcactgagaaacattgttcttgtggtattccagccaaaaatgaattctttgagactagtcataaacatcagatggccccaggttgagtgtcactgtacataattagagacctatacattataaaactgttgtgagagatagggaagactgaggaactgttctagaccaaggaaaattgaagagacatgactactaaatgcaacacatgtttctcagttggatcctgggcttcataagaaaaggagacatggtagggataacttgaattgtgtctgtgaattcagatggtaagtgttctagtaatgttgatttttttaaattgagaggattgcttcgtgattatggtagagtgtccttgactttgaaagatacacactggagtatttaggggtaatagggcataatatctgcagctagctgcctctcagtggttctgaagaacactaataaaatcggtatatacacaataatagagaaaatgcagtaaaatatttacaattggggaatctgggttaagagtatacaaaaattctttgtactattcttgtaactttgctaataataatgaaattatttcgaagtaaattttttaaaatttctgaactcataaattctaattatgaacaaaatgtttggaatactattgttaatcaaattgataacactaggaagtggctctggcctaatactaaataagggcccagcaactttgtattttgtaagaatattgtggtggaaatacacaaagaaaagtatctaatttggtctcaaactaatttgcctttggatagaacgtaatgcatgtgaagcaaatggcaattattattttcattttggtccattatcaaccttgatgtacgttctctgactatataatctaaagtagccaccctctcccaaatactttttgcattgccatatatatacaatttagaacttattatctgaaattagttcattttactcactcttcattggcagtctgcctctaccagaatataagctctgtgagagcagtagctgtcaagacctgcaacaattccttggcacctagtaagcactccataaatagttggtaaatgaatgaacaaatcagtattattgtaatataaattcctggaacatgctttcaccaggcctgtcattatatataaacaagctgtattctatggggacaacatttctgcagttcaatctgatattttgtgttttatgtaactattggaaaaataatttcaagttttcaaatgacctttaattcccctttttccttttgtgttttgaattgtgttagtcaaagtgaaagggaggaatttgaaagtgagttcaaacaacaatatgaacgagaaaaagtgttgttaactgaagaaaataaaaagctgacgagtgaacttgataaggtgagtgatttaatctcatattaattgagtagtacatgctagatgttcaacactgataggaattgtgggtataactttatatttgacatacatttttgtttaatagtctttctcctgagttatgttgcttctatgatatatgcaattctttgttataataatctgataggagtcttctgaagagagagttttgcttatctccttttattctttgtcccatatatttttttgagcctcttatttatttcactctccatccaattagtccattttggggttactataaaggaatacctgagactgggtaatttacaaataaaatagatttattttggcttatggttctgcaggttgtacaggaagtgtggtgccagcatctacttctggtgagagtctcaggaagcttccaatcatggcagaaggtgcaagggcaagggagggagcaagagagagactggggaggtgcacacacttttgaacaaccggatctcagtgagaactcacttatcaccaaggggatgatgctaaaccattcatgaggggcctgccctcctgatccagtcacctccccccaggccccacctccaacactgggaatcacatttcaacctgagattcgaaggagacagacattgaagtcatatcaccatctgttctctttcttactcttttttttcatatattcatcgtttaccccgtcacggatggctaataagttcaggccaagttaaggctgtcccttggcaagaacagggacaattaggccaaacctggagaaattgtaacagctgattcatattcacaaagaagaactagtaaagctagaaatgataccaggggtaggtgatatctaaagaaaccatctcagcctgatttctagcttgcatacagaatcatgtattgaactgagaagtagccatattcatgaacaaaatttcaaatacttaaaggaatttttttcccacttagtatctcaaatttcccaacttcccaccattctgcatttcttgtgctaattcctagcaagcagttgtaaaaatcctaatattaaccagaagtttattgtttgtttgttttgatacagtctcgctctgtcgcccaggctggagtgcggtggtgcaatctcgtctcactgcaacttccgcctcctgggttcaaacaattctcctgcctcagcctcctgagttgctgggactacaggcgcacaccaccacacccagctaatgtttgtacttttagtagagttggaatttcaccgtgttggccaggctggtcttgaactcctgacctcaagcaatccgcccacctcagcctcccaaaatgctgggattacaggcgtgagccaccatgcctggccacatgagccactgcgcccagcccagaagttttaataattctacttaaatttaaataataagggctggttaattgtattttataatgatatctagtattttcctccaataaaaatattatgttcaattattagttattccaataacagactgaaagaccttgacttgtaaaatagagactcttccttttgttttctgtatagctctgtatttctcactattttccccatgattattcagcatttaaaatgctaaataagtatttaaaacattttttaaatgactgcttgttttctaagcctttaaaaaatgactagttgaaaactacttgagaaagaatactgttcacatcataaagtcttgtaaagctaacatacacaaacattgtaggaagtggctgaacagtaagtaatataaattgattttttaagccatgaatagtgcatgaactttaacagttatttccattgaaataagactaacaatatttgaactttatccaagcaggtcaataattgttatttcatgtgttgactaatttgattacaaaatttaatgtcattttgtcctataagacagaattttaagattctgttgagttacctactaaaagatgttattacattttaagaaaaattgtattggaaaataacttgaatgtagatcaaatttttgcattcaattattggtttaatttcattgttagccatacatttctgctgagtttatccaaaatacatatttagagagaatttttcaaaacttctcatttgattaaaattgtgttgcagtctaatacatccatgagaaatggacatacttaggcctagtatatgtaatgaagcctccttgatgaggcctgaaggatagtttgtttttaaaaaaaaaaaaaaaaaaaaaaaacggaattacccattcttgctaaattgaaagataggtaggatatgagtagcaccttaagagcaaattcatatggtaggtaaatatttaatgtccagtggttacagggcagtatttattcctgaagaaatgggagagatctggaatctctatttccatttgaacctctgctctgtttctcaaacttttgttcaatttttgcatctctctcttcctaattctcagtctacctttccctttttaattctgtctgtctcagtagtgataagctgaacttcactgtacatcttcactttccatttattcattttccaatttggttagaagtgggtagtttccccaaggatgaccacagaagcatttgccattgctacaccaactgttccattgggaaccagcttgaagagaactggatctcttcttgacagaattacagatctagaagtcagaaagcaattattaggttaattttgaaaggtacatattacagattttcacgtttttaaattccaaaaataaaaacgtttaaataaatttttaaaaattagatgacatttttgtaaatcttataaaccccaccttctattaaaagataattcattgccagctgggcacagtggctcacacctgtaatcccagcactttgggagtccgaggcgggcagatcgcttgacgtcaggagtttgagaccagcctggccaacgtggagaaaccccatctctactaaaaatacaaaaattaaccgggtgcggtggcacgtgcctgtagtctcatctactagggaggctgaggcaggagaatcacttgaacccaggaggtggaggtagcagtgagccgagatcgcaccactgcactccagactgagcgacagagcgacagtctgtctcaaaaaatatatatatatatcattgcaaatataattagccatctggtttccttcaatctcataacaaatttttaaaaatcagccatttatgccagtgagtaaaattaattgtttacagtaagaaaagttgtaatttgtttttaaaacttgttttgtttttaaaatattttcaaaaaatgtggaaaatatttaacatgaaagttacccataatgtgatcaccacaaaacaggtattttaattttgtatgttcctttccaggtatatccttattattacataattgcaatcatgtatacaatccacttactaatctgccttttcacttaaaatgttaagagcattttttcgtattcctatgtagtcttcttataagtcaaatgtgtcaatgtacaaatagtaaaacctcattttcaaacatgaaaaatgaactaatacttaaaatttactatgtgcaggtcatctttggaattacttcatataactcatttaattttcacaataactctctaaggtgtacccttttgttcttgccattttatagatcaggaaactaagtcaaagaagggttaaactactttcccaatcacaagaataagaagtaggatttgagtacaggtagtcgggctccggagtccatgcttttatttggtaataatgcaaagattaacttttttctaaccgattccacatacattaagcaatctattgaaaactgcttgtcactgttgtaatatgacagtgcagagtttgcattttcctccttctcttgcaaatctccaactgaaaccccaaccacaaatgtggaagggctataaaaaataatggtaatccaaaatggatattagtgcaggaattaatgtaagagaagatgctgcacatacaactctcaaaaacagctgatagacttctggctatgctaatatgaagaaattgattaatcttctaaaaaaatactaaaaagcaaatgcaattgtcaaaaacaatcatttcagaagtcttggagttaaccagaggaagatgacagctacagaatactgctaagataaattaaggactatctgaacaaatggagagataaactatgttaatggattggaagactcaatattgttgggatagcaattctccccaaattgatctataggttttgggacatccctatcaaaattctggtaggctttttgttggaattcacaagcttacccttaaacttatagaggaatagaaaagaccaagaatagttcagatattttgagtaaagttagaagtcggaggattaacactatgtaattttaatacttgctataaaaatgcagtaatcaaaaacatgtagtactggcataatgaaacgaagagtccaaaaataagttcttacatttatggtcagttgattttctgcataagtgccaaggcaattcaatggaaaaaggataatcttttcatatagtactggaacaattggatatccatatgtgagaaaaaatgaacttggatccttacctcataccttatacaaaaattaactcaaagtggatcacaatctgaaatataaaaggtaagcataggagaaagtctttgtgattcagggttaaaaatgtcaagataatgacattaaaagcacagtgcatgagagaagagtaatgataaattgagcatcaaaatttaaaaagaacattaagaaaatgaaaagacgtgcacagatggggaggaaatatttccaaatcatttatctgaaaaaagacttgtattcataatatgtaaagaactcttaaggtggacgtggtggttcatacctataatcccagcactttgggagtctaaggcatgaggatcacttaagcccaggagttcaaaaccaatctgggaaatatggtgagaccttatctctacacaaaatcttttttaaatattagctgggtgaggtggtgcatgcctgtagtcccagttacctggaaggctaaaacgggaggatttatgtgagtccaggaagtcaaggctgcagtgagtggagatgacaccactacccagagtttgaccctgtctcaaaaaaaaaaaaaggaaaaaaaaacctcttaaaatataaacaactcagtgttttaatgggtaacaaagccgaatagacatttcatgaaagatgatacatgaataacaaataagcacatgaaaagatgatcgtcattaggagaatgccacttaaaaccacagcaagatactgctgtataccctcgagaatggctgtaatcaattggcgtgaccgtatcaactattgatgatgatatggaggaactagaacttacacactgctcataggagtataaaatggcatagcacttgtagaaaatagttccaaaaattctcaaaaagttaaacatatacttaccatacaacctggcaattctcctatttactgaaaagaattgaaagcatagtccccttaagacttacatatgaattttcatagcataatattctcataatagtaaacaactggaaacagtacaaatgtttatcaatggtgcatgataaacaaagcatatcatacccatatactagaataccactcagcagtaaaaaggagtgaaattctgatgcatgcaacagtattgaggttcaacttcaataatctaagtgaaagaagtccaatacaaaagactgcatattctgttatttcattgatagaagatttcagaaaatgtttctacagaaacagaaagcaggtcagtgatgcctagagaaatcagagtgcggaccaagatcaattataaataggcatggggatatttcttgagtattagaagtgttccaaaactggattgtagcaatcactgtacaactgttgaagtttgctaaaaatcattcaagtatacacttataatgggtgaattttatgttatataaattatacctcagtaaaagtgtgaaaaaaaactggtaaactatattttcagaggcaaatggcacaccctaaggtacaaacttaaatctcttgtttgcaataggcaaatcagtgtgtgccagcagtgagtgatagcttccctggatctcatttccttttgggaagacaaggaggttggaggtaggattaaatggggtattacagacaaactctatatgcataaaacaatttgttgttgttgttttgccagaggggaagaaatgaaactttgctttgtgatttgtgccaaaattgcctatctctgcacagaaatacaggttcaaaatgcacaccaataaaatcctgtgtcatcagtagaattcctaatagcttagaattgagagttggcaaactatggcctctggccaaatctagctcccagattgtttttgtctgacccacagaataaaaatgatctttacatttttaaatggctatttttaaaaagaagatgacgatgatgtgagattttatgtggcccacagaggtgaaaatacttgcatctggttctttactggaaaagtttgcagacccttgacttagaacatggttgtggcctgtattagttagggttccacagagaaacagaaccaatagagtgagtgtatgtggggggtgggaggtggtatatgtatgtgtgttgggagcaggggagattataaggaattggctcaagtgattatataggctgacaagtcccgagatctgcattgggcaagctggagacccaggagagtatattttgtagttccagtcccaaagcttggcaagcttaacattcaggaaaagcttctgcctcgtttcaggtctgaaggcaggagaagctgatgtcacagctgatgttcccccctactattggtgcattcagcctttttgttctgttcaggcctttagttgatcacatggggctcacatacattagggagggggttcttctctcactctcccaattcaagtgttacgcagagacaccctcacagacctacccagaataatgtttgacccaatgtctaggcaccttgtggaccagtcaagttgacaatcacatggcccttttatccctaaaaacctgtaaatagatcctctaggagcaactcaccttcatcaaagttgagtaatcaagaagaaactagcacggtatctctacaaacatacaaaaaaggaagaaaggagtggtaataaatagcaggtgagaccatttatcagaaaaaaatgtagctctgaaataaagtagtatgcaaatattttttcatgaaaaaaaaattttttttttttttttttgagatgaagtctcactctgctgcccaggctggagtgcagtggcactatctctgctcgttgcaacctccgcctcctgagttcaagcgattttcctgcctcagcctcccaagtagctgggattaaaggcatgtgccaccacacccatctaatttttttatttttagtagagatggggttttaccatgttggccaggctggtctcaaactcctaacctcaggtgatcctcccaccttggcctcccaaagtgttgggattgcaggcgtgagccaccacacccagcctttttcatgaattttctaaaaacttaaagcaagaactttttgcttctgtgacagattagcttacatcctaccacctcaccaagaagagctataaagctggattttaaaaataatactatatgaataccacttacagtattcatctgtaagaagtcattggagtgacaacaaggaaaccaggactttactgaccaagatcctaaagagaagaatagtacagagcagtgagcccaacatttagtgccacttttcctctttaggcatttgcagatatgaaagcagaaaaacctcagaatctaggaagttgaacatggtattccacagttttacaaggctggagagagaaaaatggaagtgcattgcctatcaagttgcaggatctttagtaaataattcaaactttcagttgaacccattgaaagcctacattttaggagtaagggtgagtaagaaacatgagtcctcagtgactgaaacccagtctccaagtatttcaatctttgatctatctttactctgattgcctaccaaaagtaaaagtaaatactctgtggaggaagatattatccagagtcttaaaattatctaaagtttgtatacacgatatgtggcatgcagtaaaaaattaccaggcatatcagcaaacacaaccaaatcattgaaaaccaagagaaaaattcaacagcaaaaacaaaatcaaaaaagggaaaataaaaaccaggcagtcagtagaaacagacccgcaggagttcgcagtatgaaatttttatgaatggactttaatcgtgtgatttgttcaagaaagtagacatatgaaggatttcagcaaacaactggaatctatacaaaactgtcaaatagaatttccaggagcaaaaaattaaataactaaaagactcaatagaacattttaaaaacagattggagagaaacaaagaaaaggactgcatatgttaaaaaaaaattttttagactaaagtgtagtcagggattaaaaagaatagaaaatatagaaaggaggatctaagacatagaggatgtgatgaaaagttctaacatacaaataattggtttcccaaaaggcaaggagagagatggtggcagtgcaatatttgaagagtgtttatggcccagaatttttccaaacctatgagaaacatttagccacaaattcaagaaataccacaaaccctaaaagtgaaataattaatagaaatcagaccccacttagacaaatcctagaaaagcggccagaaaccaaccaacataaaattctaaaagcaaccagagaagaaagacacattacgttcaaaggcatgaaacttcaactgaaaactgacctcccaacagaaaaattaaaaacggaattcagaagaaaaagaatgtcctaaaagtgctatagtaaaataactgccaacttacagtgttatttacagcaaaaaatgccttccagaaatgaaggcaaaaattcagaatgtggaaaactgcaggacaacctacattctttttttttttttttttttttttttttgagacagagtctcattctgtcacccaggctgcagtgcagtgacgcaatctcagctcactgcaaactccacctaccgggttcaagcaattatcctgcctcagcctcctgagtagctgggactacaggcacatgccaccacgtctggctaatttttttttatttttagtagagacggggtttcactgtgttacctaggatggcctcgatctcctgacctcgtgatccacccgtctcagcctcccaaagtgctgggattacaggtgtgagccaccgtgcccagccaggacaacctgcattcttcaagtcaaaagaaaaataaaggtgttgcaggggaacctataaataaaatagacttaaaagatgtatcgggccaggcatgctggtgcatgcctgtaatcacagtaatttgggaggccacagcgggcagatggcttgagcccaggaatcttgagaccagcttgggcaacatgccaagaccccatctgtacaaaaaaatttaaaaaataaaaaaataaaaaattagctggatactaattttttttagctgtaatcccagctactagggaggctgaagtgggaggattgcttgagcctaggaggtggaggttgtaataagctgagatcacaccactgcactccagcctgggtgacagagtgaaaccctgtctcaaaaaaaacatatatccagccattaagctgggttttcttattggtatcatgattcagtttaataaacaagttttgtgatatgttgaagtaactggaaacttgaactattactatttatgtgatattaggaaatttgtgaaatttgtagtatgatgctatcgtggttatattttaaaagagagatccttattctttagagatacatacagtgatatgtatggataacattgtatgatgtctagtatttgttcccgaatagtacaggaggaggggataagagaacaggcgtataggccaggcgtggtggctcacacctgtaatcctagcactttgggaggccgaggtgggcttatcatctgaggtcaggagtttgagaccagcctgaccaacatggtgaaaccccatctctactaaaaagacaaaaaattagccgggcgtgatggcgcacatctgtaatcccagctactggggaggctgagacaggagaatcgcttgaacccgggaggcagaagttgcagtgagttgagaatgtgccattgtactctagcctgggcaacaagtgcaaaactctgtctgaaaaaaaaaaaaagagagagagaacaggcgtacaagtgaaacaagattgatgttgaagtaatcattgttgaaattaggtagtggggctcatgggaattcatttttattttccttttctgtatatgcttgaaattacatgctattttaaagaaaaaatgacataaagacatttttggagaaaaaaaaaagctattaccaacagaaatgggcaattcttaagccaagtagagaatgttcacagaaccaagtcactgtaggttgtaagggaaaagcaaaggtagcaggagaattcagagtacttgatatccaaattcagtgagcaaaagggattattataataagacaggcatttttgggtagatgatgttgagtaatcaaatttgacaatacctgtctgaacacctcgaattcttggtcctaaaagtcatgcatgtcttaaaactatctttcagcttactactttgtatgagaacttaagtatacacaaccagcagttagaagaagaggttaaagatctagcagacaagaaagaatcagttgcacattgggaagcccaaatcacagaaataattcagtggtgagtgctcttttaaacgtttttttgtggatgattgtgagtatgtggccaagttggtatgaattccaggtggctactaataatggtttttatctcatttgtcagatgtgataaataagttactctgaaaagcacagttttattactgatctgttgtgttctactgtgttttctgttacattcctctgttccctaactctaacaaatgtcccataccagcatttaacacagcttcattgaaatctgattattattactttctaagaaaatgttaccaccttcagagtcaaagttggaattcatctgctacctatggatgtttctttctaagaccaaaagtcctgtatttgtgagtattttaagaaatggaaggcctgcaaaaaaaacttagaagctaaagatactgtactgttatcttgtatcatgattataccagattaattcacacatggcatttttaaaaccttaaatggttacattttagttttatcagctctttcttaagctcttgggatttagtttggaatattcatcttagtaaccttcatattcatttattaaacgattattctggtgctggtaaaaaaatttcatattttaataatacatggggaaagtagaatctaatgaagactgtatttccaagtaaaaataggtaacttaactttttatatttatttaacttttgaaatccattttggcaaatggtaggtgtttaatttatatcaaaacaaatacaggttgagcattcctaatctgaaaatctgaaatctgaaatgcttcaaaacgtgaaactttatgagtgctgacgtgacaccacaagtagaaaattttagacatgactttgtgatgggtcacagtcaaaatgttgtttcatacacaagaaattattataaaacattgtaaaaagttaaccttcaggctatgtttataagatgtatataaaacacaaattttgtgttttgtcttgggtcccatccccaagataatctcattatgtatattcaggtattccaaaatttaaaaaaaaaacctgaaatccaaaatacttttggtctcaagcatttcatgtaaaggatacccagcctatagtttcatcatatatttatagatcagtcatttgtagggaattttaattcctgtatgcatattttggttcaaatgtttttccattaagagctcttaatgcttataatgtttctattcagtgcatataaagggaatatgcagattgtggaaatttatttgggttctagacagtacagttattggttcattaatttatatctatatcatcaagtctgcatttctgaagcaaaatccattttaatgtttaaccaagtttataatatcaaaaattatgacttgatatttgtgattccatttttatgttatcaaatatatatgtaaggaggagctgaaaatgacttcagaagacagagtcaaaacctgtgatactagactactgattttttcaagtgtctggcatgatgagttcagctggaatgggaagtggtgctagtaatggaaggaagctttcaatgtgggctttgtagaaagggttaatagaaagggtgaagatgaaagttttatatgatgccacaaaacactcactatacacttttcacattcaaacgaaatatgcagaaatcagaaatacgaggaagtcactttgcatgaaagctgttattaaccctactttttatttagaaatggagtaatagatagcagattggcaaatacccaaagggaaaaagtaaaatatatattccctgttcaactttcttaccacttcaaagttaactctgtgagatacaatatccaagtttataaaggtcagaagactgagttattttcattttttgagtttagtttacagattgagtattccttattcaaaatgcttgggaccggaagtattttggatttcttttggattttgggaagtttgcgttatacttaacagttcagcatccctaatccaaaaatttaagcatcttgtcagtactcaaaaagttccagatttggaggcatttcagattttggattttcagattaggaatactcaaccttcttttgaaaaatgaggtaatgctcaaacaagattataggacctcatgacatatagcactttaaatgtttcctgggacaaatgaacagttttaatacaaaacaaacactgcagtatataaaaccttttacgaagtcacttctaatggctcttgaactccacctcctctctcttttgctatgaaatatccctttcatcagaaactcttttagagcaaggacatcttctcaccgccgttagagtaggaaccttccttctcgccattggctcatcagaggacttcacgttttctctttgaaataatattacaaagagaggttagattaataggctagtccataagatttattttttaaatgtgttttcctcacataaggcattcttctggtacaataagagatacagagatctataaatgtagtacttttctttaagtaacttgtaactaaacatttaaagtttaaaaactattttgaccagagctggagataacttatgagacttaaatataaatgccttacatattgaatagatactgactttttaaaaataagaatgtagtgttgagaaaattatctcagactagttgctcaagaagggtgggaataatcagttaaactagactgtgtgttctgaaaaccctgagtttagtaaaatatcctacacctagtttgaccaaattggagaatttttgtaaaagaatagtaggaaataagagtaataaagttactgcaacacagttgtcatgaatactaggtaagaattttaccttcacttatttgtaagatggagaaggtttttcaaaggtaatggtgttaattaaaatgatgattaggcaaatagctcttaacagtaatgttcagaatgaagtagaaggtaatgttggaaataaagtgaacaaatgcaggagacattgtgaaagaaaactctataggacttaatactatttacaaatgaagggcaagagatgaggagaaattagtattcctgaattgtgagttaaggaggttaagaaaatgatggcatcattgaagtaggaaagttaagaggggtaaccacccttggggaagatgatacaatcaattttagctgttattttattttgtttgttggtaagactgaggtgatcctgagacatcttagtagagatttctcatgcttttgaaaaactaacataaagattaggattagaaatgtaaatttgggaattaaattccttgtgaataaggccagtgaagtggttgagatctttttaaggagacaagaaagaaggaggatggtaagggctatattataaaagctagatgaaacagctctgtagaggagaaccaggagaagggtttaataattacaaagcgtttcagtaatgaaacctttgtctctctttatttaaatccactcacatatttgaaacattcctcattcagtaatgctcatttgtgtatagtaatagcttctattgattaaaacataagagtgttctggtcattaggctggaaattcacatgtattcttatttagttattacaccggtcctgtgagatagatatttttactatccccattttataagtgggataacaaagagaagtaatttgcccaaagttacacagctggtaagcaccagagctaggatttgaaaccaggtctatatgacttaagaatcaaagttcctaattactatatatgccccaacttttcaggaactgtcccttatttgtcttctcaatatgcccaatgcaatagtatttaataagtattaactaattgatcatttgagagaacttggaagggaaggattaaatgtgccaagagaacacatagatctaagttggccttctgtagttgagttttaacagattagcttcagcaaaatagttgaggcaggaattagacttcgggaagtatagagtagtgaatggagggtttaatactagagcaattacacgtatggagtgtaacaatgaaagagggaaaatgggatgtttggggatttgtcagtgaggaggacagggaacttttggatttggtagagtttgtacatgtttaaaggaaccaatggaaataatgaaattgaaaatatgaggtgtagtagggagggtgattatgtatagtaataataactgttattaagaaatatttgaatgatttagccaaataaaagataagacacctacctctaaaactggttttaaaagttaagagaatgaatatgaataaacttaaccaaatggcctacaagcaaggagcaagagatagtgttggggccaggtgcggtggctcacgcctgtaatcccagcactttgggaggctgaggcgggtggatcacctgaggtcaggagttcaagaccagcctggccaacgtggctaagcctcatctctactaaaaatacaaaaattagccaggcgtggtggcatgtgccagtaatcccagctactagggaggctgaggtaggagaattgcttgaacccaggagacggaagttgcagtgagctgagattgtgccactgtactttagcatgggcaacggagcaagactctctcaaaaaaataaataaataagagagaaagatagtggtggggttggagaaagtaagatttttttttaatgaggtggaaaaatagacaaatagcaatgattatgagaaggagttgtgtgagacttagagtacagtggaacttaaatggcatgagttgccctccaaaccagtaattctctatagccaagaaaaagagaaataggtttaatcaaaagttaggaattagtggaagactgcagttgtaaggtgttcaacatgtaaataaatgtgttcaacatgtaatgtgttcaacatgtaaataaaaagcaaagttagaaaaaagagattgtcatataaaattccaaataacttaaagtcagtttacaagaggttgatttccaaagttaattaaacacattggacttcacagtttcttggaaatgtgcataaactaagatctctgagccatggtagatactaaaccagcactaggtgagacctgttagcctgggcacttaaaggataatacagttttctttattgttactatataagtatcttttttgtattctaaaaaagataatcttccttcatcccaatttattctctacactatagatcaggtaattaaatgaaaagattacagtcacttgtagtcaaagaattttagaaggacacaacccttgctacacaaacattcttaaaataatttccaaaaccatttttctttaacaggcaataaaaatgtgtacatgtagatagagcctaggaatgtgtaactgtcccttaccatggttttattgcatctccatattttcttttgcttatactccaaagacaatctcccatctaagaggagagagcaacaagcctcttttaaagggcctctttaagatatatataaatttgactcctcaggagtttacattctaagagatactaaagcagagctcaggagttaaacatgtctgctgtatgcatcggatacatgctgatttacctgaaatatactttcctcatagcttcagtgacctggattttatctgaagacaaccagcctgcacaaagacaaattgtcttccccaaagtgtgtttagaatacacttgtgagcattgcaaatttcaactccattttttttgtttgtgcagtatggctttctgtataccagtggttttcattcttcctgagaataggaccttcttttttagattcttgtagatatgctggactcctcccctcaccttctccccacttgagggaagtgtaagaaatgcagacgttttcttgagaaattctaaaatgtggaatttgtcttactaaatataatttgaaaactttctgtctaaaattataattgtatcgttagctagatagccttaagacagtaagtagaaattaggttttggtagactttaatcttccctctttgttattttattgatcatttcagaaaacagaagagcttaattacaatataaccctgatttttgcagaatatcctacattaaactttctaaatttaatatacacttcagttttaagaatggtatgttgtttttatgatataaaatggcagaatccaattgagaaatcttattatttagaaaacctcacacatttgtgcatctgtgttaattgttagatttaaagagtgttaattctgtgtttcaagggtgaagttttaataatgtatcagctatgagtaacttggacttttgtaaacatcacctgctctaccatgtacataaaagaacagttccataaacctcttcccagttgttgacaggtagtatactatggtagaccttttcaaagaaattatttaagactatctttgaatttcctaccacttatttctttaggaagctttaaaataacatatattgcactgaagcttttttgttttacttttgtactttgtctttatatattctagggtcagcgatgaaaaggatgcacgagggtatcttcaggccttagcttctaaaatgactgaagaattggaggcattaagaaattccagcttgggtacacgagcaacagtaagcttctatgattttgcatggaggcttatcatattagaaaaaagagatttaaaaaacactataataaatccaattacttatatcagtttgtttagactttgagcctactaaagagttttttatgagaaaactattagtttgggtcttttccagtttagaaaaacataacacacagctggttaactataataatttaaatgttaaaaataggatggaactaaaaacacagtcattatttcataggatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatggtaagattgaatcatatagtcccactagaataatttctaagtttgtcataattatttggagagaagttacatgtttagtttccattgcttgcttttagaaaaatgatggccaaatatgttacaaagatttgaaaataactagatgcttttaagccttgtagatagtgatgaggttttaatatagccttgttttcctctggcttgtccataaagtagaattaatagtattaaataatattccattatttaattttcctcataaaatttagttgactctcaaattttattaaacctaaaattctctcatgtttaggaatattatatttgtataataatacaacatatggtgagaacaaaatataatcatttgaaaattgtggcctctaccataggtcttttataaatgaaaattctattgatggcaaatttcataatgatataatatcttttaagtataattattgtttttcatgtttctttatgtatttagaaaaagtgtatcccacagtctctgaagcagttagctaatgaacacatttcgtcaattctggtcacaacactagagtgaatcatactctgaatacataaatgattcacagttagactgattataaacatggttcaaaataagccagtttaagtgacatagaggaacaatagaaacttcacatcacaagtgaaactacaaatacgaaaatccattgactgctgagaataccaaaagttccaaaagcctgaaaagaaatgcaggcccatgaattcagtttttaatggtgtgtagtcatagtccttaaactgcaattgtttatctttttaatcaaatcaaaggccagatacatgatacttctgttggattataaacttttggtttataagctttttgctataaataatgcagacattgtatgttttacttaaatgtgcttatgtggcattgaggaggggaaaactttttctggagaaagtgaattgatcccagcataaagagctaatgaatatcattctctgtgttgtaatttgaaataagtaatatcttttctccttatgcctaggacagatgagtttacatattgttcataagtcaggaagatgagccagtttgaaaaattataaacttactcctgtatgtgctccactttcatggttgcctgtaatggtataatatctaacaaagtctaacagaattctaaaattaacctttgattttgtaacatttttaaatttaataatttagttcagggtccacaaatgttttctgtaaaggttcatttagtaaatattttaggctttgattagcttccatcacagcttctcatctctgctattgtagtgtaaaagcagccatagtcaatacttaaatgaatgagattggctgtgttctagtaaaactgttaatctacatgaaagtaggtagcaagctgtatttgttcttcccgcagtaatttatagtcccctaatttaccatgcctgacatttaaaccaagtaagtttggctacatccaagatggctcactaaccagcaataaaaattaatgacatttttccttttttctccttatttaagtaaactaaaagattcagagaagaagaacttggaactactctcagaaatcgaacagctgataaaggacactgaagagcttagatctgaaaagggtatgggagtgtgtgtttgcctcactcaggacttactgttatgttataaatatattttattacagaagaatcaattcattgcataggtgggagaattgttgacataagcaattctggcactcatttatgaatatacgtgtgtatatatgatgcatgtgcatacacacacatttggaagactgacctctgagtcattttgttttacttaatatgcattgtttaatgatttcatagtaacagaaaaagacactttgccataaatttgacgttttttttcagtgcagtggactacttcatgaataacatttttgtgattggaaaaaaattttattttataatgtactttataatattctcaaatgctatgatatgaggttatcactctgacagtggcaatgtgtgttaacatccagaacttggtaagggtacttgaacaagtatttcctagcactttttatgtgcctagaatgtataaaaattgggggggggggggtgggattcactttcagggtagttgaggaaacaatgtatgaaatagctgaagattaatttagtattaatggagcaattcagtaaggaaaattttggggggcattttaatgtcttcttccagtttgacacttaaattgcttgtcctgtaggatatcccggatttattaccattttcttgaaaactttacttgaacatttttccattcatgtgaaagcttagtcagagtgcttcatagctgtattacatgaacttcttaaactttccttaatgtggatgttaagaaagtgaagatttaataaaaagaaattcagatatttttaaaataaagggatatcttatatacatttatttgaaattgattttcctgacaaaggccatcactgaatactgaactcgttaatgggctttttattaggtctaagtgctttcctatcatttctcagccatgcaacacagtgagataaaactggtggagtctctgcatctgcatgtaaaatgatagagaacagagagtaatcacataaagaagctaacaagaaaaagcctttacaaatagtcgatgctcaataaattcttgtggattgaatttcttaattaacaacaaaaggaaggagcccagaaaaagtgaatagtaattcagattaggagcacaagccatcatgccaaaatgaaaatcaagctaggttttaattaatggaaatttgaaagaagatacattatttagtgaggaaaagaaaaagaattcgtaagacatggacaactcgtggccctaatggcaaataggagagagactagtgcagaatatgacttgcacgccagatgacattgattgcatcatttttagaatagacctaaacttgaaagagacttaagtttatcactgaaggcatgtttaccacagctttttaatttggattttgaatattgcagaacaaaattttattgtataacataatgtatactactacttcagtaatataatgtgatatttacagtatgagggcaaggatgtttttaatgcttcatttactattatttccccaagtctctaggacagtgtctggcacactctcaatatttgaatgaatttctgaacatactgccttacctgataactgtgttatattattagatagtaatatgaaaaacacaaatcagctgatgtcaattcctaaggatatggaagtgaaaaatgtgggattggctgttttctggtttttttctacctagtatttttatttgtatgttgtaagaattacttgggaaattgtgcatttaaagttaatgccatagtcaagagatatgtatgaatttttaaaaattcatctgagaaaaactggggtttggagtcttcatcctgtcaataaaaaaatacctgaaatcagattggcagtttttttgtaattaagtgtatttgtttcatcactgcattaatttcttataaaggattattcttattagtgcatactctgtgctttgataagagtatttcaaaacataagcctgtttggtgttgaattagcttagaaaaatcagatataaacagactcctatttttaaattctctcaagcctaccaaaagatttaatgtggttttttattatttactatacacaaaaagaaagaaactcagtaacataaataagcatttcatggaaactgatgtaattgaactattaagtgatattctaggaaacactagtgtattttagttttgtttaaatgtagagttaattatagtgatcaactttgaaatacagtagtttgtgaactgcttttagtagattcagacagggaaggttatccattaaaatcaattttaattgttgtagccttaaaaaaagttgctgctgtcttctaggtatagagcaccaagactcacagcattctttcttggcatttttgaatacgcctaccgatgctctggatcaatttgaagtaagtattaaacatgtcacatatcctctggggtcaatttaaaattcactttgtaatttaaagttcacttataataaaaccattttattgcttcccacatcagaggacctagaatcttaaataaacaaaaacatattagcagaggaatatgttctgcattcttatggagactataatcccacctctgtttaacaaaacatctaagaaagatttaatcatgagagtcattataagatttaaaagcaatttcatctcccttaagaaacattaagagcagaacaaatcccaacttttgaaataatttgacaatttttttattctccaaagcatagtgccacaataaaaagtgagaaaatgtcaaagctgacaataaggtattgctggttcttatttcaaatcaattcatcttttaaaaactatacagtaagaagtgcttttgttaaaaggtgttacatagactctgttaggcatatcacacagtaatgaaattgtgattatgtaactcttgatcattcgttggtatttaaattctttgctttaaaaaaatcaacttactgttatcaagtatatttttgtctcagtaaatttaagtgtgattatatctttattgaacaaataataatcatgtagctttgtgcaaggcactgttgtaagtgctggagatatagtagtgaccaaaatagacaaagtccttcccactagaacttacattccagtgggaagaattagaagcctcaggaattccattgcttacttttagttgttacttcaaaagtacttacatttaatttgattattaattatttgtcatgagcttcattttattacattttgggcacagtatgtgaattgtgtttcgttcctttaggaaaaggaaaaataatcactctttaaaaagtaattaatgaatctcttaagtttctcaagaacaatgatagtgactgcttttctcatttatttatttgaattaatgtcatttgcctttcaattgttttacaaagtttttgatttattattcttattaaattgcttcatccatattttctatttttttattgctgtattcgttaaataggattccttttcttcttcctcatcttcactgattgattttttggatgacgtaagtctttgattttcaaaccaatgcatccttcagtaaaaaagatcagtgaattgatttgaagaatttgcctagtaatgcagtcagttttagaaataccacatttgaaaatttatgtgagccaaaatatgcttctttcttatcttaaatataatgaaggatttatcagtattaaacataatgaagtaaaaatttactttcaaaaatgctttgactgttgtagaatcccagtattttcagtctttgtaagaattctaaaactagaatgcttatttaattattttttatatatatataaataattgcttatttttatttttcctggcgatttctattttacttttcccttttcttttcagcactttactgtttaatttctatgttggttaaaaataaacctctggtggtataataaaaaaaaattacttttaattaatttctccagtaggttttattgtatgacaataatagagtactgattttaaaataaatcaatgtttaattgatttatttctaatgctgacagaatttctcttctaatgtgcaaagtgattttagttaacatattcactatatgcactataaattgactgcattatcactttctctcctgaattctatcaatttaataatttagaagttcctgttaaatgtgtatcattcattctctttactacctggcataacattctctctattccacattaaatgcacagtaattcttgtcctaaagcatttattatcctgttgaatagtctttacagaaatggggaaataaaatggattcaaatgcaaatattgtgcatagaattgttttttaaatcgggagattttttaatgttttattctttctgttttgttaggatacttatagtcagaagagtagttagcataatgttctgctaaaggaacttcttgatctagatgtttaaaaattattgaacaaaaaagtgattttgaatatgcttggaatatttatactgaagtttgcacattttcattctaaacaaagtgttttgctattctcaaaacaaataattactctggttaactctatagtgtgataaaaagagaactctcctcgtgtacagtggtattgcatgttataatctgctgctcaggatgttaaaatattcaatatgatatttccatacagatattattcaccttaaaaaagaaagggaaggaagtttgagtaaattattttggttgttctttccactagaaaacctttttatttctaacaaacttctctccatcccttttcctgtcacaaaaaaaaaatgtacatatatttgattgtaaaacctaagagcagtatgtattttggcaaatacatgaggtcttctcagcagacctttcaggaatgcacaccccagccaggtcctcagcttgtttctgctctcacaggcactctgccactgctgccacccacctgtaatgcctgagcaccccgcagccatttcccagtgttacttttcctccaggaatatcctttctcatcttctaccctctattaatgcaacatgagctcagtataaatataaaagtaaattttattgcactgcaagggaactcctagtatgaagtaaaaaggaactgagttcacaagagctgccaaatcttttatttatattccacctcctaaaaggcatgatttcccactcatgtgctttctaagctccattctcccaatttattggttaagtgcataagcaggcacaaatcctgcctgtacaactttctaggtgtatggtttggaagaaattaacctttctacaccctaaatttgctcatcaggcaaatagtaataataatataactaatctcataatgttgtttgaagatttaaggaaacagtgtatgtaatgccgtcagtaataatgcccttattacttttaataagctggttccctccctttctgtattctctttagcttcttttctcatccatcagttcagtttcacttaaatgctttcttagctcttcatcactcagtcatctatccaccaccaatattttatggcacaaactttgtgtttctctttagagtttgtacctatgatctcccttcccagagttatcattcattcatttgatcctcaaagtcatagcagaatgatgttttgaacagcagtattcaatctttgacatacttgagttcagcatccaagatatttcgcataacgctcaagttcttctgtagctctttttctgctaggaacttggattctttttttgtttttgtttttgtttttttttttgagacagagtttcaccctgtcaccaggctggagtgcggtgacacgatctcagctcactgcaacctctgcgtcccaggttcaagcgattctcctgcctcagcctcccaagtagctgggactacaggtgcatgccccccgtgcctagctaatttttgtatttttagtagagacgggctttcaccatgttggccaggctgctcttgaactcctgacctcatgatccgcccgtctcaacctctcaaagtgctgggattacaggcgtgagccaccacgcccggctgcacttggattcttaaggagcaaatcaggtctctgttgttctctgtgccaaatctagttatattgtgcttgatgcttatatgcctgccctttgcggtaaggctctaatgagtagtacacatccttctggacattcttttttgttttctgtctcgttgctatagaggagattatgttgaagacctaaagtttgaattgcagctggaacttgtacgtatagaagggaataagactagtattgactagaattgcaggaatcaagtcctttggtatcaacatattatcattcttctccctctgtctctgggaacccagtgttctcatgctgccctctgatttgttggagctttaccaccagtgcctctcctcctccaaagttaccttctttactcctacttttacccttccacacaggcctctaagtgtagttactttatttaaaacagtacggttttaagttaaaatgttcccatccctattttttcctccacatgttttgcctgttaactcaaaattcaaatgaatgctggaatttttggcacaatgggaagatgttcggagcaacatgctttcctttttaagtcacattgtttggccaatacttgtatgtgtaagagtagctttgaagagaagaaatatatgtaataccagtcattcccttccctctgggaaaatgaaaggaggcaaccaggcagagcagagcatattctcaacactctctgcttctctaacttgggggaatgtaggcatttgggcttttctacatgtagaatcatagagttttgaaggagaaaaccttagaaagtatttaatccagttgttttaaccattacagcactcttctgttattaagagtggataggttactctcccatttttaagagtgacttttttaaagttctcaatctttggggattaggacagtgtggtgatacattgttatgtaaaatattctttaggacagataaagaagggtttgagttaatttatttatttatttatttatttattttgagatggagtctcgctctctcacacaggctggagtgcagtggcgcgatctcagctcactgcaagctccgcctcccgggttcacgccattctcctgcctcagcctcccgagtagctgggaccacaggtgcccaccaccacgcccggctaattttttgtatttttagtagagatggggtttcaccgtgttagccaggatggtcttgatctcctgacttcgtgatctgcccacctcggcctcccaaagtgctgggattacaggcatgagccaccatgcctgactgggtttgagttaattttaaaagaaattgaaactactttgataagtggtctcttgagaaaggcatttccattcaacctattaagaaagcagtagaacagagataccaagatcccttctgctgtagaaattattcccacttctaccctcatcttttccttcaaccgtgcatgcccagtcttggactgtctagtccatgttagccccagcctctttctctaggtaataaacagggtgaggagcaaatggagctcagctgcttagattttcccatttctttcccccatctattcccttcatcccaatagtaacagatccagggatcatcacaccaagcttgtagcaacttcctatactctcttcagttcattttcttttcagccgaacctgaaaaagcttggcttgagagtattatagataatactaattacaatcatataaattagctgcttgctctttatatttgagaaacgtattgtcatatattaaatatgtgctaagtaagttttgaatttgattaaattacaattctacactttgttcatttagtcccagttcacaaaaatagaaattgcccatttgcctggaaaatgagaatgtactcaacttggtttttcagagttttcttactctgatatactgatgaaagagtaaatcaaggattaagctcgggaatataaaggtcagacacagagaaacagagatagtatctatagcccaacagtctggtccccctaatattgttttccattcttatattctggcatataagaaaagcaagtagtctgacaacattggcaggctgagttctggacttgattttaaccttgtataacatcttactaagatgcttcaaaatatttaatttcagtcatggcttctaacttctttaatttatctcttgatttcacatggttttatctcccagcttcttttacattctgttacaatcagttacagaaatccgaggcttttacagaaatctgaggcttggcagcatagtttcagcgatacttgggggaatggtcaattgtatgtgagaattggtaggaaatagagttttaaaacatacattttaaagatttttagtcctatgaccaaaatcagacctagcttctttggcattcctgaaatttgctcattcaattcttgtttttacaatttctatccacatattcaccacaaccctacctgaagattgcatatttcagaaagttacatgcattttttcctcaacttaggcaatatattatgttgaatataattgtatatattacgtattttatcgcatatataatataataatatatttagacaatctaaagagaaagaaccatgattacatagtccatttcttctttggtattttattaaataagacctctaggattaattgaaccttaaaaactattagccaaattatgtactcctgagattatttcttttggtttctgcttgtgtgcataccttcatattcagtcttaaagttttgttggcatgtcatggacctatatatgaaatacatgttttaaagtggtatttggttgcacattaagacaaggtgctggtttatagtgtttgccatgaattcaatttcagtgtttataaaaaccacagtgtgtgtaggtatatatgagagagaaagtgtgtgggtgtgttttcctctaactcaccttttctgttgaaaacataaaaatagttgaaaacgtaacaatattgaaaacataaaaattagacaatttctaagtaaacactttggtaagaaatcattgctgtggtgatagtatcattattagctttaaatggtattggcttagaaaatgtattgtccttcattttcaaagatagtttcgggagacattttaacttgtttttagtatagtgataatatatttattttgagatattcatgctcttttccatggttttagcatactccagactctagtctagaagtagagatagccaaaaaagttttttttttttttatgttaaacattttagcactttttacatgggtggtaatatactgggcataatggatacaaagacaaagcagatgtggaaatggacctcaaagtacttattttataattagaaaaataattatatagttacacactatgcaatgtggaaagcaataaatgccatgagaaatacctaggctaagtactatggacattcagaaggattcattcaatatttattgagaatatttaagtttgaagtcttatgctaagcaaaatacaatacttcctgcccttaagcgtaatatttcctgcccttaagcataatacaatatttcctgccctgacagtctaattggaaagacaaatatataaccagataactataacaccatgtgggaaatatagtaataaaagataaagatcgtatatcatgggaatacaaagaagagagatttctgattgaaccaggaggatccagaaaagcttattaaaggaaataatgcctgagctgggtcttcacagatgagtatgttcagcaaaatcataaaacaactacataagaggagtatattctagacaggcagagcgaacttgcggggggagggagcagggagttacgggattgtggacagagggagatttcaatttagttagaattgtcccttgcttggcaaacaaaaagggtgaggaagggattgagaaatgagtatgaagacatgggcaaaggccagaataagggtctatgtttctcaactttatacttcatattacagagcttaggtttaatcagtcccatatgtaataattattaaaagatttaacagaagagaaaggtgacagcttcattttggacaagttaagtttgagattcctaagggacatccagttggagatgtccagcagacagtcagatatttaatatatgcgtcaggagtttaaggaagaggagtggactggcaacagagatttggaaataatcagagttgaaagtggatgagattccccaaggggcagattgtagcagtgagccaaggacagaaacctggaatctccattgaagaaagggtgaaggaataggactccacaaaagctaagaaagcaatcgttgagaagtatgtggttacttaggaaagtacctgtcagaaaaactagaagagcagataattttaaggaggggaatggtcagtgtgatggtatggcagaggtggttggtcagataggacaaaccagaaatactgacctgagtatcagatcaaagcagaatctgaattgcactgtattagaagttaattgggagtttagaaaatacagacggcatttgtataccatttttcagaaatctggctgaggaagttttgaatcctggctctaccacttaatagttttataaccttaggcaagttgatccatcttctacatctttaaaatgaggatcataattcctaccttatagggtttctgtgagaattaaaataattcatatatgtaaagcactttggaaaacgatctgcatatactctgcacataataaatgttattatgattattaaggaagaagggagatagatgatagctagaggaagagttggagttgatttgtttattgtttggttgtttggttttgggggcaagaaggaatgagagaggttcttcccattaataactgaggaaaagtaactaggtttgaacctgagactttagcctccataatggaaaaacttctttagaactctccgggccttctaatcctggtttactattaactctgcaggacacagtgttcaagttatcttccattccatttcctatggaaagaaagaatatttctggccaggcgcggtggttcacacctgtaatcccagcactttgggaggccgaggcaggcggatcacttaggtcaggagttcgagaccagcctggccaacatggtgaaaccccatctctactaaaaatacaaaaattagccgggcatggtggcgcgcacttgtaatcacagctactcgggagtctgagggaggagaatcacttgaacctgggaggtagaggttgcagtgagccgagatcgcaccactgcatccacctgggtgacagagcaagactctgtctcaaaaaaaaaaaaaaaaaaaaaaaagtacctatttacttacctgccagagttattgtaacactaatactgaatttttggtagtgtttctcattcttgaacttttccttttttcttaaatcttctataactcctgtagacctagtctataagttccctcctctaggtccccaagaaaatcttctctgtccctcctctaggttcccatacaaaccttgtacatatctcagtgatagcatttgtcacattgttgctggcatgatgtcttctctaccagtctgtgaacttccatgtcttgtttatctttcaatcccttgcaaagtcggcttagtatccaacgtattgtgagctcacaacaaatgttaggttgcactgaatgttagaaattgccgaagtagatatggttcatattagtgaagctctactgctggagcatcacaaaaatattttgattgggaggccaaggtgggtggatcacgaggtcaggagatcgagaccatcctggctaacatggtgaaaccccgtctctattaaaaatacaaaaaattagccgggcgtggtggtgggcacctgtaatcccagctactcaggaggctgaggtaggagaatggcatgaacccaggaggtggagcttgcagtgagccaagattgcgccactgcactccagcctgggcgacagagcgagactcccgtctcaaaaaaaaaaaaaaaaaacaaaaaaaaactttttgagataattgttccttttttcctaattacttaattctttaatgttagaaaggtgaaagtccctcttttgactatggctgaagttgagtcaggatggagtattgttcaaataacttttaattttaatttattatcattaattctgaaatcctaacttagcccttgtcatttaaaagaatcatttttgaaaagagtaaaaatttactaggtaaatgtctaacgccaggctagttcattattttattgaatgtttgccagcactaaatcagaaatatctagatcctttttgttctcatttgttccagtctgctactgccaacctttccagaaaagaaattgtctatcacttgatgaaggcttattttgtgggtcactgtacatgggccagtgaaaagtttgtcaaccttagacgtagtccaaacaactgtttctttaccatcctatcctccagtttttcctaaaaatacatgtacattcaacctatccaaaactgtggctttatatgtatgtttatatactttgtctgttaatacaatagtagtccttgagagtcttatgtgtgtaaatatttgtaacatgtcctattctcctttctctgttgaagcgctctccatcctgtactccagctagcaaaggcagacgtgtaagagacttttgcactttatgtacccatcctgaggccttttacccctctctcatccttttgcctgtgattgcggaacctgttaatgtttttgtggtatattattacatctattgcatgctttgtgctgctgctcctgctgttgctgtgctgcttttatgtttttgtttatgttttttttttggctttggccgcaaagctttaggaatgttcatataaatcactataaccaaactactaaaatgatatcttttttagtttgatcaaggggaaaagtgatcctaaagtatgccttctaagtagtcaaagtacatgagctcctaagaatcttttgtaagcaagtatgtagattgtttcttagagattttaattatgtagaaagaaaacttgatcattcatgttgtacaacattcaaaaatgatttggaacaaattatacatcttattgactataatttatgtaaatcagttctagagaaatcttgtttttttttttttaatgtagttcagaggaatctcccaaactaattatctagatctgaggaaataatgttaataataaagcctttctattctaagataattccaagatttaaaaaatatcagtaacattatttatatatgtattattaacaaactgtaaatatcttcctatactaatcctagctctgtgtttctcaacttgaaatgagtcagccactacctctgtgctacaagattctgacatgcccagagatggaatttttctaaaccagccacatcccaacactagtcataaacacacatacatactccctatttgaaaagcgacagggtagctgacagtgttgggattttcatatactatgtaaaatagtaacattcaaaaggaaagtcagtgatggatacaaattcgtaatgttcaccagtcatctccgtggagactgatcaacactttacattccgaattcttagactcggaaagttctagatgagggaattctgtggtttgtggtaggcatgggaagcagtaggggtggcctgctgcttcctgtggtcctgtctttctggtatgttggagggttggttgtaaaataaacatgaataactctaatatagcatatataatattttcggattacagcttaataatgaataagcatttcagatacctgtactatggccagtagaactgcattcaagtgatatctcattaattattgtgtttatgaaagattactagttcaactgattgcttgattattttgaaacttgtagagacttaaaaccattagatatttggatttatcaaatgaatctgaatatatgttgattacattacataacctctagaagggaaaaccaatatgttgtgtgcccagttatattagggtcaaatcaccagcccgtgaattgactaaatttttaactacttgctgttttttcaataaggttataatttaggatttgtttctctcattttattatggattaattatgtctcacttgccttgcagactttctggggccttggacacctagaacattttttgtgaatcttgaaataagaaaaaaattttggagggaaatagctgttataaggtctctccttaattctatgtctttattctatgagatatgaataaactataattaaccataatctattgacttattattacatatgattattttaaacgtagatataataggcttggttatctgctttcctggcctccttcaatttttctttggttaagtatctcacaaaaaaagtcagccactgaaaagtaatagtgcctgtgaagatgcttgaagaattacaaattactcagctgttaaatagaagcatctcagtggtatagtgtagaacctcagtgttccctgggacatcagtgtatttcagtaggacacatgcagttaccattcttaacaatggcctctgttgtaacagtagcataagattttatgttatataccatgtttttagacaagaaaatatgcagtattttaataaatttaaaattaactatgaaatgtcatatgaatgaggtagtattacaaaataatgtttcttgcattcttgtttctagtatgctattaaacctcatttacagtttgaatgattttctttataaatagtattaagtatagtagaagaaaaagtttttattgatagtattgttaatgtccaaatacaaatgatgagagagatttccacagtgctttcattaatagtgagaaacactgaatgtattatttcagattgttcatttagagtttggagcagagattttatagcccacgtatggcttaactttctcttatgttttcttagaatatgtgtaaattctccagactagatattccaatcagtatattgaaaataacttgagaataaattttcttaaagggaaacaaggtgcattatgtataactagtaagcttacccttactggtcacaacctttagtcatttgttaggatttgttctagcgcaataaaatgtatttactgttttccaaatgatatagtacttctgtaatactgtttttgtatcataagttcaattaacagaaataaatatatcactaaaagatttgagtttatacttgttctcaatacaaaatattaaattaccttctactttgttttcaaaatacttctagctagaggataaagaaaattgatagaaactggattttggccaggcatggtagctcacgcctgtaatcccagcactttgggaggccaaggcgggagaatcgcttgagcccagggtttgagaccatcctgggcaacatagggagaccctgcctctacaaaaaaattttttaaaaattagccaggcatagtggcacatgcctgtgttcacagctactctagaggctgaggtaggaggatcagttcggctcaagaattcaaggctgtagtgacccgtgattgtgccactgccctacatcccagggcaagagagaaagaccttgtctcaaaaaaaaaaaagaaaagaaaagaaaagaaactgggactttttaacttacagtttatgtttaccaataacaaacaacttgttagatgcaagctagtttttagtaggttgaccatatataatccatatcacatcttggtgttttttactttgaagcaaggtttcttatgagaggggttgttacttgtgcaaatctgtaattatttaggcagtagaaaaggcctgttgatacatattcaagatgagtggttttagttatttttattatttataggaaaaccatgctgtccataatttgaggaattcttgataagtgggtcatctaaaaaccagttctgtgatcctgggcggcggggggacctttttaaatgtactactgtaaaaatacatttgaggatcttttagtagaaaaatcctaacagcttcagggaccattatgaacattttgcattaaaatgttttgcagtatggacagtaccactaatattcagcttttcctctttttttttttaacagagcattaagtaaaatgatactgaaatatagtagatgtttctaatgactgttcgtcagagtaacaccttaaagtatgtttacttaggaaaagaaaattagctaacaaaaaaaaattgcatttacttaaagatatttcttatattgaatttataatatctctgctacttatgtatgtttattagcttttgctgcattattatacttaatgctatagtattttagcacataaaaaatgacaaaaagaatattttaacttccatggctaaaatattaataatgattatgtttgtttttaaggttttaaaatactttgtaataaaataactaatggtattaatcagttgctttgctgctatactatatcagagtcattgccaattcataattaaactgaatcataggctgtctttaaatgccagcatgtattcattgaatattctgaaagtttaatagaattaattgctttttagtggatagaataagccattaattataaatgcattggtaggcatttaattgtggttaaaattagtaacttcctgaaaattccagtctggttggcgataattaaaacttgaataaagaaaataagtgatttgtggtgtaacacttttgagatattgtttacactggcggtaaccgagaaatgaaatacttaaatctattaatgttattagcattagtttcatttaaaaggcctggacatttttttttatatttgaaatggtttttgccctgagtttattcacctttaccaagctttgtcctttgtctttaaaagaaacacactttgaaagtaaagtggtaatttttaaattttaattattatattcataggtttttaaaattaaagatatgactatcactataaatggcatagttcaactttttaatatgcctaataccatctcaaaatatttcagtattttcacttatttttaatattttttataggaaaaattacttgattttgtttaaactctgaaattgatttttatttaagagtatatagttctaaaaagctagtatggtaaatttcattattctactttattacaattaaatattttcatttaaattaaatattttctatttctgaataaccaccttttacctcattcagcaaagaaaatcacttttaaatttgtccatatccatattctctttcatttttattgttggagaaaaactagttaggagaataagacttgacagaggagccaagaggtgtgtgttaaaagcctcaagaaaagagttactaatttgtgtagttgcaaattaaattgatagtgtatttttcctttctccaatatcccactgtcataataccacattttcataggatcagcaaacatgctggtaaatgttttaacaaccagctctgggactagagaaagccctgctttttaggttcactgatttcatgatataaccttccattagtccatatactgacaaaatggcttaaggcagtattttctaattttaatgcgagaaagtagaagacagtatgcccaacttctgtcagcatgtgtttaaacagctcaaagagcagacctgctgtaaaatttcaaccagtgctattgcaaacagcaaatacttggcctttcccatttttaaagagtttttgaaataatcaaacccagataatacaaagccgttatatcagctattcacatatacacagcattacctttcacacaggaacttcgcattttgtgtctttctgtcaagctgtggggctaaataaagccttttgcaacaggtcagaaactttacaattttcttaagatggctcagtttcttacacatagaaagtcccctacttagataccttaaaacttcttgagatgacatttcagtcagttttaagttcttactggtataaaatgtatcaattctgctttgcttctcagttccattttaactaaagcccctctccatggacacctaattcttgcaatgtgtataatcttatgaaaactaggaggaggagatttttagaaactaaaagacatttctgccatattcccaactcagagtcatatttcatatttataatctaaactgattactttctccatggctgtccctgaataaaattgtaaactgggccaaaatgtgtcttgagtcccattttcttctactttttcttttcctggtcaaaatttactatcaggaaaggaaataatataacttagcctccttgattattaaattactttgagtaaattactctgctgtggagatgcctctggtaggacaaaaatagtgctgaatttggacttgagttgggatacaggcctggctctccaacttcacaaggcatactagtttcatgaaatcagccacatcacatgtacagagctgatattcagctggtaagctttagttcagtggcccagttttttaaatattgagtatcctagcagttggtaagtggttgctgctccaagacccctaatgccttcacccttcttctccctactcctcccaaatccagtagctgaaagtttatggcctggtggtggctttgtggttaccagaatacctttccatgcccaccacccaggaaggccgtaggtgggcaccaatggagggcacgatagtgtttcccagcctgctagcctattcttcccatacacttgccagatgttttaaattctccacattgaacagaagttgactgtttttaacatatgcaacatatcatacattgctgatagtattctacattaattatcaataggaaaatatccccaacttgagaaaacaatttgtgcccttagagattgaagccacatgcccagagttctgttgagctaaaaacaaatctatgaagttaatttctaggggaaccttcttttccaagtgtttctactctcaattatttatcattcattcaaagtgaaattttgcttttcacttagttttgagtacaagggcattgtattttaattcattgttttaatagttctactttgccagcagtctcaactgcacctgactctttcagcagtggcatttctaagggatacgttatcatcatgtcttccctctaaaatatagccatagtaagaacaaaggaaaataattataagttcatgtttaaattcttaaactgatggtgtttttatgatttgtgatttctgatctaaacattgttttgctgtacaacatattcaaagtaagttcctgaaccacttttccaaattaccttcattgtcctttcattttaaaaactcaatcctagtaactctgaaacttgccatacagactagtatggttcaatcagtatggttcataagatcttttatgctaaattttaacccaaagcatttttaatttctaaaaatacttggtgtaaaaggatgcgactgaatataagtgctggtttttctactgatgcaaaataaagggaagacttactttagtgtcctgcacaaaactgataggttaggttttttttactttcagttaatgagtagtaaaagaccaaacttcattcttatcaaggacaaagttatctttaatctgccgtatgtatctctattaagtacccggcatttatttcacatgtatgattccttttgtgaaataaaaagttccatgtggaataccaacatagaatgtgcagtaggaccagggctcaaagtaacagatcaacagtgaagatcagggaggagcctttggttaactattctgtcaatccttgtttacattaaaggtagtggttatgcttttgtataatgatgtatccctaacgtgaatattcaaactaaagtttgttatcctcctttctcaagaaatgttgtcataatcatgccttacagaaatttgctaagcctgcacattgttgaaaagtgattttttgggtttttatttttcccgacttattttcctagactgatcccgttgagaacacatatgtatggaacccgagcgtcaagtttcacatccagtcacggtccacatctccttccacatctagtgaagctgagccagttaaggtgccttattggagcatccctgctccccaacttttcacttgtgtcagaaaagagggaattgaataaaacaagtctgtctctctcctcttaaccaaatatgtaataagttacagtctattggagatcattacatttaactgataatgtaggtagaagtaaaaaactaaagagcacattgtcctcaaatagtcaatctgaaatagacaaaactaactagaaagatagtctttattttaattagagaaccatgtagaacagaagattaattatgtaaatttttgaattattagaaactctaggcaaatggcagtgcaggtgccattctcatattttaattcttctaataaatgtaataggtcatgatataactaacctgttacatcataaatagagctgaaaaataaaatagccacttctggcaactgaatagttcattctaactgctaaattggtaacagtcaactaaatcctgacatttaatagtgcaaaaaaaactgtgttgtgtttacacttcatgtcaatcaatggttttaaatagccaataggccaattttcttaacagagatcatttcttccacaagtcaaaagaatgctgtacctcagtccataccatcctaccttaagatcagctctggttcttcattcagcatcaggattcagacaaagctcctttgctttccttttcttaaatctccagagctgtgtctagcattccaatagaagcagatagtccaatctgaagagttgtctgaagtgaagtgtgaggttgtagtcaggttctgacttgatttttccaactctgtgacagactcccccaaattgtttaagttaatgagaccctcttgtgtttttagttataattgttttaatattttgagattatacatttttgttttaatgataaaatatttcaagcattcagagaatataaacacccatgtaaatatcacccacagattaaacagatacgaaaattttgcttgtttttcaggtttttattcaaaaatatttcagaaacagttgaaacatcctcgtgtataccgttccccactcttctttcccagacatatctaaatatcctgaagctgatgtgcatcttccctttcttggttttagatgttcatttcatttgtatccacaaatgatacatagtagtgcttattatgtgtttataatttacataaatattacctgtatccttctgtaatttttttcattcagaagtctgcttttcaggtttattcctacagatatgtgttcatttagttcattcattataactgtggcatataccacaactacttatccattctcctgcagttggatatttaggttgtttccaatttttcattattatcagtgctgaaattaatatcctaatatctgtttttgcaaatgtacagagtttgtttggcatgtatacttagtggaattactgagttgtatgttatatgcattttcaagtttaactggatcttgccaaattgttttccacagtggttggaccaattttcactcccccagcagtgtgtgtgagttccccatttccccacatcctcacctcacagtcacacattaacttttgccagcttgatgggtattaagtgtcatttttgtattacatctgttttctagtgttattcagcatctttttgtatgtttattgaccattgatgatttgcctgtttgtgtcctttgttgttctattgaatcatttttcttatagctttttgtgttcattatatactctagatactaattctttgctagctatatgcattgcaaatattttctcccagtctgtggcttattttaaaattttatttgtggtgtctttttgtcttgcaaaagttttgattttaaaatagtcagatttatcagtctttttctttatgacttctgctttttatgtctttttaaaacagttctctatgcagagattataaagattttcttctatattttcttctaaaagtttttaaattttgcttttacttgtttaggaccttaatcaaactgatatatattgttatgtataatgggaaatgggcttctaatgtctttttcccatgtgaacaagtgaccctgctatatttccccccatcgatttgtaatggctatttctgctttatatgcatggatctgtttggatactctcaattcttttccattgttcttttggtttttcctgcattggcagtaaattgtcttaattacaattactttcactctaaaataattcctgatacctggtatggtgagccatcccacataccttcttccttttcttcttgaccttttagtttttcatattacttttaaggtcagcttgtcaaatttcacatggggcttttgattggaattgcattaatgtatagatctatttgaggagaattgacatctttcatgatactgggtattccatctatgaacatggtatacatattagggattctcttatatccttcaataaagtttcattattttcagtgtatttcatattgcttgttagatttgttcctaggtaccttaaattttttgttgctgtggtgactgggattctttttaaatacattttcttactgtgcattgccttgtctttataaactctagatcttgtatccagcacccttgcttaattttttttaattctaataacctttggactttctatgtaaatttgacgactttgtttcctattgttttttattaacttttgtatagattttcagtgttcctctcttttatctttcatatgtatcttttcaaatgttaaattataagtttggtttaaaactttttcaagctatttaaaagtaaataaaatctaaattagagctaaactcacaaacagaaaactctgagaaactcaactgaattttgttttaaggctgtagtgcttataaaatattctgtttttggaggttgtatggtaacaaagatagattgttgtatagtaacaacaaagatgaggttgtataataacagcaaagaaaggaccatccatttttcttataatattttaaaatattctgttctttatacaaagactagcgttttccttttatttttttgcttggcatcctgaaaggaagttactttccatgtcttttttttttttttttttctcactactttgctgattaagcagtggctcttttttccccataataacatccagtggaatgattggttctttgcattcaaagaaataatattacaataaaaccccataaaagaagaccatattttacatagctacctaagaaagatatggtatgtgactaaatttgtattaaagtcagaattccaataatattaaataattacaataaaattaaataattcccttctttggaaattaatttctgcacaaaaatcccagtgtcagtctctgtctatgtattcacatccagagctgtgttctatatatgtaatatatgttctatgtatgaaagttgagtagttaaaagaatcttctaaatattttattataaatcattttgagatactttttagaatatggcaaattcagatgaatgtaaaaattaatatcctcatatttatgtaggccacatgctatggctttttttatttgaatcatttgatccaaatgatttatttttatatttccagactaaagtaacttactaattgaacaaatatttcattcgtagatattgcaggcagagatttaaattatcaacactatgagaattttagctttattgaggttttctttattattaattagtagaactttttgccttattgatgttttgttttatttattttggcttctttctagttatatttgaaattaatggagtgtttcatgacatttatttccttttttgctcctgggttcagactgtagactccactccactttcagttcacacaccaaccttaaggaaaaaaggatgtcctggttcaactggctttccacctaaggtactcaatctagttataagcatagtgtgttccaaaaaaaatgaattttatctgctctatgcatttgctgtgatttttttgatattatttcttcaaatttacaaacagaaaaacttataaaataaattatgtgtgaatgcaaataatcaccaataggaaaggtagggagagcgtacagcactttttcatcttcttaaattcaatgttttgaagtctgttataataagaagtagcacttcctctaagcagtatatgcctcagtaaggcattaagttgaggccacttgtggaagaatctgagactgaaatcaataaaccagtgagaaagaaaaacgtttagtgaaaaattcaggtggacttttttttcccattctatttgacataaatatgactgaagtattacatatggtagaatgagaagatttagttgcttgtctcaagctcccacaaagaaattccagaaattggaaaactgaatgatctgcctctccagaacataaaccttggataaaccacaaaatgagagagagaggtcaatagacctgaaaaaatatacaaaaaatataactgatatagaagaaagacaaactgaaataacctgtgcccagataaagcaaaattttaaggccagatagaacatgaatttaaaataaacataaaaaatatccttaaagagataagaagtatgttggtaacatgaggcaggataaggtagttaggaagaaaaataaattgggaatacttgacatgaaaacataactgctgaaataactaaatagatgactttaatagtagaaggggtaaaatggatatcacagaaaaacaagttagtaggagggaagataagatgaaaaacaggaaagttaagatatatgacaacccaaccaaaagaaaacactctagtaaactaaaggtttataaataaaaggaaaaatattgggcattcaggcaaaaaatatgtcacttaaaggggaaagaaaatgagattatcatcagattttttcatagtaacagtatgctaaaaacaacagcagtgaaataacacatttaagatacccaaggaaagtacaagtgaaagatttttaaggatttaatattttaaggatagtaaagcatactccaaaaatgaaggccacagaaaactattaagaacatgcaagagctcaggaaatactgttcccataccccttctcaagcaatgtgctagagaacaagcttcagacaaccaaaatgataagacaccaagtactttgagaggcaagagtgaagcaggagtctagagtaaattagagaattgattcaaagtccacataaagtgttataccagttctgaaaaccagacaactaccccaactcagcaatacgttaattttgtgaagtaattaaaccaaagagatcacaaatttaagggcaccaaccaggctcactggttggtgagagaaagaagtgcaaaaccacaaatagttgagatttggcaaaagtccatgtactgaatggcgagacttcaaatcctttcctctgcttagctcccagaatactgactcttgggactgtagcctcctcctccccactctgcttggagaggatatcagtggatcctcgggtccactgaatggcccagaaaagacctatcgataatgtcatttggggctccctaatgagatggctaggtcctttcttaacaagcacatcatatgtttgctctcatgtggacacatagatagacacaaaatctctttagcttttttactgactcttaaaaatgttaagattcccaacagtcagtagacatttcaaaattatctaacaaaggaaaaagatcagggatacgtggtggctcacacctgtaatgccagcattttgggaggcttaggcgggctgattgcttgagcccaggagttcgagacctacctgggcagcatggcaaaaccctgtctatatgaaaaatacaaaaattagccaggcgtggtgatgtgcacctatagtgccagctacttgggggttgaggagggaggatcacttgagcctgggaggtcaaggctgcagtgagctgagatcgcaccactaaactccagcctcagtgacatggtgagaccctgtctcaaagaaaaagataaatatttcctgtttttgttgaaggaaaaagggacaatgcaaaaagcagaaagaaacagagcaatatgagaacaagaagtctcaagttaaagaaaatatgataaatattttttaaattcagtagatgagtcacaagataaatttgagaattctcttagaaaatattgcaaaaaatcaggtagaaattaggaaaagaaaatatgagaaatccatatccaacaagtagaagttcctgaaagggaagacagaaaaaagaaaaggaaggaaattatcaagtaagtaaaagactttttcctgtaactaaaagacatgtttccagattgcacagttccatcagtgcctactagcactagtggatgacaaatacctgtccccagtcacatcattgtgtgagttttcaagataccaaagatagaactttttaaacctttaaggagatttaaaaaagatcacatccacatattcaggaattgaaatgacatacttacccaaggcaaaatgaaaagaatagttagaaggtaaaatgatttcaagctagaatttttgattccctgtcaaatgtcccatcgagttgcaggggggaaaaaattgcattttgagaaattccagatctcaaagaaatttttatcacccatgtgctactttctaaggaaacttaattagttctaccagaacaaggaaggggacaaggaaagagagacatgaggtctatagaagaaggaattgtacacagaccggttaagagaaagactggaataggaaaccagagggcttcagcagggttgtcttcaggtcaatagaaaggggtaagggggctgaaaggcttccagtgtgtttgaccatgtggtaaatagattccaggggattttacagttccttagaagagtctggaagatttagtgatagagatacagaaaggtaaaagtcgagggtgggaggggaactattaattttagaaaaatcatgaggttatacaagtaagatgataaccatagtgtacttcttattagtgaataatgattctctagtcataataacttagacattacatataaattttaagctaaaactactataacaatattgggaaaaatgaaaaaagggagtagatagtgtaaaagggccatatccttctctaccatagcaggaagtgaacagataacgtctcaaatcaaaaaactgtagtataggctttccaccccagctctgccccgcccatatagatacctattacagaaggagggaaatagcttttaaaaaaggagagttaaatgaaattgcctgtaggaagtaggaggaatacttctgattttgtcataagcattgtaataccattttactttttcaaccatgtgtatgtattaatttgattttaaaaatttaaaacagaaaatgtagaaaaattttttgtgactgggaataaatataagatctcaaatcacaagcataaggtgaaaatattcgtgggctttatatcaaaattaaaaatgcttttacagtgaaagcattgttaacagatgatgacagactagtggaagatatctgcaatgtttaccactaataagaggcttatttctaaaatacataagaaactcctgcaactccatatgaaaaagactagaaatcccattgaaagattggcaagtgatataaataattcccagaagacgaaatcctgatggtcaacaagcatgtgaagaaatgtccaacttcattaatcattggagaaatttttaaaatttaattttagaattactatcactttctattcaaaatcaagataaaattaagtaagatgacgtcatggatgtggagaaacaggcagcttcacacgtggatactggaagtataaacgggtacagccattctggagagaacctagacagtgtagagtcatacgtaagctgtatgactcagcaatctcatttcatcagaaaaatctctttcctttacaaaaacctccatacagattcattaggcaacatgatgaagatgtttattactgtattttttatggcagtagggagttggaaataggggaaagattcctaaaatgtaattgatatataacagaaacacatttatataaattaaaaacacatactcagactatctaatttataaagatatatacatgtccaaggtattggatcatcaaggatgaaaaggcaaaataagacaaaataaaactagagtgaggcttctatcaagctgatattattttatgaattaaatattaacttagtttgttgcacctaatatttctccccaagaaataaaatttatttcatgttttttaaaagatagagaagtgaatctataattatctcaaaatagaaattttaaaagggaagaaaaaatatttttaaaaagaaaattaaatttttttttttttttttttgagacgaagtctcgttttgtcgccaggccggagtgcagtggcgtgatctcagctcgctgcagcctctgcctaccaggtttaagcagttctcctgcctcagcctcccgagtagctgggactataggcgcatgccaccatgcccagctaatttttgtatttttaatagagacggggtttcaccatgttggctgggatggtctcgatctctggacctcgtgatccgccctccttggcctcccaaagtgcttgggattacgggcataaggtaccgtgcctggccagaaaatttaatttctttaaaacattttaaaattttttgtaaaaaagaaagggttgtgtgagatactctttgacttgtcatttattagtggtaaaagtttaattatctacagtaaatttttaagctttcaccaagagttgtacttggttctacttggctcttacatcttctattaaaaacattttactttctccaatgtgtagcttaaaatctacaacacagaaaaaatcagagtagaaaagaactctttctaatcaccactttgaaatttgaggttatggttaattctttctactccaaatgatcacataatctaaaattctaattttagtccatactttaatacctttcttactagatttttttcttttcatttttttctcttcttccagctgtccacaaagggaagtattagatatcaaatattgaccaggaggcaggaaacagggatattagaagccaaggaatctagactctaagatcgatcattcctgtgtctttctttatacattttcacaccaaaacaaaaacaaaatcctattgtgtattacctaaagattgatggcctcagaataacgatctttaattatgttatgttatactatccttagtggagattagtgaaatataaacccgttaatctttagtagtggattacacaacctctcctataatttaaccagcacctaccagttggatgatttattacctaaaattaatgctcagccaaaacactgggttgttatatttttccctgctgtcatactcagaattgtgacatcctgaatagatctcttgctggagaggaagtgtatgatatatatatatatatatcatatatgtatatgtgcaattcgggaggtattatggagaattactaataaatttgtcaaccctagagttgtttcattgctactgtttcaggtatgtcttgttactgtttagaagaagaaaaacatgaacctacttagagcagttgattaatttttccttctttgtattcaaagcctctaggactaaccagtaaaataacttcacgtcttttgcattaatgcattttgaacaattgaaaaagttagcactagaaaatttactcataatagtttctcaaagagccaaaaattaaaaagtagtatacaggagaaagagcaaaattttatgattttaatagattccttcatataaggaaataatatctatctttccaaggtggttatttgcatgaaataagatgaattatgtaaagtactggtacagtgtctgtaccctgactgggactcagaagctataggagcagttgcagagttagtaataagatagactgtgttctacttagagtcaaatcctagtgctgctttgaaactgaccaaaagatcgtgaggaacttctagaacacaatgctttgaggttggaccagagctcatgaccactctaaatttgagactctcaccccattctctgactaatgctggtagtcaggtttttctatgtaaaaagataatctacttctatttttttaatttcttttgtagtgtacaaatcatatatcccagttgaaaagaacaagatttatttttaacttgaattttaaagcttcaaatattccctttagttttttgttcatatgttagtgtctactgaaataaatgctacttgataaccttttaaaatcagtattcataatttattagaatatggagtagagttcttagtagtttaaatcaatcacacatttacaagagaaaaaaatagcaaaattcaaataacattgggtacccatggacataaagatggcaacaaaagactctggggactactagagaaggggaaggagggaggggtgccagggctaaaaaattgggtactgtgctcagtacctgggtaatatggatcggtcatgccctaaacttcagcatcatataatatactcaggtaacaaacctgcacgtgtacccacaaatctaaaataagagttgaaattatttttttttgagtacttagtatgtaccaggtactgtttgaaaggctttgtttatattaatactcatttaaccactccgttaggtagatactattatttatcctgttttgtagataaggaaagtgagacagagaggaatttagtaattttttcctaagttcacacaacagaatgaaaggttatttattatacatcatttattgttaaaacatgctaagagaattaatttggaaaacaaaggaatattccaaagagataaaatctacatttgcttaccaccatgtaaatcaggtaagactaagatacctttaactatggtgtattcaataagaaatttcaatctgccatctgtctctggaataatatttgtgtattcttatctgctcaagtgttatactgcctctttccataggaggaaactgattcgtgaagcatattatttgtccttggtcccagaaagagaaatgcatgatttacagtagaaacaataattttaaataactctttttcctaagaaggtataaagcatattaaaatcctatatttgtatcagtataaatatgcaatattttacttaactatttgctgaacaataatttggataatttattaaaattctgaagctaagatttatgagccccccaaaaaagctattgtttattttatatacttttaaaatggcattgaagagcaattatcatttaacttcttaattattttagcttagtccagttcaaattacctaataaaaatgtttaaagaccataaactataagaagatgtaatgagaaatggaaataattcattctattcctatttagaaaacattctagaaagtggtatggggcataaggactcacattatggaaatcttttaaacaatctgtgtgtttttttatcaatttgttttgcagcgcaagactcaccagttttttgtaaaatcttttactactcctaccaagtgtcatcagtgtacctccttgatggtgggtttaataagacagggctgttcatgtgaaggtaagaacacaaaggaaagaaaatgtgacttcactatctaaattgtaatcaaataagttgattctctttcaaaggtgtataaatgtttgttttacttaatcatttgcttttttgcataacaggaatggaaataatctgtgttgtctgttgaatgttcgagaaactagacatatttttcaggggcaatatatttaaatatggttcatttgtctttgttttgttattaaatttgtagtccctgccaaaaaacattaacctgacagaagaaaattcattgaattttaaccttgtttaatttattagagaaattgttattaaaaagtagacagtgtgggaaccttttcagaaatattaaatgtctgccactatgtctgaaagatattttattcctgtattaatagcagaggtttttttttttcccctaacatccatgatttattcatcacatgtttatggaacacccactgtacttctaggcactggggacataatagtggataggggaaaggcatagatcctaccctcatagagcgcacattctgagtgatgaaggagagagggtcaggggtcatgtgaacagaaaagaaagtatatttgtttgggtattcctttatttttcctaggacctctgaagtgaaaatggtttaaattataatggaacatatatttttttaaatgtttcagaagaatacttttttaaaaaatcaaatgaaatttgtcattacaacactaccttatatgaggggacttcaaaaagcttgtggaaaagtagaatttaaaaataaaaataaacaatataaactttttttttagcataagctccattaagttcaagacaactttgtaagcaattataccacccatttagtccatccctgaagaacagagggtcctgagaatgtaaccatgtcagtctagtctcctttacattattaactgaagaaagatgggtgcccttaaagactttttgaaattcagaaacaaaaaagtcagaaggaaccaaatcaggactgtaaggtggatgcctaatgatttcccatggaaacactcacaaaattgctgttgtctgatgagaggactgagcaggaggagcattgtcatggtgaagaaggactctggtgaagcttttcccaggcgtttttctgctaaagctttggctatatttctcaaaacactctcattataaacaggtgctatcatcgtttggctctctagaaagccaacaagcaaaatgcctcaagcatcccaaaaaactattgccatgacctttgctcttgactggtccacttttgctgtgactggaccacttccacctcttggtagccattgctttgattgtgctttgtcttcaggatcatactggtaaagccatgttgcatctcctgctgctgttcttcaaagaaatccttcaggatcttgatcccacttgtttaaaatttccgttgaacattctgtagctgatctgggtgcagtggttttggcacccaacaagtaggaagtttgctcagcattcatttttggtcagaattgtgtaagctgaaccaattgagatgtctgtggtattggctgttgtttgtgctgttattcatcagtcctcttcagacagagcatgaacaagattaattttttccctggcaaattaatgtggaaggtttgctactgcaggtttcatctttgacatcatcttatcccttcttaaaatgagttatccatttgtaaactgctgatttctttaaggcattgtatttgtctcttctcacattgctaataaagatatacccaagactgcataatttataaaggaaagaggtttaattgactcagttccacatgactggggaggcctcacaatcatggtggaaggtgaaagaggagcaaagtcacgtcttacatgtcggcaggcaagagagcatgtgcaggggaactcccctttataaaaccatcagatttcacgagacttaatcactatcaccagagcagcacagagagacctgcccccatgattcaattacctcccactgtgtccctcccatgacacatgggaattatgggagctacaattcaagatgagatttgggtaggaacacagccaaaccatatcaggcattgtccccataaactttttgtaaagcatcaatgatttcacccaagcttcattgtaaattttatatttgttcttacttaattttagcagaattcatgttgttctgataggggctcttttcaaattgatgtctcattcttcttagtgcctcaaactagatccttttcagacatattataacaagttagtatgcatttattttggtgcaaaagaaaattttaaatccatgcatagtttttccataatatgcattttccatgaacattctgaagatctctcatattgatgtatcttatgaaaaagacaagaaaatagttgctaactcaaattctaatactagttgccatttcctgtctcttctgctgttagaatgggaagggaccttaaaggaaatgtagcccatccccatcagatgcatgtgtttcctttataatagacttgtagttagcctgtatctgagtactttgagtaagagggaaattaataacatcttaaggcagtgcattctgtttggttagttctcacagctaaagtgaaagatccagattgcagtattttaactaatccattagatatgtgtgtttaaagccaaataaaatgttcagggttaagaaagcagagatttaagagctaggagtgtattaagttataaacatgaatgacatccaggaagtacatgtagattgagaagagagcaagtacatgagtctcttacatagttaagggaaggcaacaggaaaagatagccaagttaacctgagaaggaatcgcctgtattgttgactaggaaggtgtgactgaaggcaaagaaggagaaaatttgtagttttcaagctttgtttcattttggaacttagccagtaatggtatgtcattttaaaatttgtttatcagaaagaatcctggccagctacctggctttaagtcccatgtcattttttatgcaccacaattacttgcaattcatagtaggaatttttgaggtcttctcagactctcttcccttctagagtcttttgctgtgaaattgtgcctatcttttcttcagaccctttgaagcctactttatgaagctatggggactcatgagactgttcctagcctttgtctgccaggcttttgtaaatgttgtaataatgtggttccagcttctaaagattcctgtcatgttcctttccttgtggttggttggaattagatccagtataggatacttattttgttgcttccactgccctttgcttgtaagtaaaacaaatcataacttgctagatactccacttaaaactgaattgaaggccgggcgcggtggctcaacgcctgtaatctcagcactttgggaggcccaggcgggcggatcacgaggtcaggagatcgagaccatcctggctaacacggtgaaaccccgtctctactaaaaatacagaaaattagccgggcaaggtggcgggcgcctgtagtcccagctgcttgggaggctgaggcaggagaatggcgtgaaccccggggggcggagcctgcagtgagccgagattgcaccaccgcactccagcctgggcgacagagcgagactccgtctcaaaaaaaaaaaaaaaaaaaaaaaaagtgaattgaagttgtgtgtgatgactcatgcctatagtcccaactactcaggaggctaagacaggaggatcattttgaggccagcctgggcaacatagcaagaccttctctttaataaataaataaagtgcattgagatgtttggatgatttttgtcatcttgcctctctgctggtttcacagtatccatcagtgatatgtagtccatttatagagatggtaactgtacctctcttagattgttatagaaaaataaaaagcactccataaagttaactattgttattttagtagtagtttaagtatatgtaataataactcctaaaatttacctttaacttgtacttttttagtcattgaaaaactccattttcaaggattggtagagtttgccaaaccgaagatgtcaggtagcttaatgcccactagtgacccttgcaacagaaatttcaaggcagataccaagttgcagtgggatgaagagcaaaaaactctagaaaccactcttttagaaaatctaaatcaatcattttattcacaaggttagatgcttcgtctgttgcttctttttttgatcactaatgtcaatacagaacagcagtaatacaagtaattttttaaatatttactatgtctcattaaaattgtcattggtaagcaaatgaatcagctacccaaatgataaaacagttatttaaaataaaattggagataagcattcatctaacatagcatcttgtatgcagtgagtgttacgaattttctttttgttaaaatgaatttttatcaaacgtttcttttttccctctaaaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcagggtaagtatgattaagttgggtttagattaatcctttaagatttattaatgaattaaaatcaaatccagttagtttaagaggatagttcttgatggaaaattaaatgaataaaattcatctaataattttatttcatctagaataatgatttgcaaacaaaaacctagcttttacatggaaataagttataaaatgtctcaagtttttccatattgttcctatcttgtgatgaaatcttcataaaggagtttgtggcccctgctcttgcaagagaggtggcatatggttatgaattatgagctattaaggcatagtcttgttatcttgggtagtatttacaatgtaagctgaacttcatcttacaccaagtttgacttttatgctatttagaaagaaacccatgagtgttattttaatgaaatatgagtgaaagttaaaatggtaccattaaaatgtttctcagaataaaaagtcattctgtatttgaagaatgtgttctcacattttctcatagcttaatgatatgtgtctcatctgctactttaccaaccagaatggcagacttataaaacgtgtacattatctgtaggtcttcaccatgcaattacatatgtaatttaagggatattttcatttgagttgttttggctgtttgtctgtctaaaacaaaactaagattcctaagccagctggagtgaagaaagggtggcagagagcactggctatagtgtgtgacttcaaactctttctgtacgatattgctgaaggaaaagcatctcagcccagtgttgtcattagtcaagtgattgacatgaggtaagagtttgaaggtaaaattatttgtatcattgcaacataggaattttaaagtttctgattttcaaaaattgtgttgccatggtttatttaaatgaactaatttcgtattttctaatttgctaatattgctatagaaacagaattgaaaataggaagtaaggtgtatttataggacaggttggtatgtgtgttgagtgtgaggggctaggagttaaggaaaaagaagttggtgtcccaaagacctgtgtaaatggggtaatggaggcctaccatgtgaagtttatattatcacatcacctaaaggcttagagtataatttcaatgtgaggaaagaaaataaaaatcagaaaggcttctggaaaacataatcagtaaacatttaagtaagtacagcccttgaacacttctggtctcatttttcagattcttcctgtgttccttagttctctctcctttaccttttctcctaactccaggcactatccttgagtgatcatatttactcacagcttcagccatctcctctgcattgatgactcccagacttgtatctccagttcagatatatccatccattgctcaaaaccggaatttctagctgtgactcaaattggcacttcacattggcatctcaaacgcattatcttcccctacaaatatggaacatgacaggatagatgcaagaaatattggcaagaaaaatctgatagaacctactaagggactgaatatagatagggaaaagaatcacaaataggactaaggtgtcaagcctgtaagactaagggagtcatggtaccaacaacaaaattaagggaatcacaagaaattattgtggaggaaatacgttgtagatgttgaaggaacaataaaatataacatgagctgggttgagggtacttaagatttattatgggaggcaagagggtccactggaggctccagagacctaccagggttcaaatcccagttctacgtgtatacttaactggccttgtgactgtgggtaagccagcaatgatttctagctcttgtataatgtgccactaggaagttattcttgataaattatttggggcactattaattacaatgggggaaaattaatttttttaaaaaattaaatttgggtgtttggtgcagttaagctttgggtatgtgttatttggatacacaccccaaaccacacacacatagccacatatagtaacttttaatgctttgcttttcgttcagggatgaagaattttctgtgagttcagtcttggcttctgatgttatccatgcaagtcggaaagatataccctgtatatttagggtaagtgtgtatgctgtaatttgatcactgaattatgtgtttttaatgagtatattttgcctccctatataaatcataaattcactataagtaaaaccaaatcttatattcttttatatattccatatcatccagtacttgaaggtatagaaaattggtgctaagtatttaattagtgaaagacctggagaaagcatcaatatatggcttataaaatatgcttcctggtagataatattttttagttccaattcaatttttaaataaatactaccacatggaaaattagataagtgtgaggtttctcaagtttttaaaaaaataaaaatgtctgtcttgaaaaattaatgcgtttgttacttactgctttgtaacagccattccaaaacttagtagcttaaaccaacagtgatttactatttttcactattctgtggaccagctgtacagttcttgtggtgtccgctagtgtcactgatgtgactgcattcagctcatttgggaccagaacatctaatgaccttgctcttacatctgggtgctggctgttagctgggtgatctcagttctcctctttgtgaactccctccatgtggtctctggtcgtcaggtaggctggctgagctcccagtggctggcttctaagagagcaaaataagctgccaggccctttgaggactaggcccaaaacaggtataataacccttctgcattctgttggtcaaagcaagtcatgaggtcagcccagatttaaggggaggggaaatagactccacctcttgatgagaagaatggaattccttaggaggacttgttggtaggcgtctttggaggcccttgccacgatgcaatcttgagtgggtaaattaagacaatagaggttaaaaaaaaaaactactgcccaattgttatgcctatctccctatatttgtctatgaatcttgtatctaaggaaggtcaggcaaagattatacttagtctcttagttcccagactgacaactatttattttcctcccagccaccaagggagcctacagaggcccacttatctataactgattttcatagtgtgagtttattgtcactgctacttaataaggaattctttacttatgataaggaattcatataggtaaaatttaaaactgctctgatagtgttgtttgtataatgataaaccttcatttaaatattaatttaaatggtcaaatcttaatgataatgcgagttattgttgtgaagtaacagagaatatatttctgagcacttctgaccttaaaacaagtcacaagtcagtatggtgtggcgcttaagagcatgggcacaagatcccagacttgtagttgtatgtccttggagaaatgatttaatttctttgcatcaccatttttttcatatataaaataaggatataatgacagtacatcctaaatcatgacgatgttaacagagttaaatgagttaatacttgtaaagtgcttagatctacctggtgctcagtatttactcaataaatgtcagttgttgttgttgttgttatatatttaatgcctctttagtgatagtgttctggcacttttacagaaggaaaatgaaaatgatactaacatttcaaatggtgtctgccacctttgctttgtcatgtattctagtgctaaaggtagttattctgattaggaatagctgaactccagtaatggtatcatttaatgaatgcttattttattggtgagtgctaagcaaactaacataatcatgaaactagcataaagggtgtctgttttctaatatcatgaatattgattaaattgttctaggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcataggtatgaatttataacatttatcatattattatcattgtttactaatctaccttgagaacagggattggctttcatctaggaatccccagtgtccaacatactgtgcatcatatcataaatgctcagtacatgtttactgaatgaatgagacctatatcagatctttgtttttcagtaaacaggagtataaatacactttcaaagtgccttttttttcctgaaaaaacaacagtgctaagcattagcctactaatctattttctgcttgtgtgatttagaacaagttagtttcttagagtttaatatataaaatacagatggtaattaccttgctgaggttattgggaagtttaaataagatggaatacataacacagagtgccctgcataagaaagaaatccccttaacaaatggcagtttctgtgtctggaggtttaaatttttgctgtattcctgtgtatgcatctaactcttttgttactttccataaatactgaaaagttcaatgagtatggttcaaatgccattcacaatttttacctcccaaaacaataagtgtagaacaacttaggtttttcattttgtttcatcatttattaaacatttacttctttttgtaagtattgatatggattattctttaataattgttctattttagaagacatgagagatttaccagtataatctgaaaggaaatagtgtaaactgttattgtaattcattttatttccattttttgcaccaaatgttcttatcatctggtttattagcattacatggtttttttcctaataaaaatctttcacattcatgtcttacatagatcatgaaagaattgctttgggaaacgaagaagggttatttgttgtacatgtcaccaaagatggtaagagaaaactttttttttttggagtaattttaaatcgtgttaaaaaaatttaaactgtagattctaaattctacaaagagcaggatttgctcttatttatcctgcgactaaaattttccagacctaatttgacgtttataaattaaaagattatttttaaatttctataatccccctgaggtttaaaacttcaaatatgtattgtctttcttgtatcattttatttaacagttctgtacgaactcagattgcatttctttttttttttttggagacagagtttcactcttgctgcccaggctggagtgcagtggcacgaactcggctcattgcagcctccgcctcctgggttcaagagattctcctgcctcagcctcccagtagctgggattacaggcatgcaccaccacgcccggctaattttgtatttttagtagagatgaggtttctccatgttggccaggttggtctcgaactcccaacctcaggtgatccacccgccttggcctcccaaagtgctgagattataagcatgagccactgcgcccagcccagattgcatttctaaagatggaacatgaaaaaaaatatatacaacttgattttcacattgttctattagtaccagaagaggcaacagctattaaaatgtgtttgtttggaggtttttcttctagggaaaaactaaatgctgggtgaaataaagagaaaccaatataacttggtattcataaatacagtattctaagttttatctttatgtcaacttagatcatgggaaaacaatgcattgttagccatataaaaacttctgaaaaataagttctctgtttttaaaaatgggaatcctatggtgacgttccctagaatttagtgccagtagaaaagtttccttgaagatttggcatacttttacacaagaatcctttggggtttgccttggctgccagaaatctcaggactcaaatttaatacgtactataggtgagttaaattatcttatgatgggttggataatctttttttcctgtgacttctgatgtcttattcttccgtatgtgcatctgtaagttgacttacatccttttgagtataattgggatatgattaatcaataaaactatattttgatttattattctttctgtgtttagaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgtaagattctctttcttacggctgtcttatctttatatctcttcttccttttcccttctacttcgtctcccaaatgttgtcattgttgataacagttttttaaaaaagtcattcttaatgcttttcctcagtattgattatgttgttgatgtaaaaaccatatgtagttaggcctgggcaaacagggccagcattagcatgcacgtaatttaaacaaaacatctttctgtggaatatttcactaagatggattttttaccccacatcatattttgaaataacccagaattgttatctcatggtcccccaaaatatggtgcttgtaagcatcagtgtttcacagaacttattctggagaagtagttactaagtgagttatttaatcaggtatgtaaaggtataatgtaacatctataagaggtgttttttcagttttccacttttatctagatgggtagatatttataattgcttattttaccccttcaagaaatattaagacataataaattattgaatacttttttttttttttgagagatggagtcttgctctgtcacccaggatagagtacagtggtatcgtcacagcccactgcagcctccaactcttacactgaagcagtcctcctacttcagcctcccgagtagctgggacagcaggtgcacaccaccacacccagcttatgtttttattttttgtttttgtagagatggtctcattagttgttcaggctggtctcaaattcttgtcctcaagcaatcctcccaacttggcttcccaaagcactgagattataggcttgactcaccacacccagactcattgaatacttttaattatagaatactttggttattgaaaataatccaattattattgaatatgtgccattgaatatgagttaacagcaatgagtaaaatagatacagtcttaaccccacagagcatggggtgcagtggaaaagattcgtgataaagcaagtagttgcagtagagtgtaagtgctatgatagcagaagtagagagttctgtagaagcacatagaagtatttcatccaaactgttttgtttttaatgaaaaatacttgagcatgttaaaatgctgaagggaaaaaaaaccctagggaactacatggaaaagttgtctatatgggaaatagagtaagaccgccaagaaggccagagaggacaaaattcagaagacaggtgcaagaattacttgggggcaggaggagtaaaacctcttcatttgtaacaaggtaggaggaggagtgatgggtatgggtctagtcaagtttaaaggttcagtgcgagaaagtttgggagggcaacccatgctcattacagaaaaatcagaaagtctgcgtgaacaggacaaaagaaaaatacctctagttctacccatccagacttttttttcccccaccctccatcctgggatgaacgacttaactattttttgttgttattgttgttgttttttgtctttccagcttttcaactgcagatcttgggaattaactatttttaatattttgtttcttctgaaaaatatggtcttaggtgggcacagtggcttacacctgtaatcccagcacttcaggaggctgaggcaggaggatcgcttgaggccagaagttcgaggccaacttgggcaacatagcgagaacctgtctctataaaaaattttctttaattagccaggtgtagtggttgcatgcctgttgtcccaactacccaagaggctgaggtaggaggatcacttgagctatgatcatgccattgcactccagcctaggcaatacagtgagaccttatctctaaaaacacaaacccacacacactctcatactcatcagtggaataaatgctgtcttgtaactgaatcagataataattatgattattctaatgtagagtcagagttggaatgtctgacttttttgtgtagctctttcaataattccctttgtaaccttagtttaagtaaaccattgaatctttctttgcttgtgtcaccatttgttgatattcattctttcaacaagtgtatattgagcatctaccctattcatgtaactgtgctacagtgctttattatacattcttaacagggactagaacacttacctgaagatttctctgctttctaagtttgattcactgtcaataacttaactacttttaggaatcaaatagttcaaatataatgaaattcctttatagaactcatgttgggcaaagaaatagtatacccctggtgtttacagaatccgtctatattataacggctatataatctgaatcatggtataccagttcctcatttacgatatatgttctgtttgcttcaaaaatgttttgatttggctactatatgatagccccataggatttgggtgggattccactctacagttatttagtgtagacctttcaaaatatttggggtttaatagttaaaagtaatccgcaagctgcccccccttcccttctcccaggttacaatgcaccatatctctcggtgtacagtgaaaatgcagttgatatctttgatgtgaactccatggaatggattcagactcttcctctcaaaaaggtaatttaacattaaaatgtgggctaagccaactgagtataagtgaaaacactaaattactacatagtaattttttttttattaattcaacattttctggaatgtgtaattggcagtttgggacttagctaagagtgagaaaatagaaacagaaataaagttggttaatttccttatgcctcactaaaaccatactaattttactatatttggtttatgcaaagtatgattgttattattatgaacaactagaatatatcctacaacttaaaatgtcagtgttatcttctacttttggattaaggagctctgagagagtacatgattattatgaattataactgtcattcacccagtgtttaatcctgtgaggacagatttaaaaggctagaaaagtaattaaacttagaaccaaaactgtttaagtgtccataattgaaaaataaatatttcatatattcctaataaaacataatatttttcttaatatataatcctgtttccataacaaagagaatttttacaattatagaactgctagtttgcaaaaatgaagagcaatagtttcatatagatagatgtgatatatatatagcatgtatgattagttgggggacagggtttagagaatatgtgaaagtagcttagatcatatttcaaaattagcacccatttaaaatcataatagcagtttaaaaagctcttgtaaatactgccagattatctaaagcaactaaaatatactctagtttgtaaatttggattggtcattattacttttctgtggatttttttgttttgtttttgtttttgagacagggtctcgctctgtcatccaacctggagtgcagtgacatgatatcagctcactgcagcctccatctcctgggttcaagcaattctcccacctctgcctccagagtagctgggactacaggtgtacaccaccatgccctgctaatttttgtgtttttagtagagacagggtttcaccatgttggccaggctggcctcgaacttcttacctcaagtgatctgcccgcctcggcctcccacggtgctggaattacaggcatgatccactgcactcagccctatttgatttttatcatgtaatttttgcaatgtatgtgaaagaatagatatatggcctttgtgaaagataataataaactgatcactcatgaacctacctcctaacctgagaatcagaacatcactcatataactgcaaactgcgtcatgttgtgcttatcattcctttgcttttcttaaaatacagaatttttgcatatttaagtatccctaaataatatatctttcagttttgcttggttttgagctttatgaaaatgttataatatatagtcattttctatcttgctttctttactcatccactgagtctcattcgttcatgttgttatatataccatatagtttattgctttcagtactataaaatattctgttgggtgaacttagcactactgtctgttccctgactgggggacattgaattatttactagctttttgcaattgtgatgttgctgcatctgttttttggaatagttttcaggagtttgagtcatatacctaggagcagaattgatgggacatagggagttcagtcagctttatgagatagtgtcatattattttccaaagtaattgtaccaaccaatactcccatcaacagcataaaggaattcttatcaacatcctagtactttccattgtcaggattcataggttttgtaaatggttacaaagtagtatttcattgaagtttcagtttgcatgttgctaattaactgtgtagttgaaagtcttttgtgtgtttattcatcattcatatttcctcttccataaaatgcctggtcatgctttttgctcattttgctattggattggccatatttttcttatttattgaaattctttatacattgtggatactggctaataatggatatgtaaatctttttcttctttgtgacctattcattcatttgtatttggctgaacagaagttactaattttaatgtagttaaatgtatctttcttttcctttatgtttgtcttttttctcttgtttaagaaactctttcctaccttaaggtcataagatacattctattctcctccaaacattttaccttttttaaaaaatcttttttaaatgtatatacccagcctccaaacattgtaaagcttagcctattacgtttatgtttttaatccaactggaattcatgcttggttccgtataaccagttgctcaatcactatttattgacagtccctcctttccccagtgatctacccttccatctccatcatatgtatgcatttagtttttgatagtaagaattcataaatcagctgtgttgatatctgcttagtataactgttgggtcattaatggctttaaaaagtctaaggtttaaatgtatttctacttatttgttcatttgcttaggatagccttcctttaaaatattatcattgcaagtttgtttgttcaaattagatagtattatacctttccagtcagaattattgttgatttttctgagagggctgcattttgaagtagataaatgagaagtcttaataaggtgtgctttataagcaggacaaaagttttataatttaatttttaaaggttttgttgaaatactaattttgtcttttattttaggttcgacccttaaacaatgaaggatcattaaatcttttagggttggagaccattagattaatatatttcaaaaataagatggcaggtaagaaaatacatatattcatagggatagcttcattggaaatattatttctaagctaactgcccaaggtcacattaataataagtgccagagtccagatttcaacacaggtgtatcttactccaagtctatgatgttggccactatcacattcttaatatattagaataaattactgggcaaaaagtcgttctgtttaagctcacttaagtatttgattctgatgtaccttgttatttttctgtggagtacctgagtaagtagagaaagtgtagctgattatgtcttctgtattttcaatattgtagaacctaaccaaaatttgtaacattaaaattataaacactcatctagagttgaggaatatgtcttcaggaacatatcttctgccagtgtacagggcctagcacttcgaaagtggtgatgtcagcataggaagaagcaggaaagagaggagagtcatgggagtgcctggaatcaggagagggagtagagacccagagtgttacagacaggaggggaggatatttggtcagtgaccaaaatattgaggtcacacatgtcattacataccacacataaaatgccagggagactgttcacatagaattaaatgttgtttgcctgtcagggtgtccaaacagttaaagtctcacttttaacgaacattattatagtgccctcttctatataataaagtcatttttgtgtcatagcagcaaatttctatataatagaagtatttgtaaatttctgatctgttatggcaagtctgttagcgaggatgtatttacagtacattatgtattttaaataattttttttttttgagacgggagtctcactctgttgcccaggctatagtgcagtggcacaatcttggctcactgcatcctccttctcctgggttcaagtgatccttgcacctcagcttgctgagtagctaggattataggtatgcaccaccacacccagctaattttttgtatttttagtagagatggagtttcaccatgttggccaggctggtcttgaactcctgacctcaaatgatccacctgcctcagcctcccaaagtactgggattataggcctgagccatcacgcctggccagtatttaaaataattttaagtagacaaatataagtaaaaatactggcttcaagaaaacacattaaaatgtttagacccattattttggggtagttaatttttatttttattttattttttttttgcgggggagacggagtctcgctctgttgcgaggctggagtgcagtggcaccatctcagctcactgcaacctctgcctcctgggttcaagcgattctcctgcctcagcctcctgagtagctgggattacaggcacgcaccaccatgcccagctaatttttttgtatttttagtagagacggggtttcaccatgttggccaggatgatctccatctcctgacctcgtgtcccacccaccttggcctctcaaagtgctgggattacaggcgtgagccaccgcgcctggccatgaaattattatcttaatggttttctcccacctaccccatattcctctaataaatttgtgttttctactatcaaaaaaaaaatccatcagaagtttttctgtgattatttttgttggttttgttttattttgttggtgtgtttttgtgttattaagtactggaatacacaaaattgcttgatttctggttcagtgcattggtacattgtcttggaaccagaggtttcttggtgaacaggctggtgaatatagcagaagtctatggtaagactccattatgacttaagaaagtatattcaggttttagaagtgattctcatttagagatggataccccgtgaagttaatgaaatgtaagctttagatgcttcacttccaagacccatacttagttttatacaggcatacccccattttattgtgtgccactttatcgtgctccacagatactacattgtttacaagtcgcaggtttatggtaaccctgcctctagtaagtctcagtgccattttcccaacagcgcgtgttgacttcatgtctctgtttcacattttggtaattcttgcaatatttcaaactttttcactgttattctgtctgttacggtgatctgtgatcagtgatccaaatttgaggttattgtaattgttttggggtgccacaaaccatgcccatataagatgccaaacttaattgataaatgtgtgtgttctgactgttccaccaagcagctgttccctggtctccctccctctcattgggcctctctattctctgagaaccaacaatagtgaaatagcccaattaatagccctgcaatagactcttaagtgttcaactgaagagtcgcacatctcttactttaaatcaaaagctagaaatgattaaacttaatgaggaaggcatattgaaagtcgagataggctgcaagctaggcctcttgcaacagttagccaagtcatgagtgcaaaggaaaagttcttgaaagaaataaagtgctgttacagagaacacatgaatgataagaaagtgaaacaaccttattgctgttacaaagaaagttttagtgatctggagagactgtcagccgcaacattcccttaagccaaagcctaatccagagcaaagctttctcttcaattctgtaaaagctgagagctatcaggaacctgcagaagaaaagaagctagcagagtttggcttatgagatttaaggaaggaagccatctccataacataaaaatgcaaggtgaaacagcaagtattgatgtacaagctcagcaatttatccagaagacatagccaagataattgatgaaggtggctacactgaacaatacgaaattcagtttagctaaaacagacttctgtaggaagaagatgtcatctaggactttcatagctagagagaagtcaatgtctggcttcaaaggacaggctgactcttgttaggaattaatgcagcttgtggctttacgttgaagccagtactcatttaccatttgaaaaaatcctaggcccttaagagttacagtaactcggttgggcatggtggctcacacctgtaatcccagcactttgggaggctgaggcaggcagatcacctgaggtcaggagttcgagaccagcctggccaacatggagaaactctgtctctattaaaaatacaaaattagccagctgtggtggcacatgcctgtaatcccagctacttgggaggctgaggcaggagaatcgcttgaacctgggaggtggaggttgcggtgagctgagattgtgcagttgcactccagcctgggcaacaagggcgaaactccatctcaaaaaaaaaaaagaattatggtaactctactctgcctgtattttataagcagaacaacaaagtctggatggcaacacatctgtttacaggatgtcactgaaaattttaagcccactgttgagatctactgctcagaaaagtaatacttctttcaaaatattactgctcattgacaatgcacctaagtcacccaaaatctctgatggagatgtacaaggagattgatgatattttcacgtctgctaacacagcatccattctgtagcccatggataaaggagtaattttgactttcaagtctgatcatttaagaaacacatttcataaggccatagctgccacagatagttattcctctgatgaatctgggcaaaatagattgaaaaccttctgaaaaggattcaccattctagatgccattaagaacgtatgtgattcatgggaggaggtcaaaataccatcattcacaggagtttggaagaagcagattccagccctcatagatgacttttagaggttccagaaatcagtgaaggaaataactacagatgtggtgaaaagagcaagagaactactagaattagaagtggagactgaattgctgcaatcgcatgataaatttgattggatgaggtgttgtatctcatgggtaagcaaaaaaaaatggtttcttgaaatggaatctactcatggtgaagatgttaagaacattgttgaaaaaacaagaaaatatttacaatattacatacactaaggtgatagggcagaggcagggtttgagaggattcactccagttttgaaaggaattctactgtgggtaaaatgttaccaaacagcatcattatgctatggagaaccatcttttgtgaaaggaggagttagtgtggcaaactttattgatgtctcactttaagaaattgccacagccattccagccttcagcagccaccaccctgctcagtcagcagcttatccacatcgaggtaagaccctccaactatcaacaagaatatgactcatgaaggtgaagatgattgttagcatttttggcaataaagcatttttaaattatggtatgtattttttttagacacgtactgttgcacacttaacagactacagtataatgtaaacataatgtatatgcactggaagaccaaaaaaatagtgtgacttgctttattttgatatttgttttattatgtggtctcaaattgaacctgcactttttccaaggtatgcctgtattctgtttcttagaggaactccacatatttgtataagattggctccaccttattctcactgtgtgtgactatgctggtcataaatgtgttcatacccactatgtgtctataagacaaaacctattctgacttgtcttttcccatgctttttcatctttctactctaggctaagagtagaggtagatcttggagaagagggacctgacaaaattttaatgtagttgtctttttctttgacaaaggaaggaaagcccatctcaagaggtcctttctttttctgtgttttgctttctccatcatttcttaagaggtcaaagtgttcctgcaaccctctgcctgtccaaaatctcccattgccaccctgagtctccaagacctgctttaccctcataattctcaaattccaaatttgtgtcccacattctcattcacttcaaaaattctgttctttggctgggcatggtggcgcatgtgcctgtaatcccagctctttgggaggccaagacaggaggatcacttgagcccaggaggtcgaggctgcagtgagctatcatggtgccactacacttcagcctgggcaacagagcaagaccctgcctcaaataaataataataataataataataataattctatttttaaaatatttactgttaggaaagcagtctgcctaagccatatgattatgccacgaggatcatgttgcatttctgctaattatcacctttgttttcttctaggctcgtttggcttcttctcacctcctccttctcacttcagctttttgggtgttgaaaatttctaaactttgctctttttccttatcttatttagataatgacaccatttgttgtgttatatggatacagttgtctatttttttcttattttcacacagcccagcatgttttgggagtccctggcagacagttttgtttacttctagatattaaaactgacatcggataagactatcactgggttgctaggtgtatatgattaaacatcatctacccccaagatcagaagaggaaaaatagcgacagattcttaccttttataaaggaagggtagtggaagcacagctccttctttttactccgtatctcatagactgaaccttgcaaaggaaatttttttattatgtaaagatagttgtaattgttatttaccacttatggtaaatcaggcttaccatttatgcctgattactgttcagggtaacagtagtagctctttaacaacaccctaagccattgaaatcaatacctggagggagagaaaatatagtattgagatactggggtggggtggctgattagtgacagaacaccaaggcaactgcagttttcttctagtaaaattatgtcctactgtgtttataatcaagtaaaagtgaaagtatattttgtaagctatgtttactttcagcatattatctgtttacataggttctgttaaatattatttactgggttatcaacacaacatttaaaaaccagaattgcatgtacttgtactatcaatgtttgtactgtcttggaggttaatagataaaaagcattttaacagtttaaagaacatcattatcgtttgtatttttattttaacagaaggggacgaactggtagtacctgaaacatcagataatagtcggaaacaaatggttagaaacattaacaataagcggcgttattccttcagagtcccagaagaggaaaggatgcagcagaggaggtagatacttaacctgtagtatcatccatgcttgcttgtaccatcaaggactactcggtgatgatactatatttgatttggaaggaaaattgggtatctgaaaatctcattgatctgtggtgtcaaaaactgcaataatgaatgtaacttctcagtgtcattttaattaatattctcaaaattgtgagtatgcactggattaaagtaccatatttttattcacttcattcacttctctatgtatatggaatagtcatatttttggattgtgtacctttctacagtataagcataggacatagctgtgcatacagtaaacctgtatatgtctaagaagttcagactaactactctcttcatgagcaaacagaagtaggactgtagtatttacagttatatataagaccgtttctaaagtgttaccaatcatttttaaagagatacataaaatgttcagaattatatgtaaaacaaagtagagcttctttgatgtcttaagtatttaaaaagatcctctactattccacctaaaatcgtaagatcttttaaaatttaaaacaaaatattctaaggaagtacatttttaattgagtatattctgttactctatattcttattaatgtgatttaacagttgtatttttattaagaaaattaagcttaatttttttcataagctacataaattaactgtggaaaaagtatctaaacagatgccttgtcttacagggaaatgctacgagatccagaaatgagaaataaattaatttctaatccaactaattttaatcacatagcacacatgggtcctggagatggaatacagatcctgaaagatctgcccatggtaagaggaattaagagtgagtgtaaaaaagggcgggtgtggggggagtataaatacataggcttaaatacatgggtagacttcaaaggatatgtgaaagtaatgaggaaatgtttctctcagtataccacaatatgtctaagatacatgatgacatacctgatgaacaaaacataaaatttagacatctgtcaaaagccaaacaaatcaggttcttacttagttccatattggagaatttctcccatgcctaggtttactattggtggtggaagaaactaccaaattcggagaggttctataccacatttggaatgtggttaccaaatcactaaaatttcactacgtgttagcaaatcaatacagatatttggcctactctttttttttccttcttcccagagaaccacattagcttggttattaatggtcacatctctccgacagttgtgaaattaaatcgttttcctttgcccatttacaaacatgttacctggtcagttgtacgtgaaaaagtataacataggccaggtgtagtggctcatgcctgtaatcccagcactttgtgaggccaaggcatgaggattgctgaggccaggagttcaagaccagcccaggcaacataagcaagaccccatttcttttttttctttttttgagatggagtctcattctatcacccaggctggagtgcaatggtgtgatctcggctcactgcaacctttgcctcccaggttcaagtgattctcctgcttcagcctcctgagtagctgggattacaggcacccaccaccatgcccagctaattttgtatttttagtagagatggggtttcaccatgttggtcaggctggtctcgaaccctgaccttgcggtccacccaccttggcctctgaaagtgctgggattacaggcgtgagccaccaagactgaccaagaccccatttctataaaaacattgctggtcatggtaatgtgtgcctgtagtcctggttactcgggaggctaaggtgggagggttacttgagcccaggagtttgaggctgcggggagctatgattgccgttgcattgggcaactgagcaagaccctatctcaaaaaaagaaaaaaaagtacaacattggagaactattctgttttaacaatatgaagattaggctctcagaccggtcatgtttaaattaagaatattagtggaattagccaggctctgtacatttcagtaccatagttctctcagcatactattaaaactttaaaaatgacccttttgattggtagtgatagctgctaaattttgcgcagaattttaagtataattcatatttcatggccatttgggagatgatttgtgaatcttgacccaaattgctctctaaggaaatctgtcttaattaaccacattatcaacactacagtgatagaagatataaacatctatcactgacagagaaattgattgataatataattcggtgtgcagtcaagtttctttaaattaaaaaaaacgccttttaaagggaggtttgcatttatttcatgggaagaaaacatatctgcattcaagtctgagttcttcattgtaaatatctcagttcatcagttggctctgcttgcttatgaatgaatgtgacattcttattaccattaccaataatatcaaaatattattatatattcatagtaatatacttttctttgtggagttcaaaccagcctcattaatcacttatgtttttggaatagggttggctgtgctgagtaaatatttaaaaagtgcaaaaactagattacagcttatcttgatatagtacttttaaaaattttcaggtcaagcacattaaatattaaaactattatacttttctatcatgtttaaaagctatactatttttttttcaacctttttctgggagtgagatctcagatttctctccatccttttcccattaggaacatttgcttaaagtcctgagtctggttttcctttaacctcagaagtaaacatagcataactatagagtccaaagcatgttgtttttccttatggaaggtgggatgtcaggcacaaaataccgtaaagaattttttaaattgtgataaacaattgaaatgtgaatatatttatgacttatatttgataagtcaagtgctgtgtagtattttaattaaactttttaaattgagttagtagttttttcaatacataatatgtagttagaattatgtaggggtagcaggatacaaatttcaaatatgtaagttgcaaagcaaaacatcagcaaatataaaattatttcagtagttacaaggttttaatagatagtcttttaaaatttaaattttttacacttttgtttcattttacacagaaaagaatgtttttatctcatacattccaacaatgtagctagaagtagtatagaaaatgtttgtagacattctattctagcccgcatactacagtgtttaacagaatgttactctgcttagtatccttctgccatcaggtgaaaaatcagtttgctaatgttccagagttctttcagaccttcatatccaataagactatgcaccttgatgccaaaatgtcagatttcaaacattataagaactttttttatcagagatccctcctctacattttcttccctcttccttccaccactttaagaaaaaaaaagagataaaaagaaaaaatctgtatcttattttttgttcaaaataaggtctatattgataagcaaaacaagtgaagatagcattttccacagaatcattagactgcttggtttttagtgtttgttgtcacctgattttgttaacacatgataatcgttctttttggcattaacacaagtgactttttgccctctcattgcatttcagtttttaatgtacctttcattgctttaatgttttcttatcacgtaagtgcttttgtatttccaggacaagaagttggtgtaaatttttgaaacctgtttcttcacctgtacatgtagtatgcatcaaagattttatctgtctgaattcctcttcttcacaaccagattttattgtcacatgacttttttctatttcactaccaaaggacatataacctggggcttttttataggcatccatttaatcatctaacaaatatttattgagcacttactttgtgcccggaaccatctttatctcagagtagacactagtaaatacaataatatgcatgtctgaaaataataataatatgcatgcctgtacttgtgtatgtatctattgaaaagcttgtgatattttaatgtattctcagttgttaatatgttctttccattgaaatggaattattacaaactgtctcataaaataaagatgaattaaatttatctaaagttaacatatatgtttttaaataccaaagccacatgttgtcatctattcagagagcatgtgtcccagacatttttatattttaatttattcaaatcagtattgctttcctgtgaaatacttataagcttagaaagtttattgtatgtctttagaaatttaattctgttgcttttgtgcaagatgttcttgaaacagaattgtttgctttttgaatgtggaaggagaagtgaggctaagggagtcatattcctctatcagatgcaaacctttatttgtatctaagtgagccaagacaatataagcattaatataagatggtgtgtgtggcttataaatagatgctatattcattttcttgaatttttaaaataatttaccgttttaatacatggttgctatttgtgataaagaacaaatttttctctaatttggatgcaagaataatactttacctctagaagacttatttttagcacattacatttctcctagctttttatccattactaaaattgttaataaaagtatattttcgagcttagtgacatcctggagctttaagatgtaattttgcttcttaaagtcaaagtttcatgtacgtcagtacaacctcagagggtactgattttattcatatatctagaataaaaacaagaccttacagaagagcctttcttctaaggctaggtaatttatgcaatctttttacaaagcaggttcatctcagctcatgggaacgtgaattccatgctggattcagttagcactctctccaacacgccattcaccctctgcctctaatgaagggatcatgttttctggaaacataactgttcttcaagaactgaatcttgaaaattcccattagagaaggtgactggctactgagtgatagttcctgcgtaatcggaagtagttcttttatctctaaaaatagtccttggattcaaaagcttttttctatatctttgatattacattatttcatttttaaaaaatatacctgaacattgaagggaagatttttaccttgttaagaaaacaaacatgttctttttgggtgtctaaatggagataagcttgggctgcttaaaggtaaaccaataattagtatattccatggttaactgttataaggaaataaaatcagtaaaaacaaacacattatcagggaatgcttttacatggttttagatttctaaagaaacagtttcataacacgtctatttagaagctgttgtaggttcacttgttcatgttcttgcttgtttcttgctttttctatccttaatgtttttgatagatttttgccatattttgattgtgttattacataagaaaatactgaactaaactctgaaagtcttgtatctctgaaagtccaatttctccttacttattttaattaaagaataattttataaaaaagaatgatcttttgcaaatcaactatttaagtaactggcaagagtattacaaaatttaactttctaagacctaaaagtatttcattaaggattcagctctgatatcagatactattccatttgttctgtgtgcatgttttgtgaaatgtgaatccattttcatcaccttattgccttttttcatctttcttttgtttttgatagccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgagggtatgaacagctgagtcaggtgttaactttcactaaccatgtatggatttccttttgcctggcttaataagtaacaccgctgaaatggtgccatcttgtgaaccttttcctttggcctatttctcttctgccaaacttctcctcttcctcttcctccatgtatcttcctcttctttcccatttctattttgtttcttcttttgaggaagaagatggaggaatagggaagatttcaattttcatttttgaaacacagtattaaagatttatctatgtttaataaaagtttttcccattgtaagaaatagctctctattctgttaaaacaaacaggaaagggctcccagaatttctgaattttttagctccttaccctataaccagttcaattcagtgaaatgttttatatttagtgaggttaaagtctgtggtagaacccatccacagacctatctacaataaacccctttttgaaaagcttaaaaatctccaaagtgaaaagttaaaaaattaatattaatgagtaacaaaaattccaaaaataagttagattttactaatctttgagttactgaaatgcatgtaattccaaccaggatccaaggtaagaaaactaaagcaaagaaagaggaaaatttaaaaagcatgctgtattctgaaggattgtggcagctgctgttggtctcttccattcagcttgtatttttgctaccagtggctttgcagtagggtggagagctggtggccattaaagctgaatattcatatgtccatcaagtggtgtatgcttacagtaacttcaagggaacattttctgaagttagttttgcaggtaataaaatgtttatattgtatcatgcaaaccacttcccataatgtcccctaacttacaacaatagtagatcaatttttgtatttatatatgtagaaattttccaattagaaaattagctgtaggatgggaagtttattttttgttgtttgtattataaaattattctaaattataatgttttaaatgttactgacatttaaattattatatcacttaaatatcttatctgacaaaattaaattaaccacgataaaataagcctgagtttgcttagactgcagggagtggattccagaggaattttgtatatgttaatcaggaacttttcactgggcatgatggctcatacatgtaatcccagcactttgggaggctgaggcaggaggaccacttgagcctaggagtttgagacaagcctgggcaaccatagcgagaccccatttctacaaaaaataaaaataaaaaaattagttggatgtggtggcacatgcctgtggtcccagctacttgggaggctgaggggagaagatcacttgcgcctgggaggtcgaagttgcagagagccgtgattgcaccactgcactccagcttaggtgatagagaaaggctatgtctcaaaataataataataataacttttcatataaaagaccatggaaatgttgctttagttagtcatctataactagaaatactgtgccatcaaatgaaagtctcaccctaatcttatacatatttgtaccttgaaaggaccagaggcttaggttacttgtcactttataatgaagtttatttaactctagcggactgaatgataaactgttttttaacaaaacttttttttgtcattcctttattacttcagcctaagtaataaagctactaagttgttactaagtttcagatacagtttgtagccttaatttttgctatttattctaggataggtttgttttataggaaaggacaacatcaatgtatcttaaggtttacagaaaaacaataaaaaaatgtatagcctgaaacggatattcccatctcctttgagcttttctttgctgcattgttcacatgctgcttgcgtcttacagggttgctcttgtatatgtgtctgttgaattgctagcattgactatttccattttaatttttttattttcttagagaaaaaaaaagcatttgctttaaataacgcaccaagaattacatggactttgcaaatttggtagatgaaccaaattgatgtagatggcatgtagatggcagcagttaaatttggggccaactagttgccaactttcagtatgtgcgattcttcaaaatgtatgctttggagcttttcaagtggtattaatgcatgttttcctgagtgctggctttggcccttttttagttgttttgccataaccttttctcaggcatttcaggtgcatgtaggaaagctcagtgctgcaaactttctctgagctctaacctctccttggagtgagtttcacaattgcatggcaactgggaactcagtttccagttctagacttttattataacttaaaaatattttttagccacattagtacatttctttattgcttgtttcttttaacctcaaaagccttaagtatttgtgctgatttcattgtattctgtgttaaattatttaatctataccatattatagcaaagaagatagtcatcttttaagtgtttgcataaaatgttattttgtatctttaaaacacacacaggcctgtaacttcaaatcaatattaactaaacactgttttacagaaaggatcatattttgaaattacattgccaactgaattaatctcaatactcaaattagaaaattaggattgcagatataatctattcattttccatttatttattcagcaaatatctttcagcacctaactattttaggtgctggagagtttagtgttgttgtaataacagtcagtataagaaattataagatgactaaagaactgaggctagggaaccatatgcctgcttataaccaggacaaactgaactgtcagcccaaaagctgaggaccctgaggtggtgagtgtggaggagggtgtgcctaccaacagtgttcccctgggtttctatgtttaaagggcaagtatgaggacgtttagtaaaatatgtaaaatgtagtttaagcatttaggccttttctcttgctgaaacttgtaaaaccatttaggtaagatagatttctattaacgttaaatagcataagtcatgaataaacataagtcataccacaaagtttatcaatgtatggcaggtatgtggataaatttccctattgtattctctatgttaagctactagaagaaagagtaatattttctgagcccgaaatgatgagaaaagattgtgtttttgaaacagcaaaattaggcagacagttgtaacatttttttaaaaatacactagttagcttggtgttctgttgcatttgaaaatagcatgatacagtatcatcaactcttaaattatgttggaagaaaagataggaaacacatcaaattgttattagtatctggtgaattcacaggtgacttttttggtctcttataatttcattatatattctacagttcatgagtattacctttataatcagaaaaaaagcaaacaattttaatgaactagttagcactgagagaacaccaggttaataaatatatcttccagtcacatcttgttatgtcttagtggctattactatctgtgtgattttctgatgatgtagaaaagataaaggattaccctatagtaatggtagcctatagcattctatgaagagaacatctgttttcaaaggaaagttgcatgttatagtttaacttggaattaaactatttggctttacttaacaaattgatcctttggaaaagtcacaaaacttgaattttttactgcttttaatgtgtgattttttttcattgcatttccattatagagttaaggtattgtttaacacatgtaaaatttgtgatccccccaccaccaagcagaattgctggggggttgttgttgttgttgttgttgttgttgttgttgttgttgttgagacggagtctcactctgcagagtgagtgcacgcccaggccggagtgcagtggcgtgatcttggctcctccagcaacctccacctcccagattcaagtgattctcctgcctcagactcccgagtagctgggactacaggcatgtgccaccaaacccagctaatttttttgtatttatagtagagacggggtttcaccatattagccaggctggtctcgaattcctgacctcgtgatctgcccacctcagtctcccaaagtgctgggattacaggcctgagccaccgtgcctggccagaatggctgtttcgatgtgactaaaaggaggtttgaaagtgatactgcagatggctgtatgaggttgttactcatactcatgaggaaagaaaggcacatagtgggactgggctacatgcttgctttttgctagtgtaattagcttcatcctcagacaagccccaggaggcagttcttatcctcataatacagctgagggaactggggcacagagtttagcaaccccaagccctgctgtcagtcagctgtgcagcacagatgtgagtagtgggccaaatccctccatagcctgtgctcacagccaccatgctgcctttatggcacaccctcacaaacagccaatgaaggagaggctggctgacaataggctagtaagattaccatcatttttgtagctatgaaagaaaaatcaataaggagtagataaatcttctaagtaaatacatataaatctgtttataaattgtaagaaatcaaatccagaccatttgcatcagaagatgcttacatgaggctgggattatgtgaagaaatggagaaaagccttatgagtgttaaaagatgttaataacatggtatatgtaatttgtcttctccaggatttataaagaatattaaaatatttttccctcctctggacttgtgtcagccccaacatctcatcctcctggtctgaaaaagattggggcctttggggaggcagcatgctttctgttctcaaccgtaatcagacagctcaccctgcacaccacctatgtggctatcctttaggcgtgtgtgatttgcaaaacattctgtggcctattttcctacctcacacactaaaatcattcaataattaaatggaaatatcaataaggagtaggtaaatcttccaagtaaatgtatataaacctgtttataaactctttgaaatcaaatccagaccatttacatcagaaattagttttcaaactaatattcccaaattaactaacttcacctaggttgtgagtattgcagcgtcttatttctaatcccagtactactattggtgtgagtcagtaaagatgcctggtgactggggtgtgaacttataaatggcacatttggtatcacatcaataaaacattttcttgagaagaatataattttagtagaattttctccaaatggacgtatcagctgttaagcaaataaaaatgtcatacatagtaaaagctttcagttatcggcaaatgtccatgtaattctacaattcactgtcacatctaaccatatagcttttacttactgtgtttacaaacaaaaaaatgctgttttttactgataagtatttcagtaagtataagtacttattcctgattaggatgagatttacttcatgttagggttttattacttttgtgggtgggaaagactatataatctgccattccttactctgtgtcattctggtcaagatgattttatttcttggtaattatagtgaaaaatagacatctctgcagaaaaatcagtttctttctggctaaaggatgtctctctcgcttttgtttatagaaccctcggcctcaggaaagtcggacagtattcagtggctcagtcagtattccatctatcaccaaatcccgccctgagccaggccgctccatgagtgctagcagtggcttgtcagcaagtaagtgccggggctacaggaaggtgcctctgagacagggtgacccccagctccctcccctcctgtcccgtgggtgacatgtccttcacttacgtgtgcccattgcattctcaagtggctgcagtgtctcagaccctgctgggtaatgcctaataggcacaaatgcagttgttaagaaaatagtcccagagtccttctagagtgtacaggccatctgggagacagacaaatatgattacaaattgtgatgataaaggctctgaaggaagtaaacagcatacattaatagagaataacaaggggtagctgttagggatgaatccctacttggcagaataattaggaaaatcactccctagaggtggagtcatgtttgagtaatgtttggttaactgaaagaaggctagtatggctacatggtagtggtgaggaagtaacaaaaattagagcggggtagcaggtaagggtcagaccagcagggacttgaagaccaaggtaagacattttttactttattcaaaaggaaaaggaagacttttaagtagggaagaattttctttcaatttacattcttaaaacaatcctgcgggctgccaagtggagaatggactagaggcaggaagagtggaagccagcatccagataggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagcaaaaaaaaaaaaaaaatgtatctgtttgattcactgaaagaaggccaggaatggattcaagaatataccctttactacaataaagataacattcatgcagtacacatgtttgaggttccattagataccaactcttctgctgaggtgctgggggtaaaaatacatacatgacctagtacctgctttcaggtgtctcacagtctttattagtctctctctccgttttttttgtttgtttgttttttgtttttaactgtactcggaactgcagcatctctttttttacactttaaaactagaaccttgagctaagggaccatagagagaaaaaactgtgctccatggtgcacttaggttcagctactgtcgcggagcagctttttggtgggggaggaaaggtgtgtaaaaagatattgtctgcctgaataaaattatacaaagatgctaaaggctacttacctcaaaatgagagaaatgtacagatgggacatctggctgatttaaaaaagtaaattttactcccgtcaaattcactgcgatctaagatatttcctggattataagcagtgcgattgtagattatcaagtgatcattgtagcttcacttggggaagaatgttcttggctgaaggttgcttttctgtaactttctcaagtgtgtgctttcccgggagcatggtacttgcttggagatcagagagagtgtcgatcgagtgtgccagcgtaagtgcagtccccaagtgtaccaggtgcaacttagtgaaaccttttttcacctccatgcaaatgaactttaagagaaagtaactgcactaaatccaatttcacatttaaaagtcattgagtcagaaaacttacttgttcccttctattctcgaatgttacatattttgaattcaagtcttctgatgcagattgagtttcctccattcatttgctcttcattcagcaaatactgattttggcacccaatttgtgcccaggtattttttttttagattctgacgacataaagatgaatgatgctgtattagttatctcttgctgcataagaaattatcccacaaattaggagctttaaaatagcaaacatttattatctcatagcttaaaatagcaaacatttattatctcacactgcctcagggtcaggaatctgggaacatcatagactggatggctctggttcagggtttctcatcagattgcagttgagctgtctgctggggccacagtcacctcaagactcagctgtgactagggaatcagtttcctggctcacccatgtggttgtggacacgtctgagttcctcactgactgttggttggaggcttcccgtttttgccaatgtgggcctctccatacccagtgcctgagtgtccttatggcctggctgcaggcttcctccagggcaagtgatcagagagacagaagcagcagtgttctacctaacctcaggagtgctgtatcaccacttcttcagtatgctgttgatcacacagaccagccctggtactgtgtgggaagggactacatacgagtgaatactagaagggacgatcatcttggagcctggctacagacatagagcatgctttcaaggagctttcaattgacaagaagatgttgaaatgtacagtttgcaactttcttgccattatctcctaacatcatctgtacccagtatgtagccctgaccacaatgaaaaaatcttgccaagtgggaaaatgacaaccacttttattaatctttttattagcgatagctagatttgatgattgatgtaagctgttactaactataagttatctagaagtcagttacaaaggttttacaactttaggaattaagtgatggtccataattccttacctgaaacccttgaggccagaatgtttttatgttttagaaagggatctaccatatattatgttatattcccagcaagatccatgacaaacaaacacattaagttcccacgaacacattaatacttacacagcaaaagttatgactgtttacactgtaaatataggaataaatgtagtctttataaataaagcctaaaatcggcctccaggatttttttgggttttgttgttgttttgttttttgttttggttttgcgtttttgttttttgttttttgtttttgttttttttgagacagagtctcactctgttggccaagctcgagtgcagtggcacgatcttggctcactgaaacctctgcctcccaggttcaagcaattctcctgcctcagcctcccgagtagctgggactacaggtgggtgccatcacacccagccaatttctgtatttttagtagagacggggtttcaccatgttggccaggctgctcttgaactcccgacctcaggtaatctgcccgcctcagcctcccaaagtgctgggattacaggcgtgacccaccgcgcccagcccagttcacattaggttttgtcatcacatgaatttgcatcaagcttgtgaaaaaacttttggttttcagcacttttggatttgtggaattgcagataaagataggccctaaactgcaaagatttaaagagccaagacagcccatctccttagaagtgctgaagtgaggctcccatatcactgctgatggcatgcaaacgacagactggagctggcctggcgttcttgtcaaggcccttaacgcattcattgagtttggccttttttatgtccctggttaccagctgcttgtccagtaaagatataagaggaaagaccctctcgggaatgccaaggggcatctggtgtttagagtgcctcctgctggcttcaagactagcccagctcatataaaatgtttccagaaggacagccagccaagagaggaacaggccaactatgttcagtctctacagcaagaagcacaggatcttccacagccagactcaacgatttcatgatgcaaagtcagattgaaacagcggtgctcaccatgcttccttccctccttcctagttcacctgaggaatgagacccgctcctgtcagcagtaggggctcactgggagcctcccagaccctcctggaagtcatgcagaggttggatattgctcatccccaagagatttagggcccagtccccagagtcaccacttaaaactctctggaaggggctgtatcctgagtacagtatgtggtctcaggccagagggtccccaggctccttttgctgttcaatcaaaacagccctgccttgatttttttttttttttaaaggttgtagtgtttgaatgtaacctttctttgaaaagaaaaattcctgaagtttaaaagtgaaaaaaacatactggaaatcactggggtgggattcagttcagttatctgctctataaatgatcactaggaaggagggaggcagtgaaaagaccagaagcacagtgtgggccagcacacaccttctgtcttgcatgttactctccatgcattgagtggtgagttgttcccacaaagtcctgtaaggtagaatttatttttttacctaaaggtgaagaaaatggaaactcaggaaggtaaaataacttgcttaaggtcacaccattagtaagcagagcagtggaagtctctggcagtttgactttctgtgcagaataacaaaatgttaaagtaattttttcattattttttgaactgagcactaaactagacaaggaattggaagaaaactcaaaaaatattttatggcgttcaattagctcgtaatctaaggagacacacgttccacatcaaaaaagtaaagagtatatttcccaagaaatatgtcaacaaatgaagaccagtgcatgtggagaaacccagtggtggggatggagtgttaggggaaacgtgtctcctgaggagtgaggttgtcagtgattctcagtccgaggggccttctggaatcatcaggagagcttattattattattattattattattattattattattattatactttaagttctgggatacatgtgtagaacatgcaggtttgttacataggtatacatgtgccatggtagtttgctgcacccatcaacccgtcatctacattaggtatttctcttaatgctatccctcccctaaccccccaccccccaacaggccccagtgtgtgatattcccctccctgtgtctgggtattctcattgttcaactcccacttatgaatgagaacatgcggtgtttggttttctgttcctgtgttagtttgctgagaatgattgtttccagcttcatccatgtccctgtaaaggacatgaactcatccttttttatggttgcatagtattccatggtgtatatgtgccacattttctttatccagtctatcattgatgggtatttgggttggttccaaatctttgctatggtgaatagtgctgcaataaacatacgtgtgcatgtgtctttatagtagaatgatttataatcctttgagtatatacccaataatgggattgctgggtcaaatggtatttctggttctagatccttgaggaatcgccacactgtcttccacaatggttgaactaacttatactcccaccaacagtgtaaaagcattcctaggctgggcgcggtggctcaggcctataatcccagcactttgggaggctgaggtgggtggatcacgaggtcaggagatcgagaccatccttgctaagatggtgaaaacctgtctctactaaaaattcaaaaaattagctgggcatggtggcgggcgcctgtagtcccagccactcgagaggctgaggcaggagaatggcgtgaatctgggaggcagagcttgcagtgagctgagatcacgccactgcactccagcctgggcaacagaacaaggctgtgtctcaaaaaaaaaaaaaaagtgttcctatttctccacatcctctccagaatctgttgtttcctgattttttaatgatcaccattctaactggcatgagatgctatctcattgtggttttgatttgcatttctctaatgaccagtgatgatgagcttttttttgtatgtttcttggccgcataaatgtcttcttttgagaagtgtctgttcatattcttcacccactttttgatggggttggttttttttcttgtaaatttgtttaagttccttgtagattctggatattagccctttgtcagatggatagatggcaaaacttttctcccattctgtaggttgcctgttctctctgatggtagtttcttttgctgtgcagaagctctttagtttaattagatcccatttgccaattttggcttttgttgccattgcttttggtgttgtagtcatgaagtccttgcccatgcctgtgtcctcgatggtattgcctaggttttcttctaggatttttatggttttagatcttatgtttaaatctttaatccatcttgagttaatttttgcataaggtgtaaggaaggggtccaatttcagttttctgcatatggctagccagttttcccaacaccatttattaaatagggaatcctttccccgttgcttgtttttgtcaggtttgtcaaagatcagatggttgtagatacgtggcattacttctgaggcctctattgtgttccattggtctatatctctgttttggtaccagtaccttgttgttttggttactgtagccttgtagtatagtttgaaatcaggtagtatcatgcctccagctttgttctttttgcttaggattgtcttggctatacaggctattttttggttccatatgaaatttaaagtagttttttctaattctgtgaagaaaatcattggtagcttgatggggataacattaaatctataaattactttgggcattatggccattttcatgatattgattcttcctatccataagcatggaatgtttttccatttgtttgtgtcctctcttgtttccttgaccagtggtttgtagttttccttgaagaggtccttcacatcccttgtaagttggattcctaggtattttattctgtttgtagcaattgtaatgggagttcactcatgatttggctctctattattggtgtgtaggaatgcttgtgatttttgcacactggttcaagcggacctaatacacacctacagaactctccaccccaaatccacggaatatacattcttctcagcaccacatcacacttattctaaaactgaccacataattggaagtaaaacactcctcaccaaatgcaaaggaatggaaattataagtctctcagaccacagtgcaatcaaattagaactcaggattaagaaactcactcaaaaccgcacaactacttggaaactgaacaacctgctcttgaatgactactgggtaaataacgaaatgaaggcagaaataaataagttctttaagaccaatgagaacaaagacacaacataccagaatctcttgagacacagctaaagcaatgtttagagggaaatttatagcactaaatgcccacaggagaaagcgggaaagatctaaaatcgacaccctaacatcacaattaaaagaactagagaagcaagagcaaacacattcaaaagctagcataagacaagaaataactaagatcagagcagaactgaaggagatagagacacgaaaaacccttcaaaaaatcagtgattccaggagctggttttttgaaaagattaacaaaataggccgctagccagactaataagaaaagagagaagaatcaaatagacataataaaaaaatgataaaggggagatcaccactgatcccacagaaatagaaactaccatcaaagaatactataaacacctctacagaaataaaatagaaaatctagaagaaatggataaattcctggacacatacaccttcccaagtctaaaccaggaagaagttgaatccctgaatataccaataacaagttctgaaattgaggcagtaattaatagcctaccagctaaaaaaaggcaggaccaggcagattcacagccgaattctaccagaggtacaaagaggagctgataccattccttctgaaactattccaaacaatagaaaaagagggactcctccctaactcattttatgaggccagcatcatcctgataccaaaacctagcaaagacacagcaaaaaaagaaaatttcaagccaatatccctgatgaacattgatgcgaaaatcctcaattaaatactagcaaacattccagcagcacatcaaaaagcttatccaccacgatcaagtcggcttcatccctgagatgcaagactggttccacatacgcaagtcaataaacgtaatccatcacataaacagaaccagtgacaaaaaccacatgattatctcaatagatgcagaaaaggcctttgataaaattcaacacctttatactaaaaactcaataaactaggtattgatggaacgtatctcaaaataatagctatttatgacaaacccacagccaatatcataccgaatgggcaaaagctggaagcattccctttgaaaactgcaaccagacaaggatgccctctctcaccactcctattcaacatagtattggaagttctggccagggcaaccagacaagagaaggaaataaagggtattcagataggaagagaggaagtcaaattgtctctgtctgcaggtgacatgattgtattagaaaaccccttcatctcagtccaaaatctccttaagctgacaagcaacttcagcaaagtctcaggttacaaaatcaatgtgcaaaaatgacaggaggacttttaaagttaagtcagaaactctgcaaattgttctgggatagggctgggcattggtgtttgtcaagctccatcatacgctaaacagtaaaccaccagtgttgctgatctgcagtcagtcagttccagtgtcgaggaaatgccagcgagcctgtgactgcagcccaggggcttcgcaaagaagctgaggaagggaggtggaagggggattaccaaggacagagtctgcccaggcaggctcttgttcagtttatttatgaacgcttgtgtattttggtggtcattagataaatgtgctgctttaaactatcattttttgacatttttcactgaattcttaatgtgaaaaacaattgagacatgttaaacccgcaaaaagttgaaacaagcacaacctgtaccttagagttgtgctaaaacctcaacacagtcttttggaccaatcatcctaatactgaaactcagcacgatgaaggcatgtttaagcaaaaaccttgtcatagtagggaatgctaagagctttaaataggtactgacaatagccccgagattccccagggtgttctgggtcttcccttttcttcctgtgaatgctgctggtccactgttacctaccccaactctgagaacaaaatagagagtgagtttgaagaaaacctcacttttattttacatctcaggctctttgccctgtgaagtaaaagtacttttatgttttctttatggttttatgaaaattttctagaagataagcgatatttcttcattgagtggcatggcctctctcgggatggtacaaccgagcttcctcatttagcgcatctgttttgagcctgccgtgtgccatgttctgtgctaggccctggagaggcaaagacacctcatctattgggagaatgacaggcacatgatgataacatgacttcataaatgccatgaaagagatgtgtgaaagatggctgggagccgtcagtggctgggaaagatgtgcaaggcagcaccaggcaggtggagacttgagggattctggggaattgttaacaagcagggcattggggcagatggcacagcctagagagtgctcgctcaccgggagtccccgtggctggggtggacaggaacagcgagtgagattgctggattcggggttgagctcagggcaaaggtactacagttggacttactgcgcttcaggggaggagtggtctggggcctgcaaaggatggcctgtcagctcagcagtctgtgtgctttctagagtattgtcccctctgcatatgtaaaattttgcctgcatgatgtactgtagggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggtgagtgggcagggttccggagacgtcatgtatcagaaagactagggcatcttcccaggcaatcccaccaccttgggattggcctcagctgcagcagggttcggggtcaggggccagcattcactcttggccagcgggcagctaggccagtcactcgggctgcaaactgcagttttcccagaggcattcagacttctggcttttgtgtgaaaataccatcatctgtaaaggcctacagaaaggacggagcttgtatgttccgtgcctcttcctcagctcatagaaggggctttataccgacagtgaggccgccccatggggttatttggtcagggtggctggagggggcggtggtaatctgagccccttctgcctccctttctccccctccttctcattaatgttttactttgggccttacaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaa

SEQ ID NO: 38012 - DNA, 564 bp, Homo sapiens
cattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctc

SEQ ID NO: 38013 - DNA, 131939 bp, Homo sapiens
cgctgctcttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggtgagggcggagctggctcgcctgggaaaaggcgggggaaagatggtttgaggtggctggtggggcgggcacgttgcctacgggttcaccgttccgaactttcacagggcacgcctctccttagtctgtgccgtatctgcccaagtgttatgcctttggtttcttctgtccttcattccttctgtccctctgagtgtgcccccgaaacagtcgagtgaaggtgtaggaccggcccttgcagggaggcactctcttggctttgcatacattgggtgggaaaaggagttgcaggatccagaatccggacctttcttgacaaagtgtcggagtgggccaccttcaggcttgctgtccaaccctcatttctcccctcttctccctgcatccccagcttcctctctcccgcagtgggaggaagggagatagtgacagtccctctgagagattcatctggcagtggtgcagagaggagtcttgcctgtgaaatgtcccaagcctgactaaggaatgctggagttttggaaagggagttgttcgattgtcttctgctccgttcctgtttgccaagttactactgtttacgtgtctaggaaaaggaaataattttttaaaaacagtttttagatgctagacgtttttcccttttactttattttgttattacttcctttgttttgttcttaccttcctcttgagccctttgatttcaaaaagtttacactttatacttcctgcagatcctttggccactcttaggatttctgtcccccgcccctaccctgttttctcctaaagtataaaattcatctaactacattattatttgataaggaaaagccggaagagatccagaacttcgcataaacttttgctttcatactttcacctgtaagggtgtgttcatgtttgccatttaattaacttaattggcatagaaatgtgcaccagaaatggttaccttaagtcagccgtctgttaaggcttcaggaattggccttttcttttttctttttttttttttttttttgagacagagtctcactctgtcgcccaggctggagtgcattggcacgatctcggctcaccgcaacgtccacctcccaggctcaagcttttctcctgtctcagccttctgagtagctgggtttacaggtaggcgccactaccgcctagctaatttttgtatttttagtagagacggggtttcaccgtgttggccaggctggtctcaaactcctgacctcaaatgatcctccctcctcggcctcccaaagtgttgggattacaggcgtgagccaccgcgcccggccgaattggccatttcattgctgttctctcagagcggctacagattactatattttactgctgccttaattctgcttttctttcgtttgtcctgtggtgttttttgttttgttttccttgcttagcatgacccacgtcttctcccaactaccaagtctaacacacttttatctgagaaaagagaaaagatttctaatgtattttgtggattaaatccctgcctcagttactttagtttctttccaaattgataaactggttttccttggattatgatttgccttaatcctggatgatgacttggggttcatggcctaagggtcaacaactttcaggggtcttcctcattcccacccctgaaattatatgcagttttgtttgagtgaatttttttcccccctggggaaagtgtccattgtttttatcaaattctcaaaggagatatacagcctcttgatagattaaaaccaccacttaggcagtgtcttgttgaagttagtgaaaacaggttttgtgtgtgtatgtgtgtgtgtgttttccacttaggcagtatcttgttgaagttagtgaaaacaggtgtgtatgtgtgtgtgctttcccaaactgtgcaaaggagatatatagcttcttgatagattaaaaccaccacttaggcagtgtcttgttgaagttagtgaaaacaggtaggggtgtgtgtgtgtgtgtgtgtgtgtgtgtgtgtgtgttttcccaaactgtaaattgtttgctttgggaccaaggaaaggagaatgcagggattcttctagtttgatattgaaatctctcctttaaaacattagtgtttctaaattccttcctagacttacagaaggaaatgaggctgcccactttatttcctgatttgtggttttgaggtttcttcttagggatagctgtttgtggtccatgctctggagatccagtggatttacaaactgatgtgcctatctttaatatgtattaaatatcaccaaccaactaggcacagttcagagtaaaaaatttaaattctagttgtattttgctttcattttcttaattttttttgcttgaggcatgtaccttaggatttgatttggctttgctatgaaaaacaaacaagatgtttcagtggtgtggtcctttggaatgttgttgcttatcttgacatcccctttccctccattctgtatgagatattttaatgattgtttctctcttgtgaatacgttagtatccttccaagcttaatgtaagttttagagtacatatttgaacttactgatttggttgtgaattatttgttgattgagggttgcagttctaaaggtctgatacttttttttttagaatgttaacttgaagagacctatacagctcatcatagtctatcatgagtatccagtttcttctgctcacagaataagttttcctctgtctagcaacctcacttgggggagcagtcaacataagtttatagagaatagcgtatgctaggctgggcacggtgcctcacacctgtaatcccaacactttgggaggctgtggcgggtggatcacttgatgtcaggagttcaaaacctggccaacatggtgaaaccccatctctcctaaaaataaaaaaattagccgggtgtgtgttgcatgcctgtagtcccagctacttgggaggggctgaggcaggagaatcgcttgaacccaggaggcggaggctgcagtaagccaagatcccaccacttcactccagcctggccaacagagtgagactccatctcaaaaacaacatcaacaacagactagcttatgctaaattagtttccttttaaggtaatgacaaattcggaagatattttatatctaacactgtaacagttacatttatttgcttaccatgtgcattaagctaagtgctttacattattatctcaaatgataaccttataaagtggctaaagtcctcatttctgtaggtgaagaaaataaagctgaatgattaactgaagctaaagtagtctgctcagaattgcgctggtggagccagtgcatggctccacctacgttgtctgactctagactactactgtagacaacttctaccatgcgtccattatgtcctttttgaaatgagttggagatatatcacctgactttctatcaggtgttgagaaaaggttgtttcctttcttaatcttcagtggatgaacatctggttgaatatcatactgagaagtttgacaaaaaagtgaatttggtggaggcagttggtaggggtttcctatggggatggatataagtctctggtgtgtgtgtgtgtgtgtgttagaacacacacacctacttgaaataaagaattgtaagtattataaattcttgaaatgaagattcaaataataagcagatggtgtgtgtgtatatgaggaggggaaaatgtgaaaatgaagattataagtaataaactgggcattgtaagagtctggaagtataaataaattttagaataatacatttgggatggaaagaataaattcagaatggaagaaggagtaaattaaacaggaaactttaatatggttatggatgaaaaactaaaatatttgtacagaatggaaagtgagttgttccacttaatatggaagttgatgacttaggatcatgacaatctaaaagtcagatatgtagcactacttctggatgtatgaaaaagactattggcctgaaaataattttgttttccttgatctttagtagcttttggcagtcatggaagctgccgaatggctcttgcagattaacagatattctttatgagacaaaagtatttattttctttttctttttcctttattcctattctcctctttctcccatctctcattccattctcctccattccttctaagcctttgtcttaggatgggcataggcaggtgttgctcaaacctttagttgttcctgaaaaaggaatataaagtctctttatgaaatacacttttttcccttaatgaacatacttatttaagtgaatgctgtttttcagagtaggcaatctgctttgaaatcttcttctagtatgactgtcggttcagattgagacatacaaaaatgaagttcttgcctggcttcgtcacttcgtgacctcagtcaccagaatctgaataactttgggtatttggaaaaaatcagatcctctcttgaaagacaaagatttggggatctgaaggtagttgcaaaacaggcaattgctcaaatcttttgtgaaaatatggcagtgtctttaccatgttctcacctaagataagaatttatattttatttttgtatatctgtgatagcattggactagcagctccttgatgttgaagcttgagcctcattggtccctggggaacagtgacatactgcctttggaacaggatcataaaagcagcagagttagtggtaagccctaaatcttccagaggagggagtcagttcgccaactccagtttctgctagcctgagatactcatcatggcacacataaaaaatgattataattgtatggcagactagagccaggccctccttggttccttggaagctgtggagtgggggaatgggtcacaatttcagcacatctgtaatccattcttggcacactgtttggaaatctttgccctagagaaaaggaatatgttactctgtttaataccttctgtttgtttagcatgtaataatttacaaagcactttcacatacatcctcattttatttttactccagccataccaaataggtagagcagataacatcaccacattagaaataaagaaattgagatttaggtaaagtgctttgtccagggtcacatacctaaaaagggatggatcaggaatttataccctcagtggaaagagcccctgggtttaagcccgtgatctgtaatctctaaaatggccaggaccttatctgttttgtttcagtgctatatattgcccagggtggtcttgaactcctgggctcaagcgatcttcccgccttggcctcccaaagtgctgggataacaggcatgaaccactgcatccagcataagtattataaattcttgaaataaagattcaagtaataagcagaaaatggaaaggatgttttttctattcctctaatctctccacccaccacacctctctcccagttaatttgaaaagtaggtattggggaatcagatgaaatatatgagaaagctgtaaacctgcactgtctaatgccagggatgctagccacatgtagctatttaagttagttaaaattaaatacaataaaagattcagttcctcattgtaccagccacatttcagtgtcagtatcatatgtggctggtggctactttattggacagtgcaaatttagaacatttccaacaacattggccagccctgataaaactttaaaatgcgacatgatatgatgtgatacataattcctatattgttgaaccacgagtttaaaaatctgctacccatggtgcctagcagtttttgttttagctgatgaaatgttattgccatgttctctctcagctttttgttttaactaaatccagatggtcaaagtctaagtctaacatttttcttggatatttggggattatagttagctgcttttctaggataaagatgtcagcttcattaagggcatgagtgttttctgtctgctttgagctgtagatctgtatgtcttgctgtcttgttgacatcctttcttgaatatcttaaaggtatctcaaatccagtatgtctaaaatgaaactgatttccccttccctccctacaaaactgcacaacgttggttctttctttgttccttttttcagtgaatgacacaattatcttttcattgtaaaatccagaaaactagaagtgatccttaattccctctccctgatagatccaatgattgaacaagtttttaaagtcttactttctacatgactcttgaatttttctatttcttcctgtttccactactgccacttcatcttgcctgaaacttttacaatagcctccattcttatctgtcctctctaattcattacccatcttgaaggcacagtgatttattttgaaacacacattggattatcactctccttcttcctcccccagtgcttttatggctttccattgcttctaggatcaaaataaaactgcttaacagcctttagctctccagactcatcttgtaccatgttctgcataactctccagttcaaccatgctggccttctttagtcctttgtatgcaccttgctccctgccatttttgcaaggcttttgtacatgcttttctctctgtctggaccattctttctttactttcatttcatttcacttgttagttcctagtcatccttcacacctcagctgaagttttgcatccttagagaatatgctcacttcccacattaaggtaatagcatcatacatttcccgcagtttgcaatttacatttattcatgtgactgtaagattttctttctgttcagtggcctataaacttcatgaaggtaaggtccatatcttgttttcttttttggctcatttttgaatccctagaacctagctcagtacctgacacctaaatttgactcattaaatttccaagttaatggtattaaggatttcagttcatcgagttttgtaatacaagaatttgaatatgaatttttataaaaatagtgttaaaatggtagtacagtttgaacattcctaatccaaaaacttgaaatccaaaatgctgcaaaattcaaaacttttttgagcccaacatgatgctacaagtacataattctacacccaactttatgtgatgaatcaaagtcagaatgcaggtgtacaacagtttctccaagagaaaaaagacctgcctagcccccttcagctgccatatatcttttcctcacacagccagatgcacctacgcaagcatgcccgcaaagggcaatacaatgccatgtgtatgtgtaagaaatgattggttatacgtagcatataaattcagagacgggaatgatagtgatgtcaaacaaccacagactgtccacatgagtggctgagatagtgacacctttgcttttggatggtacagtgtatacaaactttgtttcatgcaaaaaattattaaaagtattatataaaattaccttcaagctatgtgtataaggtgtatatgaaatgtaaatgaattttgtgtttacacttgggtcccttcctgaagatacctcattatgcatatggaaatattccaaatgccaaaaaaatctgaaatccaaaacatttctagtctcaaacattttggaaaagggataatcaacctgtaattaaattttcagtttgactatttctttcaagtgtatggaaataaattattaggccgggcacagtggctcacgcctgtaatcccagcactttgggtggccgaggtgggtggatcacttgaggttgggagttcaagaccagcctggccaacatggtgaaaccctgtctctactaaaaaatatacatatacagattagctgggcgtggtgacctgcacctgtaattccagctacttgggaggttgaggtggaagatcgtttgaacctgggaggcagaggttgcagtgagccgagatcgtgcctctgcactccagcctgggcgacagcaagactccgtctcaaaacaaaaaatgtgttattagtagctatataaaatatagcaatatagcacagtattcttacactattttgtaatagacccttttatttttggatggttttagttttacagaattactgtgaagatagaatagagcttcccatacccactttcccctattataagataggctgtgcacagtggctcatgccagtaatcctagcactttgggaggtcaaggcaggtggattgcttcagctcaggagttcaagaccagcctgggcaacatggtgaaaccccatctctaccaaaaatacaaaaaattagctgggcatggtggtgcccatctgtgatctcagctacttgggaggctgaggtgggaggattacttgagcccaggaggcggaggttgcagtgagcagagattatgccacggtactccatcctggatgacagagcgagactccatctcaaaaaaacaaaaacaaaaacatactacattagcatagtacatttgtcacaattaaccaatattggcacgtaattattaaagtccatattttattcagattacctcacttttccccaatgtcttttttttttttttttttttctgttcaaggatcccatctaggatagcatattacctttagtggtcatgtatcctttcattttgacagtttctcagatttccttgtttttgatgacaagttgatagttttgaagattactgcctggtcaggtattttgtagactgtccctcagttgggacttgtctgctgtttttctcattagactgggtgatatgtttctaggaggaagatcacagaagtaaagtgccattcccatcacatcatatcaagaatacagacttttttttttttttttttttttttttttgaggtagagtctcactctgttgcccaggctggagtgcagtaacgcaatctcggctcactgcaacctccacctcctgggttcaagcgattttcctgtctcagcctcccaagtagctgggtctacaggtacatgccaccatgcccggctaatttttgtatttttagtagagagaggtttcaccatgttggccaggctggtcttgaactcctgacctcaggtgatccacacacctcagcctcccaaagtgttgggattacaggcgtgagccactgtacctggccaagaatacaaactattaatatgacagtaccattgatattaaccttgactacttggcttgagataatgttcatcagttttgtccactgtaaagttactctgttttccccctccttttgtatattgtactttttagaagaaagtctctctgtgaagcacacaattgggaattggggaattatgctttacctctttaagggtgaagtgtctacataaatttttgaaaaatcttctataagagttttttgtctattctcccctttcagtcgtttatttatatcagtctgactcatggatatttattttatacttaagggtaaatccagtagtactttattactttgttgctcaaattgtttcagctgtggccactgggagctcttttagttggttcctgtattcctttgacatactcctgtcattgtgagacttttgttcttgttttgtttgtttgtttgtttttgagcacttttaactttctggtattacaaaatgctctaggctcaccttgtgtattacctaccacaggcctagaatcagccttttctccaaggagcactgattccttctattggagaatagtattagaaaccaatatctgggcactatgtttgctcattgctgttggaatgtcattgcttctaggccctcccagtggacagagtaaggaaatatatgtgtgtacactaactcatgtatatacacatatctataaatatttctatatgtaactatatatatgttaagctatattttcagtttatttcctgtgagcatttttcattaaaaaaattacctgtgaatattgaaggggtttattttacatggttttgggaatttagtaacaaaaagtaactctccaattatccattgctaagggacaaaagcagttcagataataccaaataacaggtaacctgtttgatctttgaatgaaatcaattacaacaacagagatgaccacctctcttggttcttggttggcttcactgctaatgttctggaactgagccatctatgaagaatgaggccacagcatactgaataatttagagttaatttacagctagttttcttttcagagagtaatttagttttgagagtcttatcattttacttctcattggtttctctgtaacacagtctgagtggggaaatttaaaaagacttctgcagacagtcagttttgttacctaagagttggttatggtggtagagataggcatagttgaaaatctgttaggttaacttttaaattgtttcttattatgcatataattcagaagtaactattttgtcagggctttctatttttgaattatctagactgatgtgtttatctttttttttttttttttttttttgaggcagaatctcaatctgttgcccaggctggagtgtagtgtcacagtctcggcttactgcaacctctgcctcccaggttaagcgatcctcctacctcagcttcctgagtcactgggaccccaggtgcgtgccaccatgcctggctcatttttgtatttttttttttatagagacgaggttttgccaggttgcccaggctgatcttgaactcctgggcttaagtgatccactggccttggcctcccaaagtgctgggattacaggcttgagccaccatgcctggcccgatgtgtttatcttaataagcaacctgaacttaatttatcaatatgtaaaagaacttgtaggtatttagcaaaatagcttttacagataccagatagttgttaatataaagacagaagaataatgtaagttattctgtattatcttctttggttattctatttataaaaataaatgtaatatactttgaacatattgtgtggtaagccatttccatttcttttgcattggacagtaaggaaaatgattcgtttttcttcttgttaggagaactgtcatcagaaaacaaaatcattttaaattgttttgactgaaaagcttctatattttggatattttcaactctgaacatatagttttaaaatggagtcatgtatggtaactcaattttttattgtaaacaagtcagttcaacttgaaaattaatattcagttacgaaatcaaaacaagtcttttccaggttttaagcaatgtcatcttggtataagctctgttttctgaatataaacctattttcattgtaatttctaaaaatccagtaggtttctggattttgtaaagacgtaaatacagatataattttgcaaatttcttagtattttattttgaggtgagaattttgttatagtttataaaagatattttcctcttcagacctcagggctattttgggacctacaaataagtatgaccaccagctgcttcaattcttgctattcaaaaggttaatagtctttaagttaaatataatgtgatattattcaacagaaagaatatgtttttcctttttaacctcgaacaaattctgtatctgatgtttaaaaagtatttttaaaagttgtggtaatataaaaatatgtggaaattgtggctgaagcattaaaaataacttgcaaaataaatatattctaatggtaaagaaaaaactgatcttaccattctgttcctgtttatccatgaatgagaaaagatgggcatattccagtagatttcatcaaaagtgaaagaaatagagccacttaaaaaaatctttagaataataactgatctctggaatatcaagtctaaagaaactaagcaaaatcactttaaaacaagcccaagttttgctactttttgctctcagtgttttctatttacctccttttattgtccttgactcaccagtcagaagttcttgatgctgtatatcattatttatagtacttttcaaacttttttttactaaagtacctttagaaagagtaataaccctttagacatttctttgaagactcatattttatcataaaaattcagtaaatttctttgaagacttatgtgtgttgttttattcaagtgaattttgctttagattctatatttagtgaaaaataatgtaaattcatattccagtatgatgtgccatgtttatcttgtctgctatggttgtatctgccctcctgtgtcttgggcataccacttcagaccacctgttatatgagtacctgaatttgaaaagctcccattatgatttatgttcaacaacactcctgccacagatcctttatcattagacttctgaatctttaaactcagtgttgtcatggagactctgaaggggttttagggatcctggcaaatctaatacctcctgccctctctttcctgggtgctaagaagaccttaaatgcatttaagagtggtagagtataaaactctccctcactaaaatttgggaaatgatcttacaaggttttcctctgtatagatttggtctattcagtatgtatatataaaaatgtgatttttatagtaaaatcaaagcagctacaaagagttggatggattttaaacttgaggtgacaaattctaattaataattcactttgtaggtctttggttcttacactcttttgttagcaaatacctctggctgatttacagtagaacccccagagatgacttaatgacattttggcctccaatataactggtttgtgagggctgaacatcagtggtggttttgtaatagtaatttatcactctgttttaaagacagctttcaaagataactgaattcatacaaaaattagaaaatgtataacctaaacagcataaattatataggtcattaacttcttaagtcttgttactcccatgtattttgttatcaaagttataaacaagaagacctttaagaaataaatatgaagtggatcagagcacttaaagaatgagccgagatagcaccatcgtactccagcctgggcaacaagagcgaaactccgtctcaaaaaaaaaaaaatgatatatatatatataatatatatataatatttagtacctatctctgtaattctcagaaatttgatttatgtttctctatctgccttgagttatttggtcttttccagagctgaatgataatgatgtacagtggtcttcccatagtcttgggggagatgttccaagacccacatacctgaaactgtggatagtcccaaactccatatgtactaagttttctcctatacatacatacctatgataaagtttaatttgtaaattagacacaataagagattaacaacagtaataataaaatagaacaattataacaacatattttcttagtctgtttgagttgctataaaggaatatctgaggcggagtaatttataaagaagagaggtttattttcagaccatggttgacagctgataaactgtgggaagctaaaacatggataaggtgggggacctactatattttcctcattggtgctgttttatacaggcggtcaaatgataactcctatttcacaagaaagtaagacagcaaaaacgaactgcctgaaccttccatttttccatgttactcttcactatctctacaggttccttcttcctttattctggcctcactggaagagattttcttcttttatttaaagggtaattcctctacctttgttcagaatttcttactgtttttaaaaaacttttcatctaattttagacttgcggaagagctgcaaaaatagtagagttcccttacattcctcaccccatttcccctaatgctaacatcttacataaccataatataattattacaagtaggaaatgaacattgatataatattattgattaaactatagctcttattagaatgaaaccaaattttcaactactgtctgttttcagtcccagggtcctatataggaactcacattgaatttagcaatttctccgtagtctcttttaaagtttctaacattttgcttgtcttttatgactatgacacttttgaagaatactaatcagttatttttagaatatctcgcagtttaggtttgtctgatgttttctcatgattggactgagcctatgcatttttggcaagaataccacaaaaatgatgttgtgtctttcttagtgcattgtattgaggggtttatgatatatgtcttactacttatgattacttgatcacttggttgagtgtgttgtttttacactgtgaagttactatctttccctttttagttggtaagtatcttgttggagctacgtggagactgtgtaaatcctgtttctcctcaaactattgctctctaattttagcatctctcaagtggatcttgtctgcagtatttgtgatatttgcctgatgttgattgtttcccactttgcttcctatgttaatttacttatcgtctattgtgaagaagagttgtcgcttttcctccatttacttatcagattgtttatatcaatatggactcattaatattttactccttgtttttgatctagtactatcatttattttgttgctgtattcgttccagcattggctgttatgggctccttcaggttggctcctgtgttctttcaacaaacccccatctgtttttgaagttttctttattttctgacaccatgtcagcatgtggaaattactatggttctgagagtcagaattattacaaaatatatcgtgtatccagagaagtgtcactccatccttagccttgctactctgttcccaagccctttcactcttctttccacccctttctcacctgcccagggtaggtaacctatctctttagtttctggtttatccttccggtgtttttgtttgtttgtttgtttgtttgtttgtttttgctttttcagtagaaatgtgtattttcttatatcccccttcattcttacatgaacataacataccatagggatttttttgcttttttcagactttgcttttttcagttaacactgtgtcctggaaatcacttcatattatagagattttcctcattctttatttccccccacagttgcataacttggatgtaccatagtttattcagtcactttcctatgtgccatattcctaccatagaaaggtaattgaatatggcacatccaagtttccaatattttacaattacaaagaatgctagagtgtgtatttgtctttgtatatttggaggtatattcccagggtggattccttgaagtggaattgctggggccaaagttaagtgtatatgtcattttgttacacattaccaacactctctctagaatggttgtaccaatttgtattcccatcagcaatgcatgtaagtgcctgtttcccttacatcctcactaatggaatgttttgtcatattttaaaatttttgcgagtctaatagatgagaaatggtatttcagtgttgttttaattggcatttctctaattttgagtgaatttgagcgattgttacttgagggcccttgtaattttttttttttttttttttttttttttttttggtgaattgactgtcttttttcctgtatctgatttttggtcctttttccctttgttttgtttttttccgccccattttaatgtttacaagttaataatctcttgatgattgcagacaggtatagctgtttggtagtactcagaaacattacagtaatggtagttttttcagttggtgtgtagtgctcaataattatatataaaattgctgtcaaaccagtaagactgcatttatgcatccatcattttcaggattgttgataacctgggcatatttccccaaataactttgcctccctgtgtcacaaggcccacttcactcacatttacctcagtgacagtctttagtaataacacccaaagttgtatacagcgggaatgacggattcttctttacaccaagtattggtaggcaaaaggtggctttcagttcaggttgtgttacatggactttcttgaaatgcaagcccattggcctgatgaatctttcatatttaggtggttttcttgtaaagacatctctagcaaagcagacttcagtaaccatcctcttccatgccttcttctttctctttcctgtttgaataacttaatgcttctgtttctccctgggcacatactttaggcagagggacttcccattttccctcattctcttttcgtttctgtttaatcatattggaaagtactttagctcgagattgtctctctgtcctgctgataggcaggtactgctccctgtggaatcttttcatcattcttttgtttggtgtttctcttttcatgcatcttgatggtcttttttatttgtattttctcagcatggcgctgtttatgattaagcttagccttcagaccaatcattttctttgccttctttgaacattcttgagcttctcgactttccttctttctctttctctcatggtaatccaaatggtatagcatttatggtgtaattcaatatattcattctgtggcacagtgacggctgcagagcacccagaagcagcccttggggtgcaaaaatgctctcctttacctttgtttttaagaattctttatatattagccttttatggtgtatgttgcgaatatttcatcttagtttgctttgcatgtactatgtgtgttgtccaattaaaaaattttatgtagtcaatattttcttttattgtttctggattctcctttccctataccaactttgagcagaattcatccatttttttctagtactttctctggtttcatattttatatctagattcctaatccatttggagtttattctggaatatgatgtgagatagagatcgaattttatattttccagatggatacctagttttcctggcaccatttattgaaaagtccatctgtactttagtgatttgagatgccacctttgttatttactaaatttctgggtatatttgggtctaattctagactttttaaattccactggcctatttatgtgctagtcccacactgctttaattatagatgttttttggtgttgtagtgtttgatagaggtggtctccttgtggttttcctttttcaatgatttcctacctattcttgcgtgtttgattttccacacaacttgaatatcaacttgccaaactttacaaaatagcttgttagtattttcattgtattgtatcgaatttataaagtaagggagaaatgacatctttataatgttgtcatcctgtcttagaatggggatatctttctctttgctcaagtgttcttcagtgtctttcagtggtgctgaaattttccttgtgtagtttttacacattgtttagtttattcctaactatttagtctttttattgctattataaatgggattttctctgccattattttccctgattattgtttttgtataggagaacatttttgtatgttaattatcttgctacttcattgaattttatttttgagttaattttattattgattcttcaagggtttttaggctaccattatatcatctgcaaatagagatagttttactttctccttacctattattcctctgattgatttttcttaactagttgatttggctaataccgctggtatgatgttgaataatagtagaaatggccgggcgcggtggctcatgcctgtaatcctagcactttgggaggctgaggcgggtggatcacctgaagtcaggagttcaagaccagcctggccaacatggcgaaactctgtctctacaaaaaattagctgggcattgtggcaggcacctgtaattccagctactctgggtggttggggcaggtgctgaggcaggagaatcgcttgaacccgggaggcggaggttacagtgagccaagatcgcgccactgcactccagcctgggcgacagagcgagacaccgtctcaaaaaacaagaatagtggtagaaatggtgggcatctttgcctttttcctgatcttagtggaaatgcctctgttatttctttattaaataatttaatggttgtaggactaaaatgtatatattttatcatgttgagaaattacgtcctaattcttgtttctttgagtgttgggtttcgaatgggtgttgaattttgtcacatacactccatcttagtggtatggagaaaattgtatgtttcctacctgccttagatttatgaatacggtatgtactaatagatttcctaattgaaccaatcctttacctctaggataaatgccatttggccatgttgtattattttcttaatgtattacattctgttagcaaacagtaaaatcattccctccagtgtatttctagagtaaaaatttgtttctttgcattattgtagctaaaatggtgtctggtacttatttgtgtgtatatttatctctgtgattagattcagagtgcttttagagctggaactagagtttactttttattacccttagtgcctagcagaattcttcatatgtagttggtaacatctaaattttactgaacaaaaatagaaacagaaatagcacattaaacttttcttgaatgaaatttgagtataatgtttcacttagcaaacagtcacatcagtcctaaagagcactaaccaccacatgaaggtcagggagatctgagttctggtctggaactttgttttacataggtcacaaaaactaacattttggcatcagacatcacagttttttcatttgtcaaatcagttgacgctctgatcttttaaaatctgtttcatatctaaatgatcttatgaaattaatttttacttattgcagtgtgcatttttacattttgccaaataatttttctgaatttttatttgtctttagaatggtttgcctgttgtaatgaatagatatacatatgattatggataattttgaaaagcaaattctgaatacaaataaattagttattattttccccattttttagttgaacaaatttaaccttcagagaaatggcgactgatttagaggaattggtaaggctggagcacaatatggggttttctgtctccagttacagtgtttctgtgccaatctgccatctgtttatgtgacacagtactaggcacagtgtttcttcaactaagccaagctactgtgattcagtgtgataagttttaatgtaggatttagagctggattatttatgtttagtccaaaaatcaaagacaaattctttgcacaatatgtattccttgcgggggattcagggttccttgtgatttaaaatagcttgagtgtttcacatttggcaaagcagtgttgtagttacaggtaatcctgagaagctagagaattatgtatacggtacgtatcttagttcatggatttgattttttaagatcagatctctgaatctatcctgttgagagatgatcagaggaagattgtgcatgtgtgttctaggaaagattgacagcctagccaatgatgggattcataaaaataaatgaaagtattctgtttgtggtttactgttgtgagttttgtctttgtaattgtcactctgatagatgctaaactagaaatttcctgctcaatagggagttaagtctggatgacggtgatctgaaggaaactactgccaagcaattgattgttcatacttgtctggaaattaacattgaaatccatgttatgcattccttgtgtttttagctatacccaaatatgcagcattcatggggaacattcttattaaatttaaaaaaagaacaggtacgtgagtataagctgaatttatcctccaatttaaaagcattatatgagtttacagttaacaaaagtacagtttaggaatattttatgactttaaaattccctactcattagtattctactaatttaaacctgcatgtttaaaacttatgggtcagatttgttaccagaagaacagtagcctaataggcaacattcattgagggcctattaagtgtcaggcgttgtattaggttttacatatatcatctcgtttaatgctacaataaccctgttgatgtttttctcccattttatagattaggcaactaaaacttggaaaggtcaacatagcttttaaggagcagagctatgatttgagcctcaatgaaagaaaagatgagtaaatttaggaaactgtatagaaaaaaactatttaaaagtagaagcaagaaattggggaaacaagcaaattaggtatatttttataacagtgacaacaaaaaaagcaaagaaattgcattagatatttattagtttatcctgagattgtagtcttaattcttctgtctgtccttcaatatagtaacactagaacatatacctatttctaatatttaaggaaaatatacagatatttgcactcttcttttgtgtaactcagacatctaaaaagtgaaacgagtacagatcctgcatccaaggtcgtattgtttaatagaggaaatttaaatgaaataaaatgcagaataataattcctttagcgtggtacaagtcaagcattgtggcagttcagaggagtagcagccaggaatatcagtgaaggtgccatttattctgaagtcttatagcgtgggtacaatttgaactacttgaacaaaagcacagataaagaacattgagaaatacgtatggagaagagtaagtttgatttcatagggtatctgaagaaacatgattggtagaaagaaaacaggtcagaccataggaaggattttgagtgtcaagctgaggagtcggcttttacattgtagacacatcggggagggagacagaccatgttaaagatatacgtaagttattttataatgtaatgtaaactagtgtttactgctgtaaagcataaggggctagagtgatcaagagtgctaattgacatagattggtcaatggtagcccttctgaggagttgatgtttgagcagaaacctaaatgaggtgaggaagagaatcgtgaaaatccaggagtaagaattttccagacagagcaaagagcaagagcaaaaatattagtaagattggtgtgtttgagaaacagtggagagggctctgtgggtagaactgcctgtcaggaaagatggaaaggaatgtggttcaagatgtagctagcagctaggatggctttccctagagtaaatgaatttctgtatcatctgtgttcagtaattatccggatttcaccatatttgccttattcattcatttataataataggtttgagaattaccttcctactgaggccatgaaattgccaagatagatagaagaaagaaagaaacacaaggctgcagacagtaacgtttataatcatatttcaaatctgtcttgattgtggtctgttttagaaaagtacatttagggtacccatagtgacaaagttacaaagagtagctgtgctggtaaatactagtattattggaactacttcaacatttgttctgttagtcttgagctgaaatcagtgtgctataattttacatttgattttcacaacagctgtgttatatataggtgaggttaaaaatctcattttataaatgaggaaacaaagttatacaagtaaagtgagatgcaaaggataaaaagagacagagctggaccttaagtccatgtctcttaatatgttggttagttctgcaatttcattaagtaggcttattcacctaatagttttgaaccatgttgaattaccacattgtaataaatacattaaccacttttcaaaggccatatttttactaatacagaaggaaattccaaaaactatttgaattatgaatttaatagaattactttcttttttcgtaggcaaaaatctgaataatttcatctgacacagaaggcatttgtgttttttggtattggaacaaaatatgatctctcttgagatgcataattagtccactaagcactgcagccttcattgtctgaagccataactaaaacagttaggattgaattagctttgtgtctttcttttcttctttcactttctttactttcttcattgctttgcctggaattgactgaacttaagaatttgatcctttaaataggaagaaaatataactacttgataacagaacaaaatagctacttgacatatgtagttaataacctgaacattggaaatatttcacagtactttttattgcattttcaaataactttaaaaaaatagtagatttaagaaacagctagaaatactttattataccactttgtttttgtttgctcagtggtaaactggattaaagagcaatgtaaatgtgttttagaaaatataatgtcttacgcagttccacaaatctaaccaaggctaaggcaagttcttttagatcctttctagaaagtttctacattgtttctaagcattttagaaattacgttttactatgaataatgtaatgaatagcaggaaacttatttctggtgtgcctttcttttgcattattaagatagtgttttagtctttggatgactcttattttccatatggtattagcctataaatgctaaattgtcaaatgtaaagctatttatgttagtgtcaaagtgtattttcaggatttgaaaaatgtaagtagcatgagaaaaaaagtacattgacttttaaattttagccctgccttgggcagctacagaaaaggctatacagtaggggttgaattgtcagggaggagaattactgtgtatcctcagggtaaagatgaagttagtggagatttgtccactgtccaaattggccagtatgaagaaaggagggggagactatggtatgagaagcagctagagaagtaggtagaggtcagactgtaagcagttttatgagccacgttatcacgattgtagtactgagaaagtttgctggagtgctgtttggtccaccaaaggacaggagggaagctgttctcccccagtgcagttgaaatgggttacatttatgacattgagtgaaaagacccatagggcctgccaatctaagaggcaatttatagcatcaggcaatttacagaatttctcacccttgacactattgacatatttgggtaattttttattttggggaattgtcttaaacagcattgtacaatgttttccagcatctctggcctctgccttcaaaatgccaggaggacaccattcccagctataacaaccagacattgctaaatggtgggtggtggggaggtggtgtcaaaatccacccccaacatccccagtttgaaaaccactgagctgtcatgatcaatgataacatgtgcatatttttgggcggttgatgccattttcaacaacaggcttgttatcctggcactcctaatttccaggtgtcctagtttaattctgcaactgccaactgctaggagtaggaggttcctggatgcagctgtctctaaggctctgggattagcagaagacagccctaatgatataaatggaggttaatgcatcagtctgcagttgttggaagtgaagggtcagagtaaattaagaggggtgctgctcttaactgctcatgataatatggagataaaagaaacaacagtacaagttgtcaacatcaagaaagcagtgtgtttgattcatataaatgtctgaatgtgtatatatataacatgtattatatatattttatatatataatataacatgtaatatatatattatatataatataacgtaatatatatattatatataatataacatgtaatatatattatatataatataacgtaatatatattatatataatataacatgtattatatattatatataatataacatgtattatatattatatataatataacatgtattatatattatatataatataacatgtattatatattatatataatataacatgtattatatataatatataatataacatgtattatatattatatatataacataacatgtattatatatattatatatatataacataacatgtattatatatattttatatatataatataacatgtattatatattatatataatataacatgtattatatattatatataatataacatgtattatatattatatataatataacatgtattatatatattatatataatatataatatatataatatatattatttatatatatataatatatatatatatatagttgggagggcctgttcatgtatttcagtcactctaggagaggcagtgtaatataaagattaaaaacttaaaccaggttgccaggtttgaatccccacgtcatcacttgctagctgtgtatcattaagcaaatttcctaatctttctgttttcttatgtgtgaagagtattggtgtgaaataggaataataatggtacctaggtcagagatttgttgtgaggttaaatgagataatgcacataaagtgagtagaattaaatcagttaatatgtaaaattaatgtgaaaaacatagactagttcctgatatatggtgagtactcattaaatgctagctcttattgttgtagagcttcatttgcaagtggatacattatttaaattagttaatttccttaacctttttaggctgcagtctcctcatctgtaagattgggaaaatcatatttacttcaccagggtagttgtgaaggctgaatgaaatgatttatgtaatgtgcttagcacagtggctggcatgtagtaaactctcaataaaggccagatttttagtgatgagtgttaggattagagtagggaactatgaaggtatcaaacaaattttatagcattctgacattctaaaaacttgctagaccatttcagagttatcacctgatactcaaaagcattcataaagatattggaagaccatattccatttatctacttcctgattgtaaatctgatgtcaaggtcttatgttgtaagcaaatgaaaccagttccagctcatttacttagaaaagggatttaccaagaggctatgaggtagtgtatagaattgcctggagcattggaaaaccagaatccaggcccacatatctaggaatattgatccaaatcatggttgagcagtggtccaatgacggcatcattgcttaacactggatttggcagtttgcactgccaatacctgtagctctggtgactggatgctgccactatggtcacttctgacctggaaatttgatcttgctgattatttttgccccctagtgagttctttgatatctttcttcgtaaccctagtttctgattctaagtctggggcaagtgggctttgatttggcagagcctagatcatgatggcagtgccctagagcttgggaaagaatagtattaatgtaactgaatatagcactcatatgtcaagcgctcttctaaatactttatgtttttattttgtgccacaacaatgctatgaggtaggtaccattatcatcttacagatgaaggaagagagctttaggaatttgcctaaggttcacagctagtggaggagccatgaattgaacacaaacaatctggcttcagatatttgcttgaatgtctggtattttgagcttttatgtaatacaaggcgggctctgccctttcccaagcctcacaatgtggaggctttccccaactttggttggggcctggggctgggcagccaaaaataaggaaatatacatcatacttggctaaagtcttacttggcaaaccagttatgcctgtattgctattttaaaagatctaaaatgaggaacagaagaattttttttcttcgtgattgcattttatgttctgccactcttcagatatttgcctttctttagatattctctttgaggcagtacttctaattttcagactctggatcaaacacagggaaaataggtttgtaaatgacacttagaactatgcagtcatttttctagtgagagagtattagtgtaatttattttttgtgggcaggacacattttggaaaatgacaaacttcttttgctgctgggttgtggagctgatatagttcctctttgtaggtgggcactgtgatcagggtcacacacacctcccgccaccagactggtatggtatggttgctctctgggtggattgggggcctgcaggaaaaataggtcctctgccattagagatgataaaatgtaatttttacctttttttcaaaatcaacagtttattgaggtaaaatttacatataagtgtactcatttaaaatgtgcagtctaatgagttttgacacatatataaacttggaaaaccacagtcataatcaagatacagaatgtttccatcaccatacagttagtttcttgtgtccctttgcaatcagttcttccctacattacttgtctcccaggcaaccactgatctgtcataacaaattagttttgtatgttctagaattctgtacaactggaatcataatagtatgtattctttttgtgcctgacttttttttttttagctcaacgtaagtttttttttctttttctttctttttttttttagagacaggtctcactctgacacccatgctggaatgcagtggcagaatcatagctcactgtaaccttgaactctcaggctcaagtagtcctcccacctcaacctgctgagtagctaggactaacaggcatgtaccaccacagcaggctaataaaaaaaattatttttagagagcatctcgctatgttgcccagtttggtgttaaacccatgtttcgaaattaatcaagagttgttgcatgcatcagtagttcattccttttgtattgctgaggaatatttcattgtatggatataccacaatttgtttattcattaacctagtgatggactttttttttttttctagttttgggttcttataaggaaagctgctaggagtacatgtctacaagtaaggacgtttattttaatttctttttggtgaatgtttttgtatagaatggctaagtcatatagtcaagtatatatttacctttacaagaaattgctaaacagttgtccaaagtgaagtactttttgcatttcctacattcatgtatgcaagttccagttgcccttcactcacatttggtattatagtcatctttacttgagccgttatagtggttatgtagtggcatcttattgtggttttaatttgcatttccttgatgactaatgatgttgagcatcttttaatgtacttactcgccattcctgtactttcatttgtgaagtgttctgttacgttttggccatttttcatttgtgttttcttgctattgaattgcaagagttatttatatgtctttgctgtcagtcatttgtcacatatagatattgtaactgattttctcctagtctgtggttcacctttttgttttttttttgatggtgtcttttgaaaagaggtttttaattttaatgaggtccagattatcagtatttttcttttcttgtttttgctttttgtgtctaagaaattttgcttacccacggtcatgactccgtactattccaccccaagataaccactgttctgcctatatcatcaacacttactggttttctttttgaattggatcatgtaatatgtactctttggttctggtctcatttgctgaacattatgtctgtgaagttttttccatttttttttttaagacagagtttcgctgttgttgcccaggccggagtgcagtggcacgatcttggctcactgcagcctccgcctcccaggttcaagtgattctcctgcctcagcctcccaagtaaatgggattacaggcatgcgccaccacgcctggctatttttgtatttttagtggagacggagtttctccatgttggtcaggctggtcttgaactcccgacctcaggtgatcttcccaccttggcctcccaaagtgctgggattacaggtgtgagccaccacgcctggcctccattttttttttttttttttttttttttttttttttgtagcagtagtttgttgtgttctattgctgtgtggtagttcattgtatgactccaccacagtttatttgatagacatttggattgtttccaggttttggccattataggtaaagctgctatgaatattcttgtacttgccttttaatggacatgtgtatttatatttcttgggtatatttcctaggagtggaattgctgggttataggatagtcgtatgtttaactcaaatagtactgccaaatagttttccaaagtgatttttaccaacttttacttgtaccagcaatgtataagagtctagttgctctacatactggctactacttggttttgtcagtctttctagtttccgccttctaatgggtgtataatggtatctggtggttttaatctgcatgacaagttgagctgaatgactttgtagctccttcccaatgctaaggttttctgtgtgttttacaaagtggagccgggcgtggtggcttttgcctgtaatcccagcactttgggaggccgaggcatgcagatcatctgaggatgggagttcaagaccaacttgaccaatatggtgaaaccccgtggtgtttcaccacatggtggcatgtgcctgtaatcccagctcctcaggaggctgaggcaggagaatggcttgaacctgggaggcggagattttagtgagcaaagattgcaccactgcattccagcctgggcgacagaggaagacccgtctcaaaaaaaaaataagtggcaagtgttgtagcatgtaaacacaggtccttaaataacagtaggtgttcttgggtttttgtgtaaatacaaaagatatttgtatagctaattttgctgtattaaccttcctctcttatatagggcatgcttatagcactggttctacttggctgcacattagaatcacctggtgagcttttaaaactactttaaatgcatagtggccattcatatgggtcctgacttgtagatgtgtattcatagcagctttacttacgagagcccaaaactaaaaaaagtccatcattaggttaatgactaaagaaattgatatatacatacaatgaaatattcctcagcaatacaaaaggaatgaactactgatgcatgcaacaactcttgattaatttcaaaagattaaaattatgatctccgtggagaggcagaaagctcccctagtagttctgagatgcagagggttgataatcgttggcatgtacaaatggaatattccattgcttctcaagggggcttgctgtaccctttaggaatgaagcaccaactataaaatctttattagatatgtgtcatgttaatttatccccaactttgacccattgacaggattcaagaagctagttcccagccttcacttttttggttgtacaatatactagctctctaggtaagttctatgctcatatttttaattttgcattactcttcatgttacaatgctaattctgcttttaaagtacattctacatacaactcaagaaaatcacctattacaaatgcactctttctgttagcactggagcagtagtcatggtcatgtaagagtatttgctcagctttgatcttctcctttaacatgattgtggatttagaatgtacttgaacttaacaaggaacaacactaaaaaaggcacatgatttgattgttgctttgtaaaataaaaaaatgaataaaatgttcagttttttgtttatgaatataatagtgaatctcaccttctgttggtatgcaggtttggtacatgacgatgcctttagatcatctccaaaaaagtaacatcataattggaatgtgacatccatatatattggatttttaaagattgtttccaaagattcagctgtacagagtgtgtgcctaatacttttctaacttggaaataattcagtggtggctaaagctggcttgtactgcctgcaaaagctgattggtaaattttcaagaatttgtaagccaactgttaaacacagccattattttaaaaattatgtaaagttattattaaatacatatattaaaaataaaagtaatacctcctcaaacttagtagttcctaaatatgttactgtcttttactgttatctgtgctcttaaagttgtgtctgtggtgtttccgtggtagaaatacaatatgatgttgtgctggtgtatatctctttctactatacgatggtgtgctggccaggcatggtggctcacgcctgtaatggcagtatttcgggaggctgaggcgggtggatcatgaggtcaggagatcgagaccatcctggctaacatggtgaaaccccatctctactaaaaatacaaaaaaaaaaaatattagctgggcgtggtggcgggtgcctgtagtcccagctacttgggaggctgaggcaggagaatggcatgaacctgggaggcggagcttgcagtgagccaacatcacgccaccgcactccagcctgggctacagagcgagactctgtctaaaaaaaaagatggtgtgctattccacatctcttcctactatatgatagtgtgctgctgcgtatctctttctactgtatgatagtgtgctgtgcttatctctactatatgatgttgtgctgcagcgtatctctttctactgtatgatggtgtgctattgcatgtctctttttcctgcctctggattcagtgaggtcacgttcgaagcttgaaattggccactgtagaagtattggcaacatggaaatcgacaacagccacatgctaaggttaagccttttttttttttttttttttttcagtttggaaaactggttgttaaacatttactagcacacccactctggagacattgttctttattcaatgaatgccttctgtgtgccggctacccttcataagtgctttgaataaatctttacttaatttcctcaagtattatccgatatgtttcttaatattatagatgagaaaaacaagattaagtaatgaagatcagaaagcagctgttatattgtacagctgggattttaacccaagtccaaagcccttagtcttctcattatagtgtgtggtatctctgaggctttggaataagttttatagaagagagatcatttgagctgagccttaagttatgggcaggatcttactagatattgaagttggaagaatatttcgagcattgtgaacaatttcagcaaatgttcatagatatcaaagtacatttcatgttccagaaatggtaagtagtagattcagtaatagaggatatctagaagagtaaagttaaaagaagtgaagcccgaaaagttgattggaacctattgtgaaggaccttaaatagcctcaaccttagaacaaaagagattgtttttattcctaaaggacataattatgtcccaaagcattttgtataattattttggttgtctaatttgaatttaaattcaatttcaatttaaagcatgagtgaggtatcatgtatattttttgtccagggagataacatggagcttttggtttggggccttattctgccgatttgtatgttggctgttaattttcagtactataattaatggttagtaaatgatgttcccccaaaatgggtcattctttgtagggaagaaaatgaatagataatagttgcaatgtttgcatatcttttggcaaatgagtattcttgttacctactttacggcataaagtagtattggtttatcattgtctttctgattttcagaacatcggttttttatttaaagtcacaaacccggaacaatacatagttccattgctgtaattttctctgctgtatctgcatcatgaaccatttactccccttacccccagaatcttttttgcagtatcttctgccttttgttgttgttgttttgagatgagttcttgctgcgtcagccaggcgggagtgcagtggcacgatcatggctcacggcaactgtgacctccctgggttaagcaatccttccacctcagcctcctgagtaggtaggaccacaggcacatgccaccaagccaggctaattaaaaataaaagtacagacagggtctccctatgttgcccaggctggtctcaaactcctgggctcaggccattctccctcctggcctcccaaagtgctgggattgtaggtgtgagccgccccgtctggccttctcttccttttaatgttccacacgattcttctcttgagttcttttgtcattcttaacagttaatgccatccacatccctaaagtgatgatttccaggtttatgttttcagcctggagctctagacttgcattttgaaattccaaatgaactggtggacttggataccccacaaacattctcaaattcagaatgtctacactagactcaatctctggcctttccaagccaaataaacctcttgctttccttattttggtgagtgacatgtttatctttctagttgcccaagccataaattggaggacagtgagaagaggtaggtcattctagattcctccttctttttcatttccacaatccagttactctgtaagtctcttatttctgcttccttaatatctgttgaatccaccttttttcattcccacaactttgattccagttgttatgatttattgactatattgtaaaatagtctttcaaatagcttttctgtcttcagtctgtgatgctttccttcagtctagcctcccaccaggctgtttaaaatactgtcagccctccctgtccatgagttctaatccatggattcagccaaccttggattgaaaatatttgagggggaaaaacaataaaaaataatacagtgtaacagttacttatatagcatttgcattgaattaggtattacagataatctagtgatgatttaaagtgtacaggaggatatgcataggttatatccaaatattacatcattttatataagggccctgagcatcggtagaattttgtatccatgggatggggagtgtgggctggggggtcctggaaccagtcccccacagataccaagggatgactgtaaattgatcagactcctcttgctttcttattcctttcagttttttgtttgtttttatgcttctctactctgcgtttttcctctcctcctcttttcctgccttttcatttattatttgataatctgaatatttttaatgttgattattggaatatttttatttgaattccatttttatttttctgattactttttagctgtacttctttgcattatacttttagtggttgccataggagtacagtatatatcctgaaattttgtagtccacttacaagtaataatgcactgcttcacttgaaatacagaaatcttacaaccttttaggtccatattttccttacctttcccctgttttttgataataattgttattatagatattatatcttgatacatattaagccccagaagataatcttataacattttcttcaagcaattatgtggattataaataaattaagaggaaaaggcaaaagggaaaaaatagggttattttttgtatttaccaagttatttaccgtttcacttcctcctccttcttttctgaaaatccacctttctctctgatttcatttcccttcagcctgaagaacttcctttaatatttcttgtaatgcaagtcaagtcttttggttttgtccaaaaatatctatttctcctttattcgatatagaattctaggtggacagtttttcttttgttcttcttcttctgtcttctttcttcttcttcttttttttttttttttttgtttcactctgtcacccaggctggagtgcagggacatgatcatagctcactgcagcctcgacctccctgggctcaggtgatcttcccaccttagcatcccaaatagctgagaccacaggtgcgcaccaccatgcctagctaatgttttttgtattttttgtagagacggggttttgtcgtattgcccaggctggacttgaactcctgggctcaagccatccacccatctcagcctaccaaagtgctgggattatagatatgagccaccactcctagccagtttctgtctttcatcactttaaaaatgtttcagctcaggtgcattggttcatgcctgtaatctcagcactttggaaggctgaggtgggaggatcatttgaatctaggagtttgagaccagcctgggcaacataataacaccctggtctctacaaaaaattaaaaaacaaaaaattagccaggcatggtggcacactgaggtggaggattgcctgagcttgaacagtcaaggctgcagtgattcatgatcaccctattgcactgctagccaagggcaacagactgggaccctgtctcaaaaaataaataaggtaagataaggtaaggtaaaggtaaaagaataagcaaaagtaagactacaactttccccctgggtaccctggccactgctggatgcacagcatggatagcacttagctcaaagctaaaagcctaggagacggaaagttacttgcatagatccctgtttccattctgcaagtgagcacgacctccccaccagagtttctgtttactttctgatactttcaggggatttctttttaaattgtgttcagttttgtagttgcattcttgcaggtgtggggaggttcagtagggtctttgtcatcagtctcagaagcaggaacctgtgttctttttacctgtcctcagaagccccctgttatgtttctccttctaccttacatgccattctttatgagttttttctgctagtgcctcttcatttccctgtatctcagattttgggatatcccagagtgtagtttttagattcttctgcttctttttttttaatctctacagactttctagggcaggagtcaggccaaatccatgctcattcatttgcatactgtcagtggctgctttgggattgcaacagcaaaattgagtagttgcaacagagaccttatggcccacagagctttagatatttactgtatgacccttcatagaaaaaagttgttgactcctgttctaggtgatctcatccagtcagagatttaagtgcatttacacactgatgtcttctaaatttcttattcccagcttcaagcttttgtctggacctcaggctcataaatccagtaacctacttaccttctttgcttgcatataataggcttgtaaactttgatatgtcctaaactaaattcttgatatttcccttacattgtgctcttcccccaatcttgtccaatggcaattccatctttccagctattcagccaaaactcttgagagttatccctgacttctcatttttccttatctcacatctgtctgtaaggaattcgtgttgtctttaccttcagaatatacctgtaatctgaccacttcttttttttttttttttttttttttgagacggagtctcgctctgtcgcccaggctggagtgcagtggagggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgttccgcccgcctcagcctcccaaagtgctgggattacaggcgtgagccaccgcgcccggccatctgaccacttctttacatcctcagctactgttcccctactccaagctactatcatctcttgcctagactattccagtaggctcctaattgttctccttctgcctgtgcatgattattgtttaattccaacacagtagcaaaacaacagtactttaaaaacctgagtcagattgttttaccccactgttcaaaactctcagctagattttcatcttactcagaataaaatccagagttctcgtgataatttttgaagtcacacacgttcttgccactggccatctctctgccatttcctccttttctcccccttgctgtcttccctcaaaccacctggccttcttgccattccttgaaaagctgagcatgataccacctcctgatacttgtacttactgttctctctgcctgcagtgttgtagctgtctttatgacttactccctcactttattcaggtctcacaaaaatataccttttctgaggttttccctgaccaccatatctaaaacagcacaagtgtgaacacatatacacatacatgaccatgaacatttatgactatatgacatgtatatttgtttgtttttcccaactagaatgtaagctctatgagagcagggggctttgtccgttttgttcttcacaaaacatcacaaaatatactgtatgtctgaaattgtacctagcacattatagagtttgataaattagttggactgatgaatgtgtgagtgagcaatcaccattctagccaagttgctttacttgcagtttctagaatatatgactctttttccactctccttcttattcctcctattgaggatctttcctttactatattcgtaatctgttatcgtacaagatttagcttaaatgttacctctgttaagtttttcatcttattgctcacaacattgtttccctcttcatgctcacaacactgattataattttttatctgccaaaaacactttaagtttctagaaggctgaaaactgatttatatttctgttttatctcatgcacattgcccacaatagtaggtatatagtaaatacctgttgaatcaccagctgtttttaggaggaatgaagtagaacataatagcgtaatttgaaaaggtagtgattatttagagagctggatcttagtcttcctaattagagtccaaatactagtgtgtgtatatctcttatttgcaaggaacagaaacttaactccagtagccacaaataatctagatgtagtgtgagaatgcagtgacaggaaggaaaataggtatttcaaaaatgccaagaccattaaatggagacaggatagtctctttaacaaatcatgctggaaaaactggatatccacatgcaaaagaatgatgttggactcttacctcacaccatatacaaaaattaactcagaatgaatcaaagacctaaatgtagacctaagactataaaagtcttaggagaaaacaggaaatgttttctgacatctgatttggcaaggatttcctggttatgaaaccaaagcacaagcaacaaaagtaaaaatagacaaattggactagaaaatgaaaaacttctgtgcatcaaaggacacaacagagtgaaaaggcaacctatagaatgggagaaaatatttgcaagttatgcatttgataagaagtaaatatccagaatatataaaggacttgtataactcaacaacaacaaaaaccccctaacaacccaattttaaaatgggcaaaggacttgaatagatatttctacaaagatgatatacatgtagccaacaagcatatgaaaagatactcaatatcattaaccattagggtaatgcaaatcaaaactacaatgagatatcactgtacacttattaggatggcagctattagaaaaaaacagtaaataacaagtgttggtaagatgcagagattggaatccttgtgcactgatggtggaaatgtaaaatgatgcagctgctatggaaaacagtatggtggtttcccaaaaaattaaaaatagttcttttttccccaagatggcagactggagacattgttagcatgcctgtcccacttggaaaaacaaaatagtgtgtagaaattcacactgtgaacatttttccaagaagcaacataggaacttaacagaaaaacggaaactacagaccctctgaaagaagcagcaggcagtagcctacaccatgaacccgacagaaaatggtgtctccagagcttgggaaggggagagacagctgccgtgacacacactcccactggggaacccagtaatccaggccatgaggggaaggctttaaccctgtccagcactggagctgatttagtgagcagtggggaatatatgggaaggagccccatcaggatgggctttgcatgcacgcccagactccagcagggacggagggaagccattccctatcacaggggacctcatgtcagctaactcaggctgaggtcacaggttgagagaagctcccaactgagatttgtgctataaacttgagtgaggatgaacacctttggccagaattaagggaggaacagtaagtgtgctgtagccacaggcacagaaactgggcactcctgcttccacagactgggaatggtgtttctcggaaactgtgatttctgtgtctctgaataggttggtggcctgggggcagttttgccttccaaatgtaggctgcctaggacctaggtggctgctgctagcagaacactatgggttgtgagacctgccttgccaagtgcataggagctgagtgggacttagtgctgcctgcaacccctccttcccacgcagattcttttgtacaacaaaagcatgtgcgcttctccctggaacattaccccagcagccaggaaactaccttctgaacacaaggtgctgctgcttgtgctcgtacctggggagccagagaaaggacttgcctgacccagcccccacccagctttgctccttcacttgccctggtcgtgtaacacaatgggcaggggcctttgggaaccccatggccctgcccattacctgaggcagcagagtacctcccctgggtaacataaggcaaacacaaattccaccactaccactgtagctggtgcagttgcaagtgctacctcctggctgatggacagctggcacagccccgttacagcatctgcaggcacaataacacagcactcaggaaagagaaaactgtggcatgacctcaactattgccatcgcctgcatcaccctggctaactagaaggccttcagtctgttcatgtacccagtacattactgctatgctggcatttcagaaaggcaacacactaaggctctttacaaggaaatctccatctacgtcacttccctcccacccccatcggagctgctgctggtacctgctgctgggagactagaggacaggttacgtcactgaatctactgcagacattccccagcaccagcctggagtatggcagcttcactgggcagctacacccagaggagcagcaggattcacagtatgggccctcagcgactgctactcctaggggaagggagtgagtgagtgagccacattaagggagtaccccgtgggacaaaggaaactagactgcaggccttgaatccatgaattttctacttgggggaagtttctttcagcagaggcacaagtgcagttctgggcttggtagacaaagtgcagctctacctcaacagtcaggcagccctggtgctcctgaagggtcttggagaaggagattacttctccctcttgcccaccactgcaaacatagctacagcttctcctagggagctcattgcgggtgcctctttagacagcatttctggaacatttcagggtgactacatccacataggaggagtgccttccagattcaggtttgcatgagaggtggagtcacaactcttctgtatgtgtaacatcagcattcctgcagatgaaaagaggtgcctgtctgtgatctgaatagctggaacactgggtcaagagtgtgattgggaggtagactgctttcctgctggcttggaagaagagctgtggtggcccccccacccccaaagaagacctcagtgcatttcaccgagagcttccacagccacttctgtcaaggctgggacctctgcccaccattgcagtattgcatttacccacctgtctttgctgcggccagtttttacccatgggcacctcctactggcataaaccctgaactgttcaacctggtgaataaaatactggggaaaaaaatttagaaagtgcacactactggggaacaataagcttcatgagacctctgccattccagccccataggagacagtgaaccttctcacacactgtattagtttgttcttacattgctaaaaaaactatctgagactgggtaatttatgaagaaaagaggcttaattggctcatggttccacagcctgttcaggaagcatggcttgggaggcctgaggaaacttacagtcgtagtggaaggtgaaggggaagcaggcacatcctatatggctggagcaggaggaagagaatgaagggggaagtgctacacactttgaaacaaccagttttcatgagaactcactatcgcaagaacagcaagggggaaatctgcccccatgatccaatcacctcccaccaggctcctcttccaacattgggaattacagttcaacatgagatttgggcagggacacaaatccaaaccatatcacacacccagcacatttctcctgcgactggcatctggcaaagccatcacacaaagactctacataaccaaggaactcatacagagtcttcaccactgaaagcacccggagctgaagctaagtgacaataaactacaaacatttaagtcacatgctcaagggggagaaaaggaaatttttaaaagaacccagtacaataaaaaataaattcaaaaaatagttagaagaaatagtctgctcacatgagaaggaaccagaaaactaattctggcaatatgaaaaaacagagggagagtcacccccaagagatcacaccacttctccagcagtggatccaaattaagatgagatctttgaaataccagataaagaactcaaaaggttgattattaagtcactgaaggagatacaaaagaacagaaaggctaaaaccaacataaatttaaaaaacaattcaggatatgaatgaaaattttctaaattgatattttaaagaaaaaccaaccagaacttctggaagcgaaagacatatttagggaactacaacatgcagtggcaagctttaacaatagactagaccaagtaggaaaaagaatttcagaactcaaagacaagacttttgaatcagcccagtcagacaaaaattatgacagaagaattaaaagaaatgaacaaagtcatccggaaatagggaattatacaaaatggccaaacttaacaattataggtgttcctaagagaagaaaaagaaaaaaaaattggaaaacttatttaagggaataattgaggaaaactccctggccttgttggagatttagacatccaaataaaagaagcttaaagaactcctgggaaactcattgcaaaaaggacatcaccagggcatatagtcatcaggctatctaaagtctgcatgaaggaaagaattcctagagcagttagacaaaagcatcaggtaacctataaagaaaaacagactaacagcagacttctcagcagaaaccttataagccagaagggattggggtcctatctttagtctcattaaacagaataacatccagcaaaactaagttgtataaatgaaggagaaataaagtctcaagacaagcaaatgccaagggaatttgtcaatactagactagccctacaagaaatgttaaaaggagttctaaatcttgaaacaaaaggttgatacatatcagaatagaaatttctgaaggcataaaattcacaaggatttcataaaacaataatacagtgaagaaaacagtcactaggtaacaacatgatgatctatttaaaagatacagattggcagaatggataaaaaaattgcaaaccaagtatctgctgactttagaagacacagataacacataaggattcttacagactcaaggtagagggatggaaaaagatttcgcacaagttgaaatcaaaagcaagcaagagtagccattatatcagatcaaacagactataaaagcaacagcagtaaaaaaaaaaaaaaaaaaaaaaagacaaggtcattatataatagtaaaaagttcaacaagaaaatgttacagtcctaagcatatatgcacctaactttggagcttccatgtttgtaaagcaattactgctagacctaagaaaagacacagacagcaacacaaaaatagtttgggacttcagtactccactggtgacagtagacaaatcattgaggcagaaagtcaacaaagaaacactggagtcaagctacactgtagaacaaatagatctaacatatttatagaacattccacccaggaaccgcagaataaacatgattctcatcagcacacacaacattctccaaggtatatcacatgataggccacaaaacaagtctcaataattttttaaaaatcagaattatatcaggtatcttctcagatcacagcagaataaaactggaactcaattctaaaaagaacccaaaaccatacatagacatggaaatgaacaatctgctcttgaatgttgtctgggttaacagtgaaatgaagatggaaatttaaaaaatttttgcagtgaatgataacagtgaaacaagttttcagaacttctgggatacagcaaaagcagtgctaacaaatgtgctaaacacctacataaaaaaatatgaaatattataaattggcaacctaacatcacacctcaaggaactagagaaacaagaacaaatcaaacccaaagctagcagaagaaaaataacaaagatcagagcataattaaatgaaattgaaacaaaaaaatacaaaatatcagtgaaaaaaaagctggttctttgaaaagataagcaaaactgataaactactcgctagatgaaccaagaaaagaacacagaagattcaaataatctcaattggaaatgaaaatggagacattacaactgctaccacacaaatacaaaacatcattcgagactactgtggacacctgttatgcatacaaactagaaaatctagagggaatagatacattcctggaatcatacaacccctcaagcttgaatcaagaagaaatagaaatcctgaacacatcaatagcaagcagtgagattgattcagtaatttaaaaaaaataaataaaactgccaattttaagaagcccacagccagatggagacagctgaattctaccagatattcaaagaaatgataccagttctggctgggcacagtggtttatgcctgtaatcccagccctttgggaggccaaggcagagatcacttgaggtcaggagttcgagaccagcccagccaacatggtgaaaccccgtctctactaaaaatacaaaaattagctgggctgtggcatgtgcctgtagtcccagctacttgggaggctgaggcaggagaatcacttgaacccaggaggcggaggctccagtgagccgagatcacaccactacactccagcctgggcaacacagcaagtctccatctcaaaaaaaaaaaaaaaaaaaaaaaaaaaagaattggtaccaattttactgaaatttttccaaaaactcgagaaggagggattgctccctaactcatcttatggggccagtatcaccctgatgccaaaaccagggaaggacataacaaaaaagaaaactacagaccaatatacctgatgaacatagatgtgaaaattcttaacaaaatattagcaaactgaatccaatagcacatcaaaaaaataattccccatgaggccaggtgcagtgtctcccgcctgtaatcctagcactttgggaggccaaggcgggtggatcacttgaggccaggagttccagaccagcctggccaacatggtgaaaccccctctctactaaaaatacaaaaattagctggaagtgttggtgcaggcctgtaatcccagctactcgggaggctgaggcaggagaatcacttgaacccaggaggcagaggttgcagggagccttgatcatgccactgcactccagcctgggcgacagagcaagactcttatcaaaaaaaaaaaaaagtaaaaaggtaattctccatgatcgagtgaatttctttccagggattcagagatggttcagcatatgcaagtcaataaatgtgattcatcatatgaacagaattaaaaacaaaaatggtatgatcatctcaataaatgcagaaaaagcatttgataaaattcagcatccctttatgataaaaaccctcaacaaactaggcatagaaggaacatacctcaaaataaagccatatgtgacacactcaacagccagcatcatgctgaacaaggagaagctgaaagtattccccctaaggactggaacaagggaagcatgcccgctttcactgcttctattcaacatattatagtactagaagtcctaaccagaggaatcaggcaaaagaaagaaacaaagggcatccaaattggaaaagaggaagtccggtgatctctgtttgccaatgattggatacctagaaaaccctaaggactcctccagaagactcctcaatcagataaatgaattgaataaagtctcagtatacaaaatcagtgtacacaaaatagtagcactgctatacaccaacaacagccaagcagagaatcaactcagtaactcaattccttttacaattgatatatatatacacacacgcacaccacacatacatacacacacacacacatacatatacacacacacacttaaccaaggaggcaaaaaatcttcacaaggagaactacaaaacactgctgaaagaaataatagatgacacaaacgaatgaaaatacattccataagaatctgtattctgaaaacgaccatactgcccaaagaatcagtgaaattcctatcaaaatatcagcataatttttcacagaattagaaaaaaaaatcctaaaattcatatggaaccaaaaaagagcccaaatagccaaaatcctaagcaaaaggaataaatctagaggcatcacattaccccacttcaaactatactataaggctatagtaaaccaaaacagtgtggtactggcataaaagtaggtacttagaataatagaacagaatagggaacccagaaataaagccaaatacaaccaactgatctttgacaatgcatacaaaagcagagtggggaaaggacacactattcaataaatggtgctgaggaaattggataaccatgtagaagaatgaaactggacccttgcctgtcaccacatacaaaaattaactcaagatggattaaagacttaagatctgaaaccataaacattctggaagaaaacctagcaaaaactcttctggacattggcctaggcaaagaatttatgactaagaccccaaaagcaaatgcaagaaaaacaaagataaataaatgcaacttaactaaacaaagcttctgcacagcaaaagaaataatcatcagaataaacagacaacctacagaatgggagaaaatatttgcaaattatgcatctgacagccaatatccagaatcttcaaggaacaagtaattccattaaaaagtgggcaaatgacatgaccagacatttctcaaaagaaatacacaaatggccaacaaacatgaaaaaatgttcaacatcactaatcttcagggaactgcaaattaaaaccaccgtgagataccaccttaccccacccagaatggccatgattaaaaagtcaaaaagtagatgttggcatgaatgtggtgaaaaaggaatgcttatacgttgctggtgataaaacagtatgtagagatctcaaagaagtaaaagtagatctaccatttaacccagcattcccactactgggtatctacccaaaggaaaaaaagtcactatatcaaaactgcacataggtgtattgcagcacagttcacagttgcaaagatatggaatcaacctcagtgcccaacaaccaatgagtagataaagaaaatggggtttatatataccatggaatactacttaacaaaaaagaatgaaataatatcttgcagtgacttggatagaaccaataatggtaggccattattctaagtgaaacaactcaggaatcaaaaaaccagataccacatgttctcacttataagtggggacttagctgtgggtacacgaagccacacagagtggcataatggacattggagactcagaagaggggagggtgctggggagtgagggataaaaaactacctatagggtacaatgtacactaccggggtgacgggtgaactaaaaccttagacttccctactacgtacttcatccatgtaatcaaaaaccacttgtacccctaaagctattgaaataaaaaattttatttaaaaaatagaattacagtatgatctagtaatactacttctgggtgtatatccaaaagaattgaaagcaggatcttgcaggatcttgcacacccatgtttgtagcagcactgttcacaatagctaaacgtttgaagcaacccaagtatccatcacgggatgaatggatacatatatgtggtatatacatacaagaaaatattacccagccttaaaatggaagaaaattttgacacatgctaccacatggataaaccttgaagacattatgttaagtgaaatagccaatcacgaaaagataaatactgtacaattccacttacctagagtagtcaaattcatagcaacaagtagggtagtggttgccagattctgtggggaggtggaaaatggagagcaacttaatgggttatactgtttcaattttataagatgaaaaagttttggagattgattgcataacaatgtgaatatacttaacagtactgaactatacacataggttaagatggtaatttttatgttacgtgttttttacaataatttttaaaaataatctaggaacaattctttcataaggtcataatttagaagcagtggcagatttagacagcattattactatttttaattattttcaagagcagttttcacagcaaaattgagaagaaagcacagagagttcccctgtactgcctgttcccatacatgcacaactgttgacatccctcgctagagtggtacattcgttaaaattgatgaccctacattgacacatcatcaccccaagttcgtactttaccttagggttcattcttggtgttgtacattctgtggattttgacaaatgtataatgacatgtatccgccactgtagtatacagaaaagtttctctgccttaaaaaccctctgtgttcagcctgttcttccttcctcactaacttctagcaccctcttgtctttttactgcctctatagttttaccctttccagaacatcatatagttggaatcatacagtatgtagccttttcaaattgggttttttgtttgtttgagacagcatcttgctctgttgcccaggctggagtacagtgttgtgatgttggctcacagcagcctctacctcctgggctcaaatgatcctcccaccccagcctcccaagtagttgggactacaggaatgcaccagcacacccagctaatttttgtattgtttgtagagacgggtttcgctatgttccccaggctagtctcaaactcctgggctgaagcaatccactgcctcagcctcccaaaatgttgggattacagacatgaaccactgcacttggcctaggttctttcatttagtaatttgcataaatttcctccatgtctttttgtgacttaatagcttatttacgtttagtgctaaataatcttccatttatgtatgtaccacattttatctgttcactgaagggtctcttgattgcttccaagttttggcaattataaattgttataaataaataaggctgctgtaaacatctgtgtgtaaatttttctgtgggtaagtaagttttcagttcatttgggcaaataccaaagaacacaattgctgaatcatatgtaagagtatgtttaattttgcgagaaactaccaaactctgtttcatagtggctgtaccagtttgcattccttctagcagtgagtgagagttcctgttgcttcacatccttgtcagcatttggtgttgtcagtgttacaggatttggccattctaataattttgttatagtatctcattattgttttaatttgcaattcccttatgacatatgatgttgaacatcttttcatatgcttactagccactttacattgtctttgatgaaacatctgttttgataaaacatctgttctgatcttttgcccatttttagttgggttgttttcttaatgttgagtattaagaattctttgtatattttagataacagtcctttatcagatgtgttctttgcaaatacattctcccagtccgtggcttgtcttctcagtccttcatatgttttctgtggagcagaaatcttaaattttaatgaagtacagcctatcagttttttctttcatggattatggcattggtgtcgtatctaagaagtcatcaccatacccacggtcatctaggttttctcctatgctctctttatgagctttatggtttgcattttgcacttaggtctgtgatccattttgagttaatttttatgaacagtgtaagatctttatgtggattcattttttgcatgtggatgtccagcaccattattccagcaccattgtggaaaatacagtcttttcacctttgcattgcctttccactttgtcagagatcagttgactacattaatgtgggtctgtttctgggctccctgttccactgacctatttgtctgttctttcaccaataccacattgtcttgattattgtagctttccagctagtcttgaagtctggtgatagacacggaattattttgataacacttgtcaactaaagtttgtggatttttaagctagtgatctgttaccaacctaattctactctgccctgtgctctcatttgtcttcgcagtactccagttggaaaaatggagctgctgtagttgaattaacaaccaagcttggctttctgtaattttttttttccaattgtaagtggtgttctatcataacactatttaagaggcaaggatagtgcctctggtacctacaacaaatatgtaactcatttttaattaagaagtttaggttaagtgaagttaaagcagccagatggaattttaaaattatatatgtattctgtttattatacaagtatttggtaggttgcaatgataaaaaatattaaaacggtggcttgtaagtactataaacatgaatatagtctttatgatttggtattagttacggcgctttttttcttcttttgttttaggagtctaccatggctcaagaatctcccaaaaattcagcagcagaaattccagtgactagtaatggagaagttgatgactctcgtgaacatagctttaatagggtaagaacacttttctttctcttaatgcaaagaatcatggtaagtctttaaatgttgagatgaaagtaatagacaaaatttaatataggattgttttcttagattggcttcagtcaggaatctaatgttattatatagggatgacaaggaaggccattttagtagtttgtcaagattaagctccaggccagtaaactattaggctttggtttattttcagtaattgatcagcacaaaagtatgtctgatgattttggtatctaactttataagactattaattctgtttgtaataaaaagattatccttttaaaattggcactaataacttttctatatatatgtcatttagtacataatttctaaatagccacttctgattttgctgttcattttctaaagtgccatacttgactcagtggaaaatgatactcggggtgcatttaattttgatctgtctctcagtcgaaatttaattttattgcattttaatgggaacaccatgggtttgaagataatctgggttcaaatttcagctatgccacatttctagcagtataaccttgagccagttatttatttaatctcttcaggtttttgttttctaatctctacaatgaatatcttatttactttcatgaagatattaatattaaatgagataatatgtctaatatagtcatagaaatgatagtgatggttattatttctggagatacttgcattaaacattcctttttatgacatttgatgcaagtgtacaactttaaaaacagagttttcgtatttttgaaaaagtagtggttgaaatgtacttaaattattatgtagtttaaataggactctttactccatgtgtttaagaataaaatcttttagttagcagaaggtgataacttaaatcaggatttctcagtcttagcactgttgacattttgggccaaattgtactttgttgggtgtattggcctatacattgtaggatggttggcacattcctggcctcttcctactatttaatagatgccagtagtaccctgcagttatgacaagcagatatgtccagatattgctgaatgtctccaggagaggggacaaattcctccttggttgagaattactgttataaatagatcggtttaaataatagtagaagtgtccactgaatttcatttatttttgcattaacagtcttttgaaaagaactagtatgtcttcaagctcgaggtttattttaatggcaagtgctttaacttggtttctgagcacttgtggtccaatatagagtgactcatagaaccaagagacttttaaattctgagcacacaaaagaaattttcatttcagattttagtctttccaagacacacctgcataataaagaaactcaagttagcatcattagactataccaattacctgataaacttttactaattttaatactaattatgccaagattcaagttaatgatttcttcatcttatttttggtaacagctctttttgcaaacttactatgcaagtatttactgaatatctgctctgtaccaggtactggggatatacagtgaacaaaaatatctgtcatcaggtagttgatattttaaaagacaatctgatgaaagctgaggacctttatccaagagtaatgcaatacatagaaaatgttgcattcatggttagggaagtcacttgccatcttaagcctattttttttcttcttcttctttattgaggtatagcttctacacagcagaaagcacaaatgttaagtgtaccactcaagagaactaccgctcagataaagatgtagaacatttccaggacctcagaaggcttccttatgccctctaggcaatacaactcatcccatcctgggataaccacattaacctaactctataatcataaattgcttttggctgtttctgaaatacctatcagtggaatcatacagtgtgtactctttttcaactggctttcactcaacattatgtctgtgagattcagtcatattgttgcttatagcagtttttctatctttttttttaaattttaagttctgggatacatatgcagaacgtgcaggtttgttacataggtatacatgtgccatggtggttcgctgcacctgtcaacccatcatctaggttttaagccctgcatgcattaggtatttgtcctaatgctctccctccctttgccccccaccccccgagtatttcagtgtttaaaattgtagtatagttttccagtgtgttaatataccacagtttgtatatccattcttcagctgattgttatctaggttgtttccagtttatgattattatgaataaagctgctgtgaccattcttgtgcagattttttggtgtacttgattatttgtttttattgagtacatacccaagagtgaaattgccaggtcacgagtatatgaatgtttggcaaatggttggaccagctggcaacaccagcaatgaatgagagttctagttgttccacatccttactagctcttcatattgtcatacatttcaattttagccattcttttaatggtatcccattgtggttataaaatgctgttccctgatgactatgatgttgagcacattttcatattcttattgaccattggagattgtcttttataaagtacttttccaagccttttgcccgtttttctactgggtgtgtgtctttttttctaatctatttgtaggagttctttatatattctgggtatatgccatttgtttggatgtatatatgcaaatatcttcttccagtctatgtcttgtttttgtactctattaatggcatcttttgatgaacagaagttgttaattttaatgaagtccaatttctcagtgtttccttctgtagtaatttttatgtcgcatttaagaaatctttgcctacttcagtatcttgaagacactttgtttcttctaaaagttgtgttgttttgtttttcacactatggtctgtgattcatcttgaattagtttttgtgtatgatgtgaagtagggaccaagatttttcttcctctcatgtaaatattcaattgatcagcactgttttttgaaaagactcttctttctatacatatgcaaaaaaattaaattggatctttatcttacaccatacacaaaactaactcaaaataaattaaaagcctaactgtaagacctgaaattataaaacttctagaagaaaacataggggagaagctccatgacattggtcttggcaataattttttgatatgatgtcaaaagcacaggcaacaaaaaaataaacaagtgggactacgtcaaactaaaaactttctgcacagcaaaggaaacaatcaacaaaatgaaaaggcatcctatggaatgggagaaaatatttgtaaaccatatatctgataaagtgttaatatccaaaatatgtaaagaactcatacaagtcaatagcagaaaaacagctcaatttaaaactggggatttgagtagacatttttcaaaaaaaaaaaaaaagtacaaatggccaacaggtatgtgaaaaggtgctcaacatcactaatcatcagagaaatgctaatcaaaacctcagtgagatatcagttcatacctattaggatgactattatcaaaaagtccaaaggtaagtgttgacccttatatactgttagtggaaatgtcagttggtacatctgttgtggaaaacagtatggcaatttcttaaaaaattaaagtagaacgaccataagatctagcagttccatttctgggtatatattcaaaggaaattaaatcactgtcttgaatagttatctgtactcccatgttctttgcagcattataaacaatagccaaaatatggaaataacctaagtgtctgttaatggatgaatggataaagaaaatatatacatacacatacacccacagacaatgcgatatcattcaagctctattaaaaaggaagaaatcctaccatttgtaacagcataggtgaacctggaagatattaggctaagtacaataagccagacacaggaagacaaatacggcatgattctgtacttacatgtggaatcttaaagttgaattcatagaaacagatagtagataggtgattatagggagtatgttagtctgtttttgagttgctataaagaaatacctgaggctaggtaatttataaagaagaattttgttttggctcacagttctgcaggctgtgcaggaagtatgatgccaacatctgctcagcttctggtggggcctcagggagcttttacccatggtggaaggcaaagcaggcacatcacatggtgagagagggagcaagagagaaaaggtggaggtcccagactcttttaaacaaccagatcttgtgtaaactaactgagcaagaactcacctattaccaagggagtggtgttaaaccattcatgaggaatccgcccccatgatccagtcacttcccacaaggccccacctctaacattgggaatcacatttcaacatgggatttggagggacaaactttgcccctagccccctaaatctcttgttctcacatttcaaaatgtagtcatgccttcacagtagtttcctaaagtcttaactcattccagtattaactctcaagtctaaactctcaactagagacgaatttcttccacctatgagtgtgcgagaccaaaaacaagttatttactcccaagatacaatggtagtaccggtattaggtatacattcccattccaaaagggagaatttggccaaaagaaggggaataggccccacacaaatctgaaacccagcagggaaatcattaaatcttaaagttccaaaaccatctcctttactctgtgctctgcatcctgggcacactggtgcacgggatgggcacctcaggctttgggcagctctgccccagcctccatggctgctctcactggttggagttgagtgcctgtgccttttccacactgagattgcaagctgttggtggttctaccattctcgggtctggagggtggtggctcccttcccacagctctcctaggcagtggcccagtagggactctgtgtgggggctgcagttgccaaacttctttcagtcttgcattctctgcacctacaggcttaacaccacatggaagctgccaagacatatggcagcttatattctccaaagtggcagctggcacagctgggatgtggggagcagtgtcccaaggttgcacagggcagcagcatactgggtctggcccacaaaaccattcttttcttctaggcctctggtcttgtgataggaggggctgtcccaaagacttctgaaatgccctttaaggcctttttcccattgtcttggatgttagcacatggctcccctttagtcacgctaatctctctagcaagtggctgctccacagtctgctcggattctttctctaccacagggccagcctgcaaattttccaaacttttatgctctgctttccttttaaatataagttccaactttaagtcatttatttgctctcatatccaatcttaggctgttagaggcagccaagtcacctcttgaatgctttgctgtttagaaatttcttctgccagataacctaatttgtcactcttaagttcaaacttccacagatccctaggacatgaatgcagtgcagccaagctctttgctagggtataccatgggtgacttttacttcagttcccattcgcttcctcatttccatctgaaaccttgtcagcctggacttcactgtccatatttctatcagcattttggtcacaaccatttaaccagtctctaagaggttccaaattttccttcaccttcctgtcttcttctgagccctctcaattcttccaacctctgctcattacccagttccagagctgcttccacatattcaggaacatttatagcaatacttactcctcggtatcaattttctgtgttagtccatacttatgttgctataaagaaatacatgaaactgggtaatttataaaaaaaagagttttatttggctcacagttctgcaggcagtaaaggaagcgtggtaccaacatctgctcctggtgagggcctcaagaagtttccaatcataagtggtaggtaaaaggggagcagacacatcacatggtgagagcaggagcaagagagaaaggggaggacccagagtcttttaaacaaccagatctcatgtggactgggtgagaactcatcaccaaggggatggtcctaaaccattcatgagggatctgccctcatgatccagtcacctccctcctagcaccatctccaacattgagaatcacatttcagcatgagatttggaggagacgaacatccaaaaccatatgttgaagaggtgcgggaggaagattttgataaaaggatacaaacctgcagttgacgggtaagttctggagatataatatacagcatgctaactatagtttattgactatgtgatgttttatatacttgaaatgtgctgagagtagatcttaagtattctcacccacacatacaaataaaaatgataactgtgaagtaatggatatgctcatcagtttgattggtaatcctttcatagtataaatgtaaatggaaaccacgttgtacaccttacaattaaatacaattttaattgtcaattatacctcaataaagctgggagaaaaaaagactatccttcctccactgggggctttgttttcagatgattgtatatgtgtgggtctgtttctggtatctcttttctttcttctttttttggtctgaccttgaagcaataacacattgtcttatttatttactacagtaattaaaactggagtaaatgtcagctccaatcttgatactggtagtttatttctccagctttgttctttgaggttgccttgcacattaaactcattcatgagtcttaagaacgtttatttgcctttgagtagcactgaaacaaatttttttccccttcctctcaaattttaactttagaataaaaagttttattttttatttttatttttatttttccgcaagttattgaggtacaggtggtatttggttacatgaataagttctttagtggtgatttgttagattttggtgcacctgtcaccaagcagtatacactgcaccatattttatcccttgtccccctcccactcttccccccaaaccactaaagtccattgtatcattcttacgtctttgcatcctcatagcctagttcccacataatcagtgagaacatacgatgtttggtttccattcctgagttacgtcatttagaatagtagtctccaatctcatccaggtcactccaaatgctgttaattcattcctctttatgcctgtgtaatattgcatcatatatatacaccacagtttctttatatactcattgattgataggcatttgggttgtttccatgattttgctattgtgaattgtgccactataaacatgtgtgtgcaagtatcttttttgcatgacttcttttcctctggctagatacccaggagtgggattgctggatcaaatgatagttctacttttagttctttaaggaatctccacactgttttccacagtggctgtactagtttacattcccactagcagtggagaagtgtttcctgttcaccgcatccacaccaacatgtactggtttttgatttttcgatcatggccattcttgcaggagtgaggtgatattgcgttgtggttttgatttgcattttcctgatcatttagtgatgttgagcattttttcatatgtttgttggccatttgtatatcttcttttgagaattgtctattcatatctttaacctactttttgatgggattatttggttttttcttactaatttgtttgagttcattgtagactctggatattagtcctttgtcagatgtatagattgtgaagattttgtcccactctgtgggttgtctgtttactctgctgacttccttttgccatgcaaaagctctttagtttaattaggtcccagctatttatctttgtttttattgcatttgcttttgggttcttggtcatgaaatccttgcctaagccagtgtccagaagggtttttccaatgttatcttctagaatttttatagtttcaggtcttaggtttaagtccttaatccatcttgcgttgatttttgtataaggtgagagatgagaatccagtttcattctcctacaagtgactagccaattatcccagcaccatttgttgaaaagggtgccctttccccactttatgttattgtttgctttgtcaaagatcagttggctgtaagtatttaggtttatttctgggttctctattctgttccattggtctacatgcctatctttataccagtaccacactgttttggtgatggcttatagtatagtttgaaatcaggtaatgtgatgcctccagatgtgttgtttttgtttagtcttcctttggctgtgtgggctcttttttggttccatatgaattttagaattgttttttctaattccgtgaagaatgatggtggcattttgatggtgactgcattgactttgtagattgcttttggcagtatggtcattttcacaatattgattctacccatccatgagtatgggatgtgtttccatttgtttgtatcatctgtgatttctttcagcagtgttttgcagttttctttgtagaggtcttttgactccttcattaagtatattccgaagtatttttttattattattttttgcagctattgtaaaaggggctgagttcttgatttgattctcttcttggtcactgttgggctatagaagagctactgatttgcctagattcatcttgtatctggaaactttgctgaatcctttgatcagttctaggagctttctggaggagtccttagggttttcgaggtaaacaatcatatcatcagcaaacagtgacagtctgatttcctctttaccaatttggatgtccttatttctttctcttgtctgattgctctggctaggacttccagtactatgttgaagaggagtggtgagagtgggcatccttgtcttgttcccattctcagagagaatgctttcaacttttccccattcagtattatgttggctgtggggtttctcatagttggcttttattacattaaggtatgtcccttgtatgctgattttgctgagagttttaatcataaagtgatgctggattttgtcaaatgctttttcggcatctattgagatgattgtttaacttttgtttttaattccgtttatgtggtttatcacatttattgacttgtatatgttaaaccacccctgcatctctggtatgaaacccacttgatcatggtggattatcattttgatatgttgttgaatttgattagctaatattttgttaaggattttagcatcaatgttcatcaaggtatcagtctgtagttttcttttttgattatgtcctttcctggttttggtattagggtgatgctggcttcataaaatgaattagggagggttccttctttctctctcttatggaatagtgtcaaaaggattggtaccaattctgtgttgaatttctggtataattctgctgtgaatctctctggtcctggactttttttgttggtaattttaaaattaccatttcagtctcactgcttgttattgatctgctcggggtatcaaattcttcctgatttaagctaggaaggttgtatttttccagaaatgtatccacctcttctagattttctagtttatgtgtgtaaaggtgttcatagtagccttgagtgaccttttgtttgtcagtggtgtcagttgtaatatcccctgtttcatttctttgtgaggttatttgaattttctctcttcttttcttggttaatcttgctaatggtctatcaattttatttatctttcaaataaccacctttttgtttcatttatcatttgtatttttttgttgttgtttgtttcaatttcatttagttctgctctgatcttggtaatttcctttcttctgctgggtttgggtttggtttgttcttgtttctctagttccttgaggtgtgaccttagaatgtcagtttgtgctgtttcagtttttttgatgtaggcgtttagcacctctttgcacttcttagcaccaccttgctgtttcccagaggttttgataggttaatttccaccttgttttcatttttgagccagtgctcattcagaagcaggttattaatttccatgtatttgcatggtatcaaaggttccttttggagttgatatccagttttattccactgtggtctgaaagagtgcttgatataatttcaatttccttaagtttattgaggttcgttttgtagcctatcatatggtctatcttagagaaatttccacgcgctgttgaatagaatgtgtattctgtggtggttggatgaaatgttctatatgtatctgttaagtccatttgttccaaggtatagtttaaatccattgtttctttgttgaccttctatcttgatgacctgtctagtgctgtcagtggagtattgaaatcccccactattattgtgttgctgtctatctcatttcttaggtctattagtaattgttctataaatttgggagctccagtgttaggtgcatatttgtgtaggattgtgatattttcctgctagacaaggccttttaccattatataatgtccctgtttgtctcttttaattgctgttgctttaaaatttgttttgtctgatgtaagaatagctatccctgctcgctttttgtgtgcattggcataaaatgccttttaccactcctttaagtttatctgagtccttatgtgttaggtgagtctcctgaaggcagcagatggttggttgatgagttcttatccattctgtggctctgtatcttttttttttttttttttttttgagacagcgtctcgctcttgttgcccagggtggagtgcaatggcgcaatctcggctcactgcagcttccacctcctgggttcaggtgattctcctacctcagcctccggagtagctgggattacaaggcacccaccaccacgcccagctattttttgtatttttggtagagacagggtttcaccgtgttggccaggttggtcaccaactcctgacctcaggtgatccacccgcctcgacctccgaaagtgctgggattatagtcgtgagccactgcacccagtcagttctgtatcttctgtatcttttttttttaagatggagtctcgcctcgctctgttgccaggctagagtgcagtggcgtgatctcggctcactgcaacctccacctcccgggttcaagtgattcttctgcctcagcctcccgagtagctgggattacaagcacgtgccaccatgcccagctaatttttgtatttttagtagagatggagtttcaccatgtcggccaggatggtctcaatctcctgacctcgtgatccgcccccctcagcctcccaaaatgctgggattacaggcatgagccaccgtgccaggccagttctgtatcttttaagtagagcatttagaccatttgtattcaatgttagtattgaaatgtgaggtacggttgcattcattgtgctctttgttgcctgtgtacttttgttttttgtttttgctttttaatgtgtatttttgttttataggacctgtatgatttatgctttaaagaggttctgttttgatgtgtttccagtatttgtttgaagatttagagcccctttcagcagtttttgtggtggtggtttggtaatggctgattctctcagcatttgtcagaaaacgactgtatctttccttcatatatgatacttagtttcactggatacaaaattattggctgataattgttttgcttgaggaggcgaaagatagggccccaatccattctagcttgtagggtttctgctgagaaatctgctgttgatctgataggttttcctttataggtaaccttgtgcttctgtctcacaactgttaagattctttctacctctggaccagcctgctagcccacatgctccgatgttaatgacatcgaaggcacccgtctcgaggaaatctcaactgcacaacccctactacaccccaattcagcaggaagcagttagagcggtcgtcagccaacctccccagcagcacttgggttttcctgttgagagcggggactgagagacaggactagctggatttcctaggctgactaagaatccctaagcctagctgggaaggtgaccgcgtctacctttaaacacggggcttgcaacttagctcacacccaaccaatcagatagtaaagagagctcactaaaatgctaattaggcaaaaacaggaggtagagaaatagccaatcatctatcgcctgagagcacagcaggagggacaatgatccggatataaacccaagcattcgagccagcaatggctaccctctttgtgtcccctccctttgtatgggagctctattttcactctattaaatcttgcaactgaaaaaaaaaaaaaaaagattctttcttcatcttaactttggataacccgatgacattgtgcctaggatctttttgcaatgaattttccaggtgttgcttgtgcttcttgtatttggatgtctaagtctctagcaaggcaggggaggttttccttgattattcctctgaatatgttttccaagcttttagaattctcctcttcctcaggaacactgattattcttaggtttggttgtttaacataatcccagacttcttggaggctttgttcatattttcttattcttttttctttgtctttgttggattgggttaattcgaagaccttgccttcgagctcggaatttctttcttctacttgttcaattctgttgctgagaatttccagagcattttggatttctaaaagtgtttccataaaagtttcctgaattttttattgtttttcctttatactatctatttccttgaatatttctcccttcatttcttatgtctttttttttggatttccttgcattggtcttcgcatttctctggtccctccctggttagcttaataactaacctcctgaattctttttcagataaatcagggattgttggtttggatctgttgctggtgaacttgtgtgattttttggggggatgttgaagagccttgttttgtcatattaccagggttggtttcctggttccttctcatttgggtaggctctgtcagagggaaggtctagggctgaaggctgtcgttcagattttttttgtcctatggggtgttcgcttgatgtagtagtctccccattttcctatggatgtggcttcctgtgaaccaaactacagtgatttttgtctttcttctgggtctagccacccagagagtgtatctggctccaggatggtactgggggttatctgcacagagtcctgtgatgtgaaccatctgtgggtctctcagccatggattccagcacctattccattggaggtggcagagggtgcaatggactccatgagggtccttagctttggtggtttaatgctctgtttttgtgctgattggcctcctgccaggagatggtgctttccagaaagcatcagctgtagtaatgtggagagggactggtggtgggcactgccctagaactcccaggagtatacgcatttgtcttcagctaccagggtgggtagggagggaccatcaggtaggggcagggctagttgtgtttgagctcaaactatccctgggcgagtcttgctgcagctgctctgggggatgggggtgagattcccaggtcacaggagttgtgtacctaggaggattatggctgcctctgctgagtcacacaggttgtcagggaagtgggggaaagccggcagtcacaggcctcacgcagctcgcacgcaaactgaagggctgttctcacttccactgtgcccccaccaacagccctgagtctgtttcaaggcagagagcgtgataggcttgaaaacctgacccaggctacccaccttccagctgcgaaagaaaagggcttggttcttgcatggcctgtggagtctgcacacgggatttgtgccctcccctgacttgtggccaggaggcttctaccaccgttcaaattgttacaaagttcagctggagatttccttctcactgtggagttttaccccctgctcctctggtcaccctcctgatggatccctgtggtaccaggcaggaatggcctgctaggggacccagcgagctcccagggcctttctgctgcttcgtgtaccactgtatttctcttggctctctaaacttgactcagctttaggtaaaatcagaaacttctcccacgaacagaccttcagcctctccagtgggagtgtgtttgggagaggaggctctccctttcccacttccgtagttggggcactcacagtacttgaggtgtctcctgggtcctccgggagcagtccgcttccttcagagggtctgtgggtcctctcgggattgctgatttgttcttgcagtcaatctggagctaaaatttacaatgaaaagttttattagaatgaagtgaattaaactgcaacatatcagtatgagttatttgcttattcaaagccaataatttcctcctttgtgaattgattgattgatttaaattaaattctctttttaaagattcccttgcaattattttacttcctattggaaggcagaaaaggaaaacataggttgtcttggtggtctctccttattgaatatgaaccttatcagtgggcaagcctccatagaagcaataacctatttcacctccttaaagaaattcaacataatacaaattaattatttctgtttgtacctgctgttattaaaaataaacacatcagatgacacaaactaataggaaaaccttccatgttcatggtttgaaagaatcaataccattaaaatagccatactgcctaaagcagtctacagattcagtgcttttctattaaactgccagtatcattttttcacagaactagaaaaaactatcctaaaattcatatagaaccaaaaaaagagtccaaatagccaaaggaatcctaagcaaaaagaacaaggctggaggcatcacattttgcaacttcaaactataaggctatagtaaccaaaacatcatggtactggtacaaaaacaggcacattgaccaatgaaacagaatagagaacccagaaataaagcatcacacctgtagccatctgattattgacaaagtcaacaaaaataagcaatgaggaaaggactttctattcaataaatggtgatggaataaatggataatcatgtgcagaagaatgaaactggactgctatctttcaccgtatataaaaaattacttcagatggattaaagatttaaagataagacctcaaagtataaaaatcctacaagaaaacctaggaaacaccatctggccattgaccttgggaaataatttatgaataaatcctcaaaagaaatggcaacaaaaacaaaattgacaagtaggacctaattaaagagtttctgcatagcaaaagaaactaccaacacagtaaacagacagcctacagaatgggagaaaatatttgcagactatgcatctgacaaaggtataatatccagaatttataaggaacttaaacaattgaacaagcaaaaaacaaccccattaaacaaatgggcaaaagacatgaatagacgcttttcaaaagaagacatacaagtagccaacaaacatatgaaaaaatgctcatcactaatcatcagagaaatgcaaatcaaaaccacaatgagatgccatctcacaccagtcagaatggcttttattaaaaagacaaaaaataacatactggcaaggctgcagagaaaaagggaacacttatacactgttgatgggaatgtaaattagttcaaccactgtggaaagcagtttggagatttcccaaggaacttaaaactaccatcagacccagcaatcccatgactgggtatatatccaagagaaaataaatcattctaccaaaaagacacatgcacttgtatgttcatcagagtgctattgacagtcacagagtcatacaatcaatctaggtacccatcaatggtggattgggtaaagaaaatgtggtagatatacatcattaaatactgtgcagccataaaaaagaacaacattatgtcttttgcaggaacatggatgcaactggaggccatccacctgtttttgttgctgctgaattaacacaggaacagaaaaccaaataccatatattctcacttataagtgctagctaaacactggatactcatggacataaagatggcaagaatagaaactgggaacgactagagtagggagggagagaagggggcaaagggtgaaaaactattgaatactatgctcagtacctgggtgacagtatcaatggtaccccaaacctcagcataatgcaatgtatctgagtaacaaacctgcacatgtaacccctgaatctgaaataaaagttgaaattaaacgcacacacacgcacacacacacacaaagagcatatgagtcatttacatatttaatagttttgaattaaaataaaactcagccatgtgctctcttaacccgtgagtgaaaacagtatttcagaagcatcatttgactattttgaataaattccctcaagatcttttaagcatctgtttacctcaattttggcttacttttccccatttatttttctgaggaataaataggaaaattgcatttaactccaaattcatttttctattttaatagagataaaattttatagagaaaataagtatattaatatattttatagactagtgaagagatctcatatgtaaaactgaatcataaccaaagttttctgaggtactttacttatatacatgtttcttttatacttgtttaaaatcttataatggcttttgttgaatgcataatgcacttttaaaagtttagtctgttacataaaataaaagtggtaggttattacgttgtcgtaacctggctggccagctggtgtcactgtggcacaggcaatgaaattacaattttttttttttgttcttgtttgtgtttctcattgcagatatttgatttttcattttacttcctttcttagtctgtcctaagagaggccctggttagctttacactcaatattcacatctatgtagagatgattttgtcctagcaatccctttgccagcagtttagtcattgcctcgtatgttaatgtttttaggtttgttcttttttttttttttttttttttttgagacagagtctcactctgtcgcccccaggccggagtgcaatggtgtgatctcggctcactgcaacctccgcctcccaggttcaagctgttctcctgcctcagcctcccaagtagctgggaccacagtcatgtgccaccacgcccggctaatttttgtattttcagtggtgacagggtttcgccatgttggccaggctggtcttgaactcttgacctcaggtgatcctcctgccctggtcccccaaagtgctgggattacaggcatgagccactgcacccggtgtcttctttttattaagatggggcagcaacagccagatgtggagaggataatcatcttagtattatctcagttttttacagcaaaaatatttctgcttctaaataaatgcattttatttagaaaataaaaataaaattattattttaagaattattctttaaaattattcttttaaaaattattcttttaaaaaagagtattacaatttaatctaaataattcaaattactctgatttgtaaactgtgtgtagtatttgtaatggatgctgttatagtgctggtcaaaattaattagaaatttgcaactcataccatgagtttaagagcagaagcaaatcatactaactccacatggttgaaacttcttgtgaattaatttatagttggtagatttaaagacattgcctccttagacctagctaaaatggaatttttcccgtggaaggcccaaaacaaaaatccactaatgtagggtgtttttacctatgaacactttctctagcaaaatgtccatacacaaacctaccaaattttgcattcagatttagtgagcttaggaccccctgaaccctgcataagggttctcaggttccctgagtcttaagaaccccccacctgtaagttttaagtgatatcacagagtattcgttcagtagaactaccttagagatctcggagtctcactatgttattttatagtggagaaaaaaggcccttgaagttgttatggaattacccagtattaattaaatagctgtaccaaaagcttatgtgatttgactataactgcagtgagtgcaagagcgctctctttcattaccttatttccagggtttggtaacagtttttggcacttactaccaaagagggcctttcaataaatggtgaataaatgaatgtttattcacgtaagaacgaggacgaggactagaaaccagatttttagacttctctgaaaaaccagggaagagatattgtaatcttatatttgatacatcttgtgtccttaatttccctgcatgtggtatttgggtttgtgagtgtgagtctttgttgttatagttttatttttaatgattttgttgagctaagtcgtttcttcattcccttgtacttagcagtctgcaatatcatacactacgatctgcagaagatttgggaaagaaatacaagaaattgttggaacactgttcctccaactcctacccccaccagtcacatgttgtaacttatttatctccttttcccaagagattggaatcactgttaggtcagagatagtgtgtatacacagcacaagttttggttcatagtagttgctcaataaaagaatgaattctagtaaatagacttaaaagttgacatcttttctccttcagccatcctaccctagggttttcatagcatgtgattacagtttgtctccattctatataggaatgcaatataatgtttccacgttactcacacataaaaaatgtagtagctcggtcaatggcaataatgatttgatgggggctttttcagagagccagttttgaccaaatatgtatgttgatcccttttagaggtatggcaaatggttttcaaggattgtttaacccatacaaatctagattcattttaatactgtttgcttttcagctataggctatacttttaatactattactacaaattaaaattttaagtatatttttaatatacacatacattaaattaattctggattgagagtcctgttgaaaatacaattcataatgaaaggttgaaggcttatctgtcttaattataatctgagagtgtgcccttatttataaacaaaagctattagtaatatgtttttttttatttcttggaggaattttgttgaaaatacaattcataatgaaaggttgaaggcttatctgtcttaaattataatctgagagtgtgtcgttatttataaacaaaagctattaggaatatgtcgtttttaaattttttgaaggaattattttgaatgtagatacatataaatatttccacagtgatagtatgtgaatgaattcagtatttctttgatgcaagttggtacatgattcaagcttttgaactacttagaatctagactaagtgggtgaggccaagagggtaggcagtgaaccaccaaaaggtacttgtaagttcttgttaaatattgttgaatgaatgggagagagggagaaaagaagattgaaattgtgtgtctgtggcaggcaggtgtgtgtgtgtatggtggtaaatggaaaaaaatcaataaaaatgttagatttactctcttgattagatggaataagatacaggaggatattgtgatcataaagtgagttattaaacttatttaaagtgagaatctagaagtgttgcttccgaagtgatgacaaggtctaagagtggcaatttgagtttaggttgcctgagtggaatatggggtatgaaagatgaaaggcattagaaatgaagatgttaatgaaatctgagactaaggtgtagattgggttatactaagtctaaaatgtcttttatctgccctgacacttttttggcatgttgtccaactacagattcccaaacctgatccagattaccaattttacgcatttctgcaagtatacggagggaaaataaaatcacatacctttacatatcattattactatcccctgtcattctgcatcagcataggtaggcaggctcatggaacagattttaagtgttttacaatttatattttaaaatatagcaacttactacctaccataacattagtggactgtatttttaatgatcggtgaaaactttcagcctagacagcgaatatatcagcttggaaggaattgctaactgaacatctataatcatttcctgaaaatgtgcccaccaacatgcaaaaggttagaaacacccagtttaatggtgagagttagggataaagcagaagccctagatgtgccaaagtcttcaataaatatttgaaattgactggaaagaaggtagatgacaatgttgaggtggggacgagggcagtgaggaaggtgacacacaggaaacgggggggttgggtaggggcagagttgcacaagaatggaaagcagttctctacaacagttcctcaaaatagactaaggatcgcctgcatcagaatcacctgatttccttgttttgaaattcggatttctgggcttcacattccaactcagtgagaatcaccacacagctaagagcaatctgcatttttaacaggatcctcaggtgattcctactgaaattaaggtttgagaactggttgtttagaagtaccaatagagagtttagaaaatgctgaccctgccttctaacaatagaatattgataagtagaatgttggaagataatcagttttataaaactcaagataattgtggagaagcagagaggccacttaaggggggttaatagtgttacagaactggggatgtggaggctgttgtaataatagctttgcttctggcagatactttttatagacagctaactgttaaactaacaaaggagattttaaattaacagaattcatcaaacatttaacataagtgttttagtttgtttctttaaaaaatttattatgtagatgctttggaaggttttgtcccttttgaagcatgagatgttactgagaaaatttcttgccaaatgaagtaatagacactctgctagatgtcaagaatacaagtggtgaacaagatagataagcttcctgatcttagcatatggtcttcggaatgggaagagaggatatagacaaattaattttaataccatgtgaaaaatgttgtgctaggccaagtatagcatggtctgagtactggtgggagcatggaaagattacctgagtgattactatataagctgaggtctgaaggatgacctagccagataaagggtgaaaaatattctcatcagaagcaactgtaacaacccgaaggaagtgtgagaccatagaactggaaattcatgttgttggaatggagaatgtgagggcaggtgtgtgagaaatgaggctagagagataagtagatagtagatcctgcaaaaccttgaaaaccatattgaagagtttagtctttacctaaaaggcaatggagagccactaaatgctataaaaatgggagtgtctcagttgggttcacattttagaaaactgtctctgtctagtttgaagaattgattgcgggactgacagtactagagacatgggaaacaagttcagtcatcaagggcaaaagaggagtgagacttaggacattctcaaggatatatattttaaaacaaatttactgaacattttgtgttcttcatgtgttggttttacactacagttcaaaagtattaccatgctaaattttaagttctaaacttatgtttttaatgtcataattatagtaacctctattaaaatatgcaaaatggagacgttatttttcacagctttatgaaagctattactacaaatattactttgtattcttttaaaagtacctaaaatgtacaaaaatgtatttggagcttttgccaaaagcatattttgttttagcttaattgtttgaaaaatatttttaaaaactattaaatactcaagcattatgctaaaagcttgaataaaaggttaactcaggtttatcccattttattatacacttgttaagcttggccttgcaaagtgttaaactttgaattgaatgtcagcaacataaaaatgcaaattaggaattttatgttgttaattataaatgggtccattgtctctgaaatatagtctggaaaatataggagtaaattcagtagcagatactttataagttgctaagctaggcacagacttatataactgatacacttaaaaaatttaagggttggccaggcgcggtggctcatgcccgtaatcctagcactttgggaggctgaggcgggcggattgtcagagctcaggagttcgagaccagcctgggcaacacggtgaaaccctgtctctactaaaatacaaaagaaattagccaggtgtggcagcgtgtgcctatattcccagctactcaggaggctgaggcaggagaattgcttgaacctgggaggcggaggttgcagtgagccaagatcacgccattgcactacagccaggtgacagagcgagactccgtctcaaaaaaaaaaaaaaatttcgggttatgtaaagaaagcacatttaaaattttggtgaactgtgaggctatataatattacttagagaatgagtattttattgaaaacaacaaactcataaaatccctagtattatctcacaagtcataaattcgtctcacatagcccctattattttgtgtttcatttagctgccaaaccacatcagaatgatagttctcttcagaattggaattcaacctatttgtatcatttttggttaggctccttctgttagtagcagcttaggcataggaaggccttagtgattttcagattttacacctgttttacctataggacagtagagttttcttctggaagaacttttgtttgtttagtaaagaaccccagcagacagtagggagggatttgagtgactgtaatgtcctcagctacagttgtctccatttgcatttaagatttttattgatatgttttgttgttctcatattgttaattggtttttggttattttgtataatctttgttcctttctttttgcctgattgtttctcattatggtttggtggttttctgtattggtgccgtttgagtcttttctctttgtcatttatgtgtttgctttacctgtgagttttgtatgttcatgtgttttgatgatggtaaatgttgcccttttgcttccaggtttagcgctccgttgagcatttattgtagtgcctgtctactggtgatgaattacctcagcttttgcttatctgggaaagactttatttctccttctggtaattttgttggatatagtatccttggctggacagtttttttctttctatacttcaaatatgtcataccattttctcctggcttctgtctcctgagaaatccactgatagtcttatgggggttcctttataggtgattagacacttttcttgctgtttttagaattctctattgttgactttagactttttgactataatgtgccatagagaagatctttttgtattgtatcagtttggtgatctgagagcctcctgtatctggatgcctaaatctcttgctagacttggacagttttcatttattgttatattaaataggttttctaacactttcattctctcttcaccctctgggaccccgataatatgaatatttggtcactttatgttgtctcatgtcatgaatactttcctcattcttttttattctttatttttttctgattgggttctttcaaaagacctgtcttcaagttctgagattctttttttttttttttttttttttgagactgagtctcactctatcacccaggctggagtgcagtggggcacgatcttggctcactgaaacctccacctcccgagttcaagcaattctcctgcctcaacctcctgtgcagctgggattacaggcacgtgccaccacacccagctaatttttgtatttttagtagaggcggggtttcaccatgttggccaggctcgtctcaaactcctgacctcaggtgatccacctgcctcagcctctcaaagtgctggcattacaggcataagccaccgcactcagccaagttctgagattctttcttctgcatgagctagtctattattgaagtttttgaatgtattttgtatttcaagcaatgaattcttcaattccagaatttccgtttggttctttttttatgatctttatctctttggtaaatttctcattcatatcctgaattgtttttctgatttctctctattgtttttcagaattctcttgtatcttcatcttgagaatcagtagtttgaattctttttccaaggtttcctgaatttctttttggttgggatctgttgctggagaatcattgtgatcctttggaggtattatatttccttgcttgttcatgttttttgtgtctttacattgatatctggtgtaatcgtttctccattagtttgaatttgctattgtaggggaggactttttcctgaagttgtatctatgctattgggtgagtaggctactttgactttgattcttgtgcaagcagtagtgtactctctgtataatttctttggctgtatacagcattagtggtatctgtgattttcctcagtggattaagtgtacagttattagtggaagctgtggtgaagttttgctttagatgtcagataggtcactctttgggccccagttgtagcagtggtgggctgagcatgcctgtcctttggccccagggtggtatatgccggcaccagtgttaatgggtccaggcgagtggatttttgggcctccagatggcttacttggatgccagtagtggcggcagtgggccaggcaggtgggcaggttcttggacctctaggcagctagcatagcatgggcaatggcagtggcagtagcagacgaccctttgggtcctgagtagtgtgcatgggtattggcagtggctgtgatgggctgggcggaccagtctccaggtcctcagggagtgcatgcaactaggtgccagctgaggtggtagcagctgagtgggtagtccaacctcaggtcctctggaagagtgttcaggtgccagtggtagtggactgggctgggcaatgctgtggcccccagactatgtgttctggcacagctgcggggggtggggaagccaggttgggtaggcatgtcctcaggccccccatggtgtgtacaggtgtgctagctgtggtggggaggggtggggtgcagaatgcgtgagtaggaggtggcaacagctgtgcttctgcacttccactggagagggtggtgctgcctttagtgactggcggcagcctaggctggtggatagagaacatctatgccccttagatctcggcccctgcagtgcttgtgcctcagccctggatacagtagtctgctatcacttgcacctaagtcctagggcctgcagcccatgcttctcttgtttttcaggacagtgtgagatctgttgggagcagagctctgaaatggcaccttgccgtatctgcttagatctcagggagcatgtgggacccagagtgagcttcctttctggggcagtgccatcacacaatctcctggcagctccctgcatttgtttcagggcccatgagggtccaggggctctcctgtagctaggattgcaagagtccacagtgggaatgtagacttcttagggtctgtcatttacctctttcccatattgggaagtctccctttgcctcccagctgatcctggcagagcaggttgccttgcttccttctccttccttgctttagatatttcctgtcacttttctgttggattccagtggtctctcttggatgatgtattcgaggtgtgatatctactcttttggttcttcttaatggaggaagggagtgcgaaatgcctctaatcagccatcttgaagcccctctcttaagttttcttttctaagaggccataggtgacaagatgaaaggtatctctataactgcttgaaaagttaggtaatcagaattatctatcatatgtactatttaataacacattacttagctcccctcctctcagatagtactgctattatatctcttttccagaaatttacacaatattctatgacaggagaatgattcagatgagtgttgttctttctgataaagttccaaggatacatctaacataaccattctggacctacacagtcagctgtctttatcccagcttctgtatcccagggtccacatccacagattcaaccaactgcactgaaaatgtttggggaaaatgaaataaaatgaaaaataacaatacaattaaaaataatacagatttaaaaacaatatagtataacaactatttacatgacatttacattgtatttggtattttaagtaatctagagattaaagtatacggggaggatgtgtatagagtataggcaaatattaggcattttatataagggacttgagcatccgcatgtattttggtatccaagggatcctggaaccaaacttccaaaggacaatcctgtgccatttgtatgttgtttgtgttcagatgttagggttttcttacattttttgtattttgaggggtgttttggtacttttttccttaaggaaagctgttatactcactaaaacataagccactgaaaagctgtcaagacttaagcaaggcaacattcaaggaagccattccaaaaatagttgacctaatgaccaaacttgcaaagtttacaaattatttcagtgatttgacagcattttattttgtctttcagagagggaagattctagtaatataaatatgaatgaaaggaatgctaatatttaaaactggaaaccattgattttagatattgaaaactaactgggaaagttaaaggtcacttattcagtgaaatgaacagacttggagactcggtttaaaaataggaagtaaataaaaattgagtgtaaggaatgttttctttttgactctctaagtgttctttaaaacaatatgtagttgaagggcgttgtcctgtgacaagaggttttaagtgatattaggaaatgagtgaatgggataaaggcagttcatctgttttgtaccagtaggaaattacagtttgagaacatatttctattagtgcgcttaaaccgaagcaggttctgaaataatgtttttttaaagctatttatttaaataaatcttttagaaaacatactaactaaaataaattctaagtctccaataaattgcctatggctgcttacatttatcatacattacagttaatatcgtttctggaggcttagtcctaaccatattgctagttaatatcaaaatgacacacttctgtgtcccagttttctcatctgtaaaatgggagtgaaagcacttcaagtgtttgtcaagattaaatgaggtaatatatacacagttcttgctttgtatagttccaatatacattaatttcagttagcacagtttagttaaataacaccagtccctcagcaacccagcttattactctctcactttgttcaggactctgttcacaatttatctcatcagagagaccttccccaaatactgcatctgaagtggcaacctttatctgtcactctctatccctcttatcctgcctttaaaaacaaaaacttatttacttgtttattacttaattacaggacttgttaccacctatgtttgtttactatcaatctcctcccttcctatgtccccaccccccagaacatcagtctatgtgggcagggactttatctgtttttctttcactgccgtgtcagtagtgactagagcagtggctgtcatgaagttggtggtcattagatgttgattcaatacataagtaaataaataagccacccctgttgggtcacacctgcaattccgccactttgggaggctgagacgggcgaatcacttgagttcatgagtttgagaccagctggggcaacatggcgaaactccatctctactaaaaatacaaaaattagctgggcgtggtggtgcatgtctgtaatcccagctactcgggaggctgaggtgggtggatggctcgagcccagggggtggaggttacagtgggcccagatcacaccactgcactccagcctgggtgatagagccagaccttatctcaaaaaagtaaaataaaataagtaaataaataatttatgttccatagctcaggcagtacttccttccttcctattttgttttttatggacttagtctattctgaattcttctgatacttagtgtttttactttggcaccatgttcaatttttatgttaatgtctatcttgtctccaatgagatggcaaggagtgtaccttatctctttctctgaccaaaaagtctaatgtaagaataagcaaatatacattaaattatatttcaaaataaacccgttattattgcagcttcttaatctacatggcattgaatcataaatcctttagttcattcaacaaattcattatttatctattcaaatatttatttgatccccctatatctcaggtactatttcaggtgctgggtatatagcagtaaacaaaataggcaacaaccctgctgtcatgatgtatagtatagtgaggggacacaaaaataaacaaatatacacataatatatcacttagtggtcattgctatgagaaaaatagaacaaggtaaggggaatagggatttcttttgtgggggttggaggggattgctatgttgtatgttatctttaaaggagcaagcgctgtaaatctctgatccaaacctcatatccaaaccagatggtaaaaagacttttagtaggaaatctaacgttttgagagacccatttgagacccaagaccaatatttttcttttcctttataagagacatactagtttatctctcttttttgttttttgtttttgtttttgtttgaggcaggatctggctctgctgcccagtctacagggcagtcgcaccaattggctcactgcagcctccgtcgcctgggctcaagccatccttccacctcacccttccaagtagctaggactataggctcatgccaccatgcccagctgaatttttgtatttttttagagttggggttttgccatgttgcctaggctagtctcaaattcccgagctcaagcgatcctcttgtctcaacctcccaaagtgctgggattacaggtgtgagccatcacatcatgcctgaccagtttatctctttgaaagaaagagtttgatttggattttatgtacagtaggtaaccaatcatgtcttgaggtctagaattcctcagatgcctcatttattgaatatagagtgatgttcttcagaatacccaagcttgtagtcttttgaggattttcacaagtgttccaatgactgtttcaaagaccagtttatctttcaaattctctttagcagcctttctttgtttatgaaaacattcctatccctactgaaggtacttatttttaatgatcttccagctgggcttttcttgcattttttggtttgtactctgtatattccttactttttgtatcaaactcatcaccttccctttaaagcatgtcttttttcccacagtttttggtctcttactcagaaactctatttctactaaaggtgtcgttttataaattttaaaacagatctctccgacttgtaaattctatctagttgccctgtttaaagtcactggatatcagaagttaattatatggttagtttcccatctaggcatgctctaatataattaagatggggttgtaagtataataagggtggaaatacttataatttcatgactttgtcactcaaaaaataaaaatcactcatcctaagtaatatgaaaatacattcttagatataatggtcagttttacatataagaaaataatctttcatcattccaacttctagtctccagaagagttctatttaaaaattgggatgaaggagaaagacattaatacttgaagtaccagatgttgtagtgtactttttgtatgttgtctatgaagtaagaataattatcccttaacattatcatgttacagtgaagaatctcagcaattcagactatttgcctggggttatgcagccattaagtgactgaagccaggattcaaactcaggtatatctgagctgacttcagagcccacattgcatccattatatcaaactgcctcatcaaatgattgctaggtattatttttttgaaataatggatgcatttgaaatcagagccagttctcagacattttcactgatgtccaaagtgctaaacaattttgtttgccttctgaaactccaccctgtatctctcagtccaaaaagcatactaaaatgcaacaaaagagtcacagagattaccttgaacctaccgtaatataaatactttacacactgaagttgataagtgttttgctttcaactactattagtaacaaatcactttacacacatctcactgccagtgtgatgaaatcccaggtttgagaactacaggataaaggagccattcccagacacaatcccctccgtttaatttatttccaataataaattagtcactaactggacagatatttgtttagctagaaaaaggaaaccaagctgcaaaattggagatttaagattgaatggataaaactaaaatggctaaaactaagcaaagatacttatgacagggtagatttttagatttcatagacagcctacaaatgttgttaatagacagtagaaggtaagtatatgggtgtttgcttttccattcttaggtgttaggatctggagggaattttaaaaactatttttaatttaattgaaccaaattggcttttttatacttcagtttttaaaatgctttagtaaaaatatctaagaatagttttaagcaatgtaaaacttgacctttcagaatggaaattatattaaatcctgtgtacttaatttaaaatcacagattctaataaatgttcatggttaactaaagaagtttagtgatagagattcagcatgctctgggcctgggtacctaatcgtaatatagtcccagagagtcctccaaagatgatgcaaagtagagaaaagcatgactccatggcctagcacctagaagattctattcatctttaggaactgttttgtttctattctttatagccacctattttcatttgcagcatataccttttctcagaagtatagagatgatgaaccaagttatccttactgtatttctatgacgttgtataagttagtaagttcctcattgaaaacagtgaaaaacttaaggaaaaaaaggtaattaagggttgcttatacattggtcaagaaaaacatcaagtacatttaaggagtacatttagaacattagaatccagatggaaacttcttcagcaaacattccaaaatagggtgttttcaagttatattatacaacatgtcacttaacttgtcctacaatatttttacttcagtagcagagtagatataattgtttaagattaaatcttcttggctagtgatttaataatccctttgcattttggttcatgattatggaaattaacttctgaaagggcttcttatttcagtagtatatattatcttagctataccacttcattgttatatttaatgtatggctataccttgaattttcattaaaagtttgtattttaattactcttaattattctaaatttcatcccttctgtctgttcttttggtcacctctccatcctaaactttagctgttgaatacttgagatacggtggtatcttatgattaatcttgcctcagtttctaactcttccaagctgttcttacatgtctaccaaattaatattctttaagcaatgctttaaccaaatcaagtaaacccgttactcaaaattttctaattcatttaccgctatctctcaacatagacctttagcgacgttggccatggtagcctagttgctggcctccatgctatcccaataatatgataatgactgcccagtgctacccaccctcttccctgaaagtttttctactaggttgaagatgaacccttcctaaccctattccatccctccagcgttccatatcatccatgttggtcactgatgcagcttagaatccatctcttccattaagactttttcttctattgaatgcacactgatcatttcctcttctgaattcttaactacattataaattgttgtatactttcctctttgattgcatattgccttcacctgattaagatgtgtatgttttgtcctaggtttaaaaaaaaaaaaaggataactatctttggagaaatatcctggacccctgctataggctctatacttgtaccagtacatcaagaaaaggtgtaatggtttagaaaaaatatataacagtagttatatatatttatgatctaaaatctgctatcttaaactacgatcagtctaaaaatttagcttactagctgtgtttacttttaacttgtcatagccctgaaattcccatgaaaatttaataaaggtaaatagaaaagtgattttattgtagatttaatgccttcatttcagtttgatttctctgaagttctagtcatgtggataggccagatttaagtctacattattcataattgttgcatcacttgaagccagcagactgtagcctcagctttacttcttggtgattttacagttttacttggcctttttgcctaatcattacttaagccctgagatttaatttacaaagttctgggaaaaaaaacttagaatatacttaactaggattgtgccttttaaagaacattgtgcttcttgactttttatactttttaagctcttaagacccagtgttgaatattatttttattataataaggttctgttataggctaatttgcagttaggttaactattatcattgtgcaatgtaaatctaagtaatttttgcttacctcaccctgattgaagtcagagaagccctcttgaaatggaagggaaattaacatggcaagtgaatgatttgtttatactgtgcattagccaggctcattgtgattatattaggtgtcagtcagcttttacatattagacatggaaattgaatgatcttaattttgctcattaaaataatttttctgatgtatcagtaagattaaaatttttacattgaattttaatatctgcctgctgcttaattccagaatgatgaaagtgtattgtatgtgatgtacacaataccacttaatacaaatcttgctgtatttgctgctgattatacatcattatagaatgccatgatagcataagggaataccgcatagcagagagaaaaataatctaagatttgattaaaaggatacaattattctgaactgttacgtcatgtgggatttttttacaaagttttttcttttatttaaatcttgctaaggatttgaagcattcattaccatctggacttggtctctcagaaacccaaattacatctcatggctttgacaataccaaagagggtgttattgaagcaggagcatttcaaggtaagagcccatatatttgtaaagatggctgggatagaggatgggagaagttcaccaaatgctacctttattaataaagcacaagaatggagccctttcattctgtgataaaacattgattataaatgtattcctttttctcttcaatttaagtaatagaattatttgagtagtctcctttatataaacagatcaatgtacatgatatcactggttattatttaagaataggttataaaatactgaaataaaaacaaaaattatgtcagaaatgtagatgtagattattttaacttgtaaccatgaaatttataaatcaatgttgatttttataaatacatatttcttatttcaaagcaaatagaaaaatgaactttttacgttatataggaggtctccaagaccacactcattaaaagtttgtattttaattactcttaattattcctaaatttcctcccttctctccatacttttgaccacctctctatcctaaactgtagctgttgaatacctgagatatagtggtatcttatgattgatcttgcctcagtttctgactcttccaagctgttcttacatgtctgccaaattaatattctttaagcattcttttaaccaaatcagcaatttgctaggagaattcacaggacttacatagtgacactcatggctatgatttattgtaatgagagtagcaagcacgatcagtaaaggcaaaaagtgcataagctaagtctgaggaaaactaggcataagcttccaagagtcttctcccagcttaatcacacaggaattgcttaattcctccagcagtgagactgacaacataggtgaaattttgctaactagggaagctcatttgaaactccatgcttgggatttttactgggggctgatcacataggtttctccatctgttacataccaagattctagacttccagaaggaaagcaggtaagcagcataagccacattgcaggtaaacagcttaagcacagtgaggcactcgtaatcattctggcaatggaggaaatcctcccaaaattcaagttgccgcatgccagcctttttaaggatagcagttagacctgctgtgttaactcttttctgcacacatctcatatctatgtctatttttaatagaaaaatattggctcctttcttaatgcttttacttgtgataacttttttaaactttttttttttttttttttttttactcgagtgaaagtaaagccgtgtaaacatttagatgtgggaaatagattttctggacagtactgtaaagtagtagctacagtttatgttcagttcaattaagcacatattaattttaatgctgcattacattttacaaaatgaagaaacaattatgtccatgcctttgtaaaccatagccctcatgcagatattagtattctgtattttttttttttaaagatgtagtctcactctgttgcccaggctggagtgcagtggcatgatcttggctcactgcaacctctgcccccgagttcaagtgattctcctgcctcgacatcccaagtagttgggattacaggcgcctgccaccatgccgggctaatttttatatttttagtagagacggggtttcactatgttggccaggctggtctccaactcctgagctcaggcagtcctcctgcctgggcctcccaaagtgctgggattacaggcatgagccactgtgcctggccgtatgctgtattttttattgtacagttggccaatactttatttaaagaacagtttagattttgaagtatattctctgctatatgggtcctggaaatagacgtttaggataatccagtataatatcctctcctttaggctgtgaaatgaatggactgtctactgacatcatttttttctcttttcatacttatgtttagaaaaataaagggagcaatcacgtcagtgtcttagtagtcattctgaagcatcatggcattcttatatcagggataattttgaatttggaagggctgactgagtacctaaaactaagagtgctgaaaaacgtaaggcttactttgcataatttggtaccattttttgactaatcaccaattctaaaatttaaatgtcaacatagaataaaaaactaattttactattaagatattttaaatatatatattttttaattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgttgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaaaaaatgaaatgtctcccatgtctacttctttctacacagacacagcaaccatccaatttctcaatcttttccccacctttcccccttttctattccacaaaaccgccattgtcatcatggcccgttcccagtgagctgttgggtacacctcccagacggggtggtggctgggcagaggggctcctcacttcccagtaggggcggccgggcagaggcgcccctcacctcccggacggggcagctggccgggcgggggctgacccccccacctccctcccggacggggcggctggccgcgcgggggctgacccccacctccctcctggacggggcggctggccgggcgggggctgacccccacctctctcctggacggggcggctgtcctggtgggggctgacccccacctccctcccggacggggtggctgccaggcggagacgctcctcacttcccagacggggtggctgccaggcggaggggctcctcacttctcagaaggggcggctgccgggcggagggtctcctcacttctcagacggggctgctgggcagagacgctcctcacctcccagatggggtcgcggccaggcagaggcgctcttcacatcccagacggggcggcggggcagaggcactccccacatctcagatgatgggcggccgggcagagacgctcctcacttcctagatggatggcggccgggaagaggcgctcctcacttcctagatgggatggcggccgggcagagacgctcctcactttccagactgggcagccaggcagaggggctcctcacatcccagacgatgggcagccaggcagagacgctcctcacttcccagacggggtggcggccgggcagaggctgcaatctcggcactttgggaggccaaggcaggcagctgggaggtggaggttgtagcgagccgagatcacgccactgcactccagcctgggcactattgagcactgagcgaacgagactccgtctgcaatcccggcacctcgggaggctgaggctggcggatcactcgcggttaggagctggtgaccagcccggccaacacagcgaaaccccgtctccaccaaaaaaacacaaaaaccagtcaggcatggcggtgcgtgcctgcaatcgcaggcactcagcaggctgaggcaggagaatcaggcagggaggttgcagtgagccgagatggcagcagtatagtccagcttctgctcggcatcagagggagaccgtggaaagagagggagagggagaccgtggggagagggagagaggtgagacgggagaggggagaggggagagggtctcgaaacaattacttgtaaaagcaatcttttaaatatttttaatgaaattatttagctggcatttttccccttaaagttattgtataatggtattatacaataattgaaatcagttggccatcatgaactgatatacatgagcattaaaatgcccatcagtttcacttgcttatagatacatcctaatccttccaattggaataagaaaatatatttcgtgataatggcagtaatatatgtctctctgaactgagtttgtaaaacattttaaaatccaaactgtattgttgatcagtgtattaggaaaataatcattctgctgctatacttaaattagttaagcatttgttggaaagttgtgattgttttaagatatatgtagataaattggaatgaacatgagaaagaataacatacaatggttacaatctggaaaataggtcttatgaaaaaatgttaaaggaattagggctgtgttagctctctggaaagatgactaaatgataaattatgactattgcttaaacagttaacaagaagagtataaccatctactttttcatctatctagagcaaattaaaaagttatacttaaattcagcttaaaaacaacaaatattgaaatcggcctagcaccaaagatgttgcagaatcagtaatagtggaaatcatgaataaatcaaagctcacaagagtgaagtgtacttggtaccagggttttgttttaatgggggtataaatctttgcacatatgtattcatctttctagatttttgttgttgagatgaaatagatttaattccccaaatttagccagttagtaagatcctgtattattgagagatcctgtattattatttattttttagttggtattggtgaatgattttggtaacagttgtttaaagggttaaagtattaaagatacagaaaagtgataattacctttgaaggtaaatcaaaaaagctgaagtcccagttacagccacactacatcatttgctattttactttgaaaatttacatatcatttgttatatatattatacacatcccatgtagtgctatggtttatttcttatgcaagattaagaaactgtaataactagaacaatagagctcctattcctggggtcaagacatggaagtacagtggtcttcttttattttacactttattttagaatcccttatgccttggacggtagagatacagtctttgtttaaaatggtgattgaactggataacctattaaaatgccttccaactcagcaagtaacttgtagattagtgatttctatattgaatttaataatggagatattatggtgttcagaacatctgagtctctaataagaaactattttaacttctctgggcttcattaatcttaccgtttaatgtgacagtttagttgatttccatcatcccttctggttttaaattttataatttaacagatttaaagagaaaaatatctctcattttgaaagttaacaacaatctatttagtttaggtctattgcatgtttgaattttaatgtgagatccagttcaagttaaggtatattttatactgttagaactcgtgacagtttctatgtcagaatttagtacatctggaatatgaccagttattactaatagtaaagaaagtagacatgtctttcttattaggaaatttaattatgtacttaatgcatgtattttttccagagaactggggaagagtgtaattgaaataaaagtacattatagacattaaaatattctcagctaaacatggaaggactttaatattttttcagttttagaaacctattactccctttttttgtttaatgctagacattagcaacaatgttgggtagtcagtgtttctttctttctttctttttttttttaattgagacagagtctggctttgtcactcaggttggagtgcagtggtgcgatcttggctgactgcggcctcctcctcctgggctcaagcagtccgtctacctcaacctctgagtagctgggactacaggcttgtgccaccatgcccagcaagatggtgttttgccatgttgcccaggctggtcttgaactcctgagctcaagcaatccatctgcctctgcctcccaaagtgctgggattataagcatgagccgccgctctcagccagtagttaatgtttcttactttgtagctaattaaggctcagagatgtttagtaatttgccagggtgttcctgatatcatgtggtagatagagccagaattttaaactcagtgttagaatttaaaacttagttgtgtttcattcaaaaattgtgttgtttcctctggttctcaaacttggttgtgtttgagaatcatcttgagtggcttttgcaaaagaatagatgcctgtttcactgataatcagtagatctttttgagtatcgcaggtatgttttaaaagctccaaaagtgattcttataatgtcaaaaaatattctacatcagcacttctcaaatttcaaagtacatacaaatcacctggggaaatcttatgaaaatgtaggtttgggttcagtaggtctgggcagggtctgagattttgcatttctaacaagcgtccaggtgaattgaagaaggtcctctatgtccacattatgaatagcaatgagacacactatgtgacatttgatttgtgatttgaaatttttggctacaattcctgtgaaggctgtagttcattcacatttcttataagagatatgagagcatgttttaatatcccttacatgcctttgaatttttacttgaagagcttttcctttatatatgagagtagcaagttatgaaatatttactgaagctttaaatcatccagctatgggactgtattcacattctgttaactgattttggaaatagtagagtccagttaaaatcctggttagatgtcatctaccagatttcattatatagttacatattctgtttagttttgatagtttgatgaaaagtttatataaaaactgagcctggtagcatacatttattattagtccttccctgaaagaaaacaaatatattaattccaacttttaatcctagtgtttgaatattttaaaggaaatatcagtaaccctatattcaaaatgtacagtatgtggaggaggaaaaggattttcacagttaaaatgtctaccttttcaggttccccagcaccgccactgccatctgttatgtctcctagcagggttgcagctagtcgactggctcagcaaggaagtgatttaattgttcctgcaggtattcactgcactgattggataaagcacttattgctactgctgaagctacactaatttactcagtttcataatcacttgctttatattcttaggtgtgtgtgattctgacttttttggtggctgccttattaacaataaaggaaataatttttctaactgtatcctatctttgtggcttttcagaataattcggctgtatctcacacctgaaacttaatccattttaaaattaaaacattataaaatttgatttgctttaaatcattctttctttgctctggaaattgtaggtttactgtttgatcctaaactctcatctttgcagctctgccttctattttcagttaaaggaaaaacaaccttcaacaattaggttggttgtttttaagaatggattaaatgaaaaaggtcttgtcttcttacttttagctttaacttacaaatagtttgcagattgcaacacaatactgttaatttaccagttatacccaatgaaaaatacttgggaaaatcagtatctttacattcaatttgctctgcactttaccgttactggactataaaaatgggagaaaaaatgaactccacgtttcttcttatatgaaatgttaacatttatattttgttttgtgagaattttgtaaattcttaaatgtgttctattttatataccattcttgttctcggactggtaaagctatgggaaagattggtctgattataggaataagtgagagaagaaatttttggggatttttactgggggctgatcctaattttttcttttccttatttcattattctttttaaattattagaaagtttccatccaaaaactgaaatgaaaaatattttgactatgaaaagtattttactattaagaactatatagttgtagagttgctttcatatcaaaaattcttaattgttggaagagtacattgtcaggaatttacactgcttctttattcattatggctctttttggttttcttaccttttttttgtggtctcttgagaaaaaagaggtacaatatagatcttgtttcaacccagcctttcatactagtgatagcatatctttaatgactatttgaattgaactactgtatgaaatttgaattatttttttcaaattctccaaaattatagcaacattctattgttgttgtagtctgcacattacagtgaaagatcactgtggggaatacgtggccttttagatttttatcgaccaagatacttcttttttagtgtcattagtgtataaaattagttgtggaaattttatttttcttgaagtaagcggcagcttatatagaaaataaggctgattgcagcaagagtttttttgtttgtttgtttgtttaaagaagacagataagtcacatggcatttgtgtttaatggacagaagtgttgtttaagtaattaggaaactatcctcagcgattccaggaagttctagttctttactttgtgggaacctttttttctttttttagatgcataagaatttcaatttgaacaatatcagggttttgttttctttccctgcttgtcttcatctggattgtgtttttatcttttgttatcttgcaggtggccagagaacacagacaaaaagtggaccagttattctagcagatgaaattaaaaatcctgcaatggaaaagttagaacttgttagaaaatggagtctaaacacctataaggtttgtaattatttaatgtttccaccctaaatggctctaaaaaagttcatttatatgtttattcaagtcattatgttgcaattaaatgcacatagagaagagaaaatgccatctaaacatggtagaaatacagtttgaaaatgaagtatttgttttatcattgatctttgcatgtaatttaagaatttagtacaaaagagtaaaaaagctattaaaatgcttattaaccgataatgtacataattgaagacatgtactgctttggaatttatttagctgtagagctactatagatatatttgctccttcccctccttttgatactttataggagctgaaggtgaagagaggtatattagttctccaaagtttgaaattctctgattttactataataactaagcattaactatatgggcaacaccagattgcaaattagttgtgtttctaaagtttgttaacattcttagttgcattgcttcagagtaattggtgattatttttcttatgccctccataaaacaaataagcaaattatttaacccatattgtatttgatgtattacaaacagctcaacccccaaatccacttagtaccttttgaattttaacagggacaagactgtagaattcgtggaatagttaggatgaaagccctagcagctcaggttagaacattagccacaattctccctatattcgtgaactgattgtgggtctagtgattggtaaattaggaattgtctgtatttttatacagaacaggcctttcttacatcttctcaacagtaaaacagaagtgaatttattctttcagttaataccttaaaaatatgatgtagaagtcttctacaaaagtataggttttcttaagatggtaaaacctccctgaaacatgttacatgaatctgtccaaaaattatttagctcatgaaagtgtagaatctgagaaatcccagtggtagtcttcaaaaagtgatgcttgcttaaactaaactcttcttctaaaatattcacggatttctattgcatcttcttgctgattccacatagccagtcagtcgttaagtcctatgcattctgccttcttaatattctttcaccttttccccgttctcctccatcccagccttcacagccatagttcatatttattactctctcacattactgtaacagcttcttaaccaattcgctaagactacatgttcgaccctgcctaacgtgggttcgctcctgcttaaaatccttcagtcaatccccactgtttttagagtggcatgaatctgacctctatctacctttcccactctgtctctgcctcttttctatctatggatcaagtgattcataccaaatttcccagaaacttcctaaacaatctgtgctttctcatacttctgtaactttgttcataagactatatctgcctcctccttggaattccctttcattttacttgttcatctttcatactagactgagcaagtttaagctttttgttcatttgagtcttcctttcatgttgtttagttgatgttttcattgttcattatctatttgttcctatgtgtttatgtgttattatctgctattcttgcatctcttatctctacaataatctgaattgaatcactattaagattccatatttatctcatattgatatgccacatttagcctattaaaaatttgtgttaatgaaaatgacaactctttaaaatgttatacatatggtatagtactatgtgaaggaggcattattttctttaaaccttatttttaaatgacaattttttccattagaacttaacttggatattttaatctaggtcaaaaaagaaaaagaaagtatctgacttacatgattctgtggagttaatagtccagtgtgtccaggctgacatattccactcaaccaaaaaaagttcatagtgtaatgacctcatggggtctgcatgactctctgtgttcttactgctttttgagcttctcagctcaaattttagctaatgttgggcattcactatcatttggataatgcttcaaatactgattctgatttggttgattcaggactgtgcttgttatccatttactgtttgtttgtttgtttgtgtagataggtctcactctgtcactcaggcttgagtgcagttgtatgatcatggatcactgcaaccataaccacctggacccaagtgatcctctcacctcagcctcctgagcagctgggatacaggcaggcatcaccactcctggctaatttcttattttttgtggagagcgagtctccctatgttgctcagggtggtcttgaactcctgggttcaagcagtcctcccacctcagcctcccaaagtgcagggacttacaggtgttgagccaccaagcccggccccattttactcttgaataacttgattctggctatgtctttggtcctctctctttcatgctttctacctttaatttcttcggtttctattctgtaacaaatgctttaatgcttttccttaaagggaatatttagcttcatttattggttgttaattttggtcccaagaccaacatggtgattcaaagcaaatatataataggagcaattttaggtttagacattgaacctatcttcttaaatattattttaatctacctgattttattcacaaaatttgaatccaaaatctattttcttatttattttcatctacagaaatagttgaaataataaactatggtttacttaagtttttgatttttattttttcctagtctaaagtagagtgctttttgaagtttgtctttttttataaaaaaaaaaaaaaaaaaaaaaagaataatctctcagtttcagcattcagagctatttggcatctttcccaaacttttttcttaatgtttaagaatttgccattagcattcacacccttatcaagttaacctttgatgtctttaaaccagtatcttttaaactttcatgcctgtttttcttgtcatgttgcctcattcatttattggttgacttacttcccctgttcattttccttttgtgctaccttctctatcccttaccttaataatccttgttgtatctgtcaattgttgccataagtttattcttttgcttgtacttaaatatctttattcttttttttttttttggcactacagaagagctcttggtgctatttgatagggtttggctgtgtccccatccaaatctcaactccagttgtatctcctagaattcccatgagttgtgggagggacctaaggggaggtaattgaatcatgggagccggtctttcccatgctattctcgtgatagtgaataagtctcacaagatctggtgggtttatcaggggtttctgcttttgcttctttctcattttctcttgctgccaccatataagaagtacctttcgcctcctgccatgattctgaggcctccccagccatgtggaactgtaagtccagttaaacctctttttattcccagtctcgggtctgtctttatcagcagtgtgaaaaccaactaatacagtaaattggtaccaggaatgggttgttgctgaaaagatacccaaaaatgtggaagcgactgtggaactgggtaacaagcagagattggaacagtttgaagggctcagaagaagacaggaaaatgtgggaatgtttggaacttcctagagatttgttaaatggctctgcccaaaatgctaatagcgatatggacaataaaatccaggctgaataacttattgggaactggagcaaaggtgactcctgttatgttttagcaaagagactggcggcattttgcccctaccctagagatttgtggaactttgaacctgagagagatgatttagggtatctggcagaagaaatttctaagcagcaaagcattcaagtggtgacttgggtactgttaaaggcattcagttttataagggaagcagagcataaaagtttggagaatttgcagcctgactatgcgatagaaaagaaaaacccattttgggggagaaattcaggccagctgcagaaatttgcataagtagcaaggatcctaatgttaattgccaagatgatggggaaaatgtcttcaggccatgtcagaaatcttcacggcagccccttccatcacaggcctggaggcccaggaggaaaatgtggttttgtgggccaggcccagggtccctgtgctgtatgcagcctagggacttaatgccctgtgtcctagccgctccagccatggctgaaaggggccaatgtagagcttgggctgtggcttcagagggtggaagccccaagccttggcagctttcacatgatgttgagcctgtgggtgcacagaagtcaggaattgaggtttgggaacctctgcctagatttcagaagagatatggaaatgcctgggtgcccaggcagaagtttgctacaggggtggggccctcatggagaacctctgctagggcagtacagaagggaatcgtgcgatcagagccccccacacagagtccctactggggcacctcctagtggagctatgagaagagggccaccatcctgcagacccctgaatggtagatccaccgatagcttgcaccgtgtacgtggaaaagcctcagacattcaacgccagcccatgagagcagctgggaggaaggctgtaccctgaaaaggcacaggggtggagctgcccaagaccatgggaacccacctcctgcatcagcatgacctggatgtgagacctggagatcattttggagctttaaaatttgactgccctgatggattttggactacatgggccctataacccctttgttttggccaatttctcccatttggaatggctatatttacccaatacctgtacccccattgtatctaggaagtaactagcttgcttttgatttttacagactcacacgcatctcagatgagactttggactgtggacttttgggttaagactttggctgaaatgagttaagactttgggggactgttgggaaggcatggttggttttgaagtgtatggacatgagatttgaaggggccaggggtggaatgatatggtttggttgtgtcctcacccaaatctcaacttgagttgtatctcccagaattgccatgtgttgtgggagggacccagggagaggtaattgaatcatgggggccggtcttgtctgtgctattcttgtgatggtgaatcagtctcacaagatctgataggtttatcaggggtttccgattttgcttctttcttattttctcttgccaccaccatgtaagaagtgccttttgcctcccgctatgattctgaggcctcccagccatgtggaactctaagtccaattaaacatatttttattcccagtctcaggtatgtctttatcagcagcatgaaaatggactaatacactacttaaatactcagagtacacagttgactgttgcataaattcataaaccagtataatgctgattcatggtattttgtacactatcactgtatttcacccaccctttcccaagtagagaatctacataggtcagtaatttactttagcttccttttgcctcttgaatttagcatcatttgtcctgttcttcaaaatgaatttttcatttatatggaaaactgaataggaccaccagctcattgtaagtgatctccattttcagggactctgaggaaggttaaataatttagattgttaattctcttccattttgaacttgctttataatatatactgatctccaatattacattttatttcagtatatactggaaagcaatttaaataaaaatccactgtagagatcatctaagacacttcctctaggaccctgatgagttgggaaattggtggcaactttatatcttctcactacaacttcctttacaaagcttcctgtaggaaatctgtagtactctcatttccagattctttaggttttgctgaaaagtgtagatttatcagattggaatatatgtgaatctagttttacaacttctttcaagtgtccagtttatcttaatttgccttataatcagtatcatcttactcttcccactgctttggcttcctggaaacaaaaaacatttcctcattaattcttcacctctatgcctgcttgtaaccgttatttctgtgggggaaaaaaaggccactcagacagcagtgagtacatttctctcactgtgctaagaaacaatccttcttcaatgaattctgacttaatggattattatatctaggctgttgtgacagtaccacatgctttggcttttgaatagagtaaatgtctctgataatattgcatagggaaaaccctggtgtggaagaaaaatatgggaataagtgatgtatctatctcctttatcttgttaaaatttctggcattatttcttgctgatggttttcttgttaaaatcacatcttcagttcaagtttctcttgtgattttcattttctaggagtgtttgtacgttttccacagtaatactttatccccttccgtggttttgatctctcacccgtcctgttatttgtgattaaggatttctctacttttaaaaaataacactcttttgttaaaaaaaaaaaaagtttataaggctccttagttgatgagaatagaaaatgtgttgggaagtagaaaaatatataagcagatttgtgtatattgacaagaaaaagtctcagattattttgttcatagaaaagaaatattcaggatattatatatagcataatctcatgtttactctaaaaatatctgagattgtatatgtttgaaggaaagtctagtatacctatcagactgttaatagtagttttctactattcagtgtgattaaaggaagaggaaattcacctcttatttcatgcattattttaatttttaccacagacattaattctgtaaccagaactttgaagaacatgataaagagcaagttttaaaaattgtagtactggccaggtgcggtggcttatgcctgtaatcccagcactttgggaggccaagacgggcagatcacttgaggtcaggagttcgagaccagcctgaccaacatggagaaaccccgtctctattaaaaatacaaaattagccacgtgtggtgtcgcatgcctctaatcccagctactcgggaggctgaggcagaagaatcgcttgaacccgggaggtggagattgtggtgagctgaggctgcaccattgcactccagcctgggcaacaggagcaaaactccatctcaaacaaaacaaaacaaaacaaaaaattgtagtacttatttactactttttaagaatatttctgataacatttaatgatgaggtatatattaatgccccagttattcttaaaatgtattatcgaatgaagttgagagtaaaacattaatactaggaaacttatttccatgtgctttgaaattagatactttttaaaaattacaggtttctaggctgagcacaacggctcacgcctgtaatcccagcactttgggaggccaaggcaggttgatcagttgagcccaggagtttgagaccagcctagccaacatggcaaaaccccatctctactaaaaatacaaaaaattagctgggcttggtggcgcacgcctgtaatctcagctacttaggaggccgagacatgagaatcacttgaacctgggaggtggaggttgcagtgagccgagattggaccactgcacttcatccagcctgggcaatagagagagactccatctcagacaaaaaaaaaaaaaaattataggtttctgtattattatttctggggcagaatacaataacataacatcatataataccacactgtgtgagtaaaagtaacttagtagtttctctctcttcctcttcccccccgctttcattccttccttcctgtttcttctttctttattcctcattcatacacacatatatatatacaagtcatttaagggggaagatagaagtaaaagagcatttgaaagcagtaggagagtagtattttggtgttcttattattcctatattaacagtctatattagtcttaatgccaaatatctctgttttagataatctacccaaatgtactaaacttgcaaaataattatgtgagagagttcttatggcagtatataagtttgctagatatgtcttaaaacttcctttgattagtaataattattagacacatctggtgaatttactttctgagtcctgatcaagtaagggagctgacaattttcagtttgttacgctagcttgtttgaatccaaaaaatggtgtatgccatatgctctagcatttatattttgttttgttttttctttctaaacaaaatgcatcttccacttttagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgtaagattattctaaataactattagggatgggagaaaatgataatagaagtattctaagaggtaatttgttattgtgatttgctgaactcttaatgaagatggaattctgagattctcttttaagatatttcatatcactttaagaaggccctcttaaagtgatatgacttctgttaactttactttttatgaattatcatatgtatataaatctttcatatttttcttcctgtttgttaatattttattttgccttttactccttaatcaatatcaagggttactgttgtaatatgttctgttaactttttctaaaagttgtaaaaatgttgttttctgtattattctatttccagtaacatttatgtagacttcagtgaagtgtgtaacttagcttgtggaaatttggtgccaaaaatcttaagctgtcctgcttttcattttagtttttacatgcattgattggtaatctttttatgtggtcctttatctgccaatatttgcaacaaatcaaggtctataatattttgaagactgagtacagagtggagttacatggacatctcttaaatggaaaatggttttagcataataaggataattttactttcctgctattttctgaattattgaatactttgtcacctaagaaacgtaattacagctattgcaatagcattaaatttgtatcttctaatattttagttaatttaatattacattatttgtttcaactgaaattgaaaagtgttttgtaacaaactggagaattatcaaattaaatgatacatcttagaatatgtgatcggttttttatttggttaggtgcatcctgattaatctgttaattagtaaaacttgcactggaaagctttcactgctgaatatacagagctagagttagttcttgccatatctgaaggagtcatgtgtaatgtttactgcaccaagatgcagtttattcaaaaagaatgaactaaagctggtgttgagtgatccttcctcagttgtgtgcctaaatagagctgagcttgggagtcagctagtcaccaagtttacaaagaaatatgtattgttaatatttatactttgaggagaatcagtcaaaacacaaaaaaaatgcactttgttttatgtctgaaagttttaaccaattattacctaatttggctgtgaaagttatagtttctctgattaataatctgctctatttttctttccaacagctgtgcttatagtataatagaaacaaaatgtagaaatgaaaatattgtttctactacaaagtaacttaaaaaaattatttagcttttaggtatgtatctgagctgatgacaattttggtttattagactttttcagtaattatatggctagctgtgatttcgattcttaaagacggaaaggaaaagtaaaactgctacagctagatctctatctaaatcacatattttcccattagtgacgtgcttgagatttttaagtcacttttactgatttattactgaataaattaaggtgacttctttgttttaggaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggtaaggtatacattttcactgtgttgtctgttttacagatggcatataattcagttaattttttggttacaaacaacagaaaccaactctggccaatatgggcaggaaaaaaatgtactggaaagttataggatgcctctacagacctggcagaaagggagagaacaagattctggaaacaaccaagaaccaaagccaagttaagcctcagaagaatctaattagaacccctatgctgggtgcctctagtacttgatgctgccacagctaccataaataatttcctaaatacccatgaatacttgcttcattgccttgagattatctaattgagccttggtcatgtgcccaaaccctgccttctagtgagtagggaaatggaggatctcccagctctggcttctttagaagaggacagggccctatgttctaccaggtaggtattacatggtcctctatactctcgcctaaatttacctttcatccttattaccactgcttccacaatagccagacccatactttcagtttctattgaataaataagctcattttgcctccatgatttttgtttgttaggatatcagtcatcttccatttatccagattataacaagccttcaaaccctttcaaattttaccttttatataaattaaatatttgacttgtattttgataactgttcataatgcagtgtttttatacatcctattttaatgggtttttgtatatccatattcatatatatatgtatatatacagtttccctgtctcataactatcctgttaaatggtgaacaaaatatatattaataaatatattaataaatattttgaagggtctaaaatatggcagacctataatagcctttttcaccttttgattccaggcccaattttttccccatatgccctaccccttttatttaagtatcattctagtcccttttgaggtttttttcttttgagcactcaaaattcttattttccattatactttttatgcatagttgaagataaactttaccttttagaaggataactttactctttggcctcttatcctagtttaatggtatgagaaatacctgtaaaaaactccaaactcatctagtatttttgcaattgagtgcttattaaatatatatttccttacacttcaattaagtaaaagcccaaatcattttgaaaagttaatttttgatgttttcacaggaagagatgcttctgtcccataccatgtttattttgtcattttccatttagtattaaagtatgagattcttattgacttgaaaatgaaggtcaaacagctgtggttgtatggaggggtaagggtgaggatagctgttagtaagatagccttccgtggaaatctcttcaataacattctcagtaattggtgtttcagtctcagtgtaaatcctttcatggaaattatatttttcaaagggttcattatgtatatgaattttaaaattcatttatataagttttacttgatccttttctaaatttttctgttccttgttcataatgtcctaatttgttcataatggtactgtttcttttatctctaatcattttaaatattcatattttctagtccttctgattgttttaacatgtatgggttttaaagatggatattgttttcttccaaaaatacccccaccacctcctagttgagaactttgtgaatctagtttctctactttgcaattgtctacctatcctgaaatatattttcgttaataataatctctttcccttcagcttttatttctaaacagtttataattaatttgtagaggagaaaacactctagaggttaaatggtttgctcacttgtagtcaatttcaaaggcaaaataagaacccattggttctctatggttcacattttatcagtaggccttatacctgagtattagtgccctaagtataatgtggtataagatctcagattataaaatacagtatataggttcatttggaacttttgaacaaaattataaatcaagttacatgtacttggtggctggtttcttaagggaaacccttacacagcctctgtgtgtactttaaaaaacaacaacagtaatgttgtttttgttttatgtcatcccgtaatttatccttttttattcaaattacaatgtatgatcttattcattaagcttagcttggggtttgacttttctgttgtttatgaaatagctgtggaattggctagttgttaacactaaaaccttgcctactgatggataatagtcaaaaagaatccaaggttaaaagtttttcagtagctgaatttccttctctgtcaaagccagaatttactgacttttagggcaagggtcatctatttgatcagtgcaaaaagtggtaatttaggcaaatgcccgagtggccttttaatcctccctattatgcattgtgtacaagtatttcctagccctctggtgcttcatgtatagaaaatcttgtaacagcccattcaacacttctccacagcagcaccaacaagggagtcaattgtggtcgagacttttcagatgtggacacctgttctctagaagttttacataagccataaagtaaccgtcactaactttgttgatacggactcagttcagacgggcaaccttgaagtgaagttgctttttgaaaacttagtgagcttctcttcttggtggtaatgagcactgttagagaagctattatggaaagttttactttggtaccacctacaaactctgaatgtaaaattaagaaatataaggtcagtattataactttgaatatgtttgagttaatcactgttgtttagaaatgcgctccaaggctattgaaggatatttgtccttagattaaatcaccatgtattactatttatttagttctacttttttctcttttatttcctattgtttttagtgtgcttgcttctagatacccctcttctaatttggccataataataagcattctaaaggtatcagttattaccaggtatcctgtgtgttttatctatatgaagtttttgtggagatttttgttcacatttatagattgaaaaactggagcacaaagagatgaaataaccagctcaagaatagagccaaaaggcagagaggtcattcagcttggctcctgaacccatggatttaactaactagttattattgccaagtcagtcttgcctcctaaatcttttgtatttgtctccttagctccaatgcctttgtcctgattcagtgactcatttcttatatgtccatcgttttctaataggtttccttgctcctgattttttaatcatttattctatcctccatctcttacactaccaccagggtcatctttctatcctgatacaatcatgtcatttttatgtcagatcaacattcttcagtggcttcccattacttctcctactggattaaatttaaacactttaacatggcctgtagggctgcttactttcaatcctgcctgcctgtctaatgttaattccttccattgtcatgttccagcttcagattctgacataccgaattcccaaatgtgtcattgtatcttacaaatctatgcctttgtccatgctattctcttcagaatcagagtatcctactgatttctgtatcccaattcacctagccagcttttaccatccttcaaattttaattatagtattttaattctgtctgagataccttttcagatatctaattaaataattattcctcttgatttccattataccttaccctcatttatggtagttcttattatctcattttgttgtaattgtttacaaggttctcttcctctagaatgcgagcttcttgaggataaacatatctgttcatctttatagctctactttctaacacagtgcctggaacgtggaaagtgctcacttgagaattgttgaatgaatcagtgtatcagtgaatgaatgaatggttctcttttgaccctgaaagaggccaattaaattaaatcttaactcatactgctaaattcagtatgagttaagaataaattaggatcagtgtgaaggactgatgtattctttctcaagtcatatatacaatatagattatgttatttaaagtattgttaattcccagaataggagatgtgaattatacacctaatatctccaaataaagagctttagttttagggtataagctttgtgattctgatcttgactaaattagaggtcactttgcttcttctttgctgagtaccgaatagttgaagctgctggataaatcactgtttaataagcaagatagtactatacttagacaggcactgtgatagagctattatgaggagttatgggatcttggagtgatgacagtggtggggtaactatttgagttgatggggggagaatatcagagtgaggcatcttacagaacacaggatggtaagtgctctacaatagatactgttgttacattctgaatactgatgttacagaaattcatctagagttgtgttgtcaagtatagtagccacacatgtctggtgagcacttgaaatgtggctagtctgaattgagatgggatagaagtgtaaaatacacagtggatttcaaagactcactacccactctccaaatgtaaagtacctatgaataattctgttacattgattacatgccacaatgattaatattttagatatattgggtaaaatgaaatatattgataacaggtgaaattaattattatttcattgtaactactagaaaattttaaattacatgtgttactcacattacatttttgttgtgcattgctaacccagacttttttcagaaccatttacacttccgttagttttagtatgccattctagagtctgctgtccttacctgctttgcctaatcagtactaagcaattcacttggggtatttattctacccttgatcttgttttgacatttattttttttaactggtttttagattttggaaattttacttgtcagttaatactgtgctttgagagaaatagttaatgagattaaccagcagctttgttcttatttaaatagctctttgtttttaaagaaataatgatttcaaaagcgtcaagtagaatatgtgtgagaattttatatattttattgtatagtatgagactgaatattacgtatttccaacccattttttgaacatactttactgttcttgtagtatgcttcacttactctcttctttccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggtaaattctttaccttctaaggtctttctgtggactttgaagtcaccctaaagagagatagtcagtttttctgtttctgttaactctcttgtatgacaattgcaagaaggaattccatttgtaatcagtgtttgagtttttagaagcatacaaaatatatttacctttctttgataaaagttatcaatgccaccgtcccagtctttcacatataacacatggcaaaaagtatttgatggacagccattgatctttggattggcgttgatagcaagtgctttaaaaattgaaataatgatagattatgctctgaatattttgaagcttttctattaatgataggtacagatttcaggaaaagaactatggcattcttctcagcaattgataagtgaaaaatagctaaaaggtccagcttagggctgcagttagcataacctaggagaaggaagccaagagatccattttccacatttttttcatatgtgaacacatctaaggactagagcaacgagggctgaactggaccagctgtaggtttcagcaggaagtggattcatatactaataggctcctgtgttttggtttaagtaaaaggatggtttctcatgtttgacatatctctattacttgcatattcagctttgtatgcaggattgcagttctggaaatgggaaatgagtgagcatggtacggaataggtgtagtgcagtcctgaacagatgggtctcaccattgcacgttggtagttttttctgtgcatttcacatcctgtgaagtcatgacaggtcttcaactgtactctcttccaggtaccctcttaaaattgtttttcagttctctcaggaaacagtcatgtttatattctcctccataacatcaaagggcattttagtaaactataactgtcagtatcttattgttttctttaacatttccttagaaactctcatggctactataaaacctataaaataatatatttctttgggatccacctagtccagcactttcactgacttgtttttaagctgctatgggtgaaaattactcaccagaaaacattatagtggcaataaaggaaacctcagcagagttgttagaaaaattgcctggcatcattcagacagagcccagtgcagccttctggtattcattagctgagcacataagattgcattcattttagtcatatatatatatatatatatatatatatatatatatacacctatttttgtgtgtgtgtgtatatttatgtgtatatataaatatatatacacataaatatatatatactatatatacatatatatactatatagtatatatatgcactatatatagtatatatacactaatatatactatataatatatatatgcactatatatagtatatatacactaatatatactatatatactatactatatatactatatattatatactatactatatactatatatactatatattatatactatactatatactatatatatactatatatactatatactatatatatactatatatactatatatactatatatatactaatatatagtgtatgtatactatatatatactaatatatagtgtatgtatactatacatacactatatattttagtcatatatacatattttagtcatatatatttagtcatatatataatggatgtgaatatatcaatatttagataatagacattgtacattttaaatataaaaatatttttggcattccaccctatcatcactacacaataatactaaaagaggtatgctagaagaatatacgtgtttgatagaaaagtagactaacatagtgaaacataaggttcatgtgatttaaaggaagagtgaatcaaatggtaattggaagccagattatactaagccttgaccacatacagactttgaattgtggccttggaatgtgtacactgagcagggagggaagaaggagacactttcgtttacagagggagggaaggagacacttttcatttatagagccaggtcgtctctataaattttaaatgtcaatcagatgaatgttacttctgattttatcttgtaaatattgaagaatttttaaagttgagagtagcaggaaaaagtcatttagaaagtctctttctttcttaagggaagaaagaaaatagaagcacatgtactaattagggatcttttatagccaaatgaaatgattaagagcctgaactagggtctttgcaatagcagcatgaaggaaggaatatggtgattttaaggctgcacgacaggggtcggaaaactaaaatgggaagctggtgtggcctgaacggggtaagggtaaaggattgggaattttttctgtttgatccagtgtttagtttgagatgatgacagaatactcaagtggaaacaattggtaggaatttgatgatgtgtgtttagagtttggatgaacagggtcagggcttcagatataaaggcttggaagtcattgctttaagaataatgttattagtactattaaataaaaatagaaaattgcttctattctcaaggattttatgttcttagatgatgtcttcgtctttttgggctgctgtaacaaaataccataaactgagtagcttataaacaagagagaattatttctttcagttctagaggctgggaagttcacaatgaaggtaccagtgtctggtgagggcccaccttctgactcgtagatggctccttgctatatcctcacgtggtggaacagggaggggtccctcccattcctttatcatgagggcactaatcccatttatgaggactgtacctcccaaaggtgattagtaccttctaataccatcacattgagggtgaagatttcagcatttgaatttggcagggacacaaacattcagactgcagcagatagcatagatattctttgttttggctttccacagttgtcatcaaggttaagtttgaatttgaactgagtaatcagctatgtctaaagtaaaatctataaagaaactttggtctttgtatattttttatttaactcttcaaaacgataagtattgtcggactgttcttttaagtagtaattgtcatttagaagaagacagagatccatgagagaacttttctttgtttttttgttgttgttgagcaacgtttactcttttttgtttcttttaatagctttaaaaaggaaggaaaagcaggtttttagcctaggaactgtcatccctgtttgctttcttggtaatttgaaatgcctcaagtctaggttttttgttcttttgttaaactaggtgaatttgtacctcaacatctcttttatgtgtggttgccaggtaatctacttagcactttaatttgtttgttcgtttgtttgtttcttgtttttgtttgagaaggagtctcgctatgttgcccaggctggagtgcagtgatgtaatctctgcttactgcaacctccaccacctgggttcaagcagttctcttgcctcagcctctctgtagctggaattacaggtgcgtgccatcatgcccagttaattttttttttttctagtagaaacaggtttcaccatgttggccaggctggtcttgaactcctgagctcaggtgatccacccaccttggcctcccaaagtgctgggattacaggcatgagccactgcaccaggcccaacactttaatttgaagaaaacatagtatacttttcctatttcttccccccaaccactcaccatcctctgcttttttttaaagatactggctctcactatgtggcccaggttagatttgaacttctggactcaagcagttttcccacctcagcctcccaagcagctgggactacaggcgcatgccaccacatcctgctagtcatcctatttcttaacaggaagaaatgaaacatcaatgaatgtgctgttctgtaatttgataatgtcctaaagagtactgcagtatatacacctgtttttgcagcttttctctctctctgtctctctttttggctttcttttggttctcatgtcatgacttttggaatatcttttcataacacttctcttctaaaatgagaagccagataaccaaacaacgagaatagggcataaagtaaaagcaagtagtccttgagtatgggactaaaagccagccgtgtgactatagtaataagctttagcatttagtgtttttctttgttccctcttagaacttttttaaaattttgagacagatcaggagttaggttcttagctataaaattgatgtgtttatatgtacttagtctagcctttcttccgtatggcaaaagaaagaggtaaggtatgtaaaatactcacatttctgcatatatgtgtgataaatgcacctaagggtatttgtcatttacccttaatgaaaaacatgtgttgttctactagttatagttcgtattttctgtctcttcaccccgtgatttagttgtgtttgcctttaacctaaacaatccttattcatctctgatattctcttctttgtttactaaaccacattgagttgtgtagcagtaaagacatagctcatttgtcttctgatatttctcctttcatcagtatttcttctttttgagacctttaaataatgtaacttgagctattttgtgacttaaggcagtttgtttacctgttattgtttctttcagagttcaaaacaaaacataggctagtttagtaaagagaaagaataatagacatttctggtgctttgtagactttgtgagagtagataccatgctttcttttacagccctcataaagcctagcaatggtgcaggtatatagtactcattcagcaagtgcatgtttgccttcttcccagaattagaggcgcactacagggattggaaggagaaggaagtgaatgaaagtcaactcggagaggataaaaggcagaatcctgattacctcactctttgctttcatgaggccaaagcatagtctctcagaaatgcttctgttttctgcaatgttttctgtttgcatagaaagaggaggcaaaaagttaaagaaaaatatgcagatcaatgtaagcaactcatgttttttttttagatagctttttatgtggcttggaagtataaagatgtgaaaaaatagttgaaggttaattttttctttaaggtgactaatttaacttgggaatgataaatctcaagggcaatgaatatattgggagtgggatctgaatgtatcagaagattcaacaaagcagtttggggtataaatataaaaagcaagggttttattcttattttaagaagtgtaaaatacactcctactctaaggtaatgtcaaattagctataactattaaatgcaggtttgtttcattattatgttatattttagtgacttaaaggatgacagaggaggcagaagaagatgaaccagacttgggatctatcctggacacatatttgatttatatagctacttaatttaaaaaaatttcttaaaatttatagtcattcctaatcttagattgatatgaaaactgttgttttcactcacagtgtttcatatataatcacaatacagtaacattcctgtatattaggatttcttttctaatatattatttaagacgcctgtaatcctagcactttgggaggccgaggtggacggatcacttgaggtcaggagtttgaaaccagcctggccaacatggtgaaacctcgtctctactaaaaatacaaaaattagcctagcgtgcccataattccagctactcccaaggctgaggcaggagaatcatttgaacctgggaggcggaggttgcagtgagccgagatcgcgccactacactccagcctagatgacagagcgagactctgtctcaaaaaaaaaaaaaaagaaagaaaaaaatgctcaaagcctagtacttttttgtaaaaatacactaaaggtttggaaaagctttgagggcagaagtattctttgcttactaaaacttctctttgagaggaaaaaatataaacctcagaatttaaaaaatagatacttgttgccaaagtttaaggagcatgttaatacctaatgtgcacaaggagatagatacattcttgaaatctcttttcccattgtcaaaagaaaaagaacccctatttcttcttgagtactttaaaaatattcatgccagtgacttaatgtcacctttacttctaaagcaaaaacagtagtacttcttggtgtgtgctcctagggaaagtgagattaagttatataggtgaaagaactacctggttctaaattttaaaataagcatttatggattgatgtctgtaagcataacaagcaaccagggagttcatagtgctggacacaaaagaacctgcctttcaacactgtgccaaatattattacatacatttggattctgtgagtcattctcttattcatgcaactttaattccagacttaattttggctgtgactggtgctctcaagggaaggtacatggtcacttaagagtggttggggaaggccttcatgagggagtgatgccgaacactaacatcacttaatgttgagaaagtgagaaactgagaaccagagagtattccaggaagaaataccagcatgtgcaactgccttgtggcaggagagggtgtggtatggtgaaagaatgaatgtaactagagccagtttgaccagagcatagggagacagctggataggtaagtggtggccagactatgtagccctgataggccatattagggaaaagtttaatatcagtgggaagcccttgaaataattcttagcaaatgataggtctaaaatatggaggatagatcttagtagggcctaagagtaagtatagtggcttagacaagaaatggtaggaagttggattacaatagtgatagtggaaatggagtgaactgaaggcttcaggagatatttaaaaggtaaaacaaatataggtaaaacagtaacacagactgatgcataattagcacctttcacattttattcctttattcagcaaatattgatggagtggtctttttatttgtatttatttagttatttgagacagggtctcactgtgttgcccaggctggagtgcagtggtgcagtcatagcttactgtagtcttgaactcctggccataaatgatcctcctacctcagccttccaagtaactgagactactggtacatgccactgcacttggcctttttttttttttttttttttttttttgagatagggtgttgttctgtcatccaggctagagtatagtggtgtgatcatggctcactgcagcctctacctcccaggctcaagcactcctcccacctcaggctttagagtagatgggatgacaggcatgtgctgctaggcctggataattttttaatttttttgtagagacagagtttcactatgttgcccaggctgttttcaaactcctggcctcaagcagtccttctgcctcagcctcccaaagagctaggattataggcgtgagctgccatgccagatcttgtggattgctttttatatgccagtcactgagttaggtgatagaggtataatggtcttacactcatagagcttatagtcaagtaagacagataggcattaaccaaacaattacgtaaatacaagctgtggtaagtgtgatgaagggaaaatagaaatgtcatgtgtgtatacagaggacttggccaggtgtgtgtgttgcgggggaggggctggggtatcatggaaggcttccctgaggcagtgatattggggccgagatagaaagagagaggagtaaggtaaaggtatgtgatggaaggagattttaattagaagaaacagcatatgttgacggtcagtgaggccagagcataatgggaacaggggagaaatagcactggatgaagctggagaggtagtttagggcctacacaaaggtgaaataacataggtacaaggttattcattgcagcatcacttgttatttctacagatgagaaagaactcaatggttcagcagtaaaggactaattgaataaactggttttttcatacagtgaaatactttgcagctatttaaaaaaatgagaatgctaatgatagaaaactcctcaggacagacaattaaatgaaaatagcaaagcacaaagtagtgtttattgtacagtatcttgtatgtaagaaaagaaggaagaatgtataatcatattttcttgtatttgcacaaagaaaaacgggaaggattaataaaatcagttacctatagagggaacagggtgaatggaaacaggaatgaaaatgaaacctctcactgtatactttttatatctttaattttgaaccacatatatgtcttacctattcagaaaaataatacttttaaaaagataggaaaattaagttagctaaaaaaaaaaaagttagctagaaaatgtttcttaaatactgtgccttatctttttttccaaaatgagacttaaaatagacatgtatttcccaaatatagtctttaattttcctcttagctcaaaattagatgattaattctgtgttggtgagaatagaaaaagttaacttagaatgtgagttctgttgcaacatcattcttaaatgacagagtagaaatagtgcaatatcgtacctttcatttacagaagaaaatatcttaacatatggtgcaacatttgctgctgttagtggtttgtctttttaaacacacatggaagaggaaaaatttgcttgtggtttgcattgcctcctttctctctttagaaatgaggcagaaattaactgtctttatataaaccatacaaccaaaaagaattgtgagttgtaggttgatttttaaactagactcatccaacccatacctgtttggaataaatcaaggtaattgtaattgttgaagagtgagtagggatgaaagcctgagtgggtgctggggagaagcacacctagctaaccaattcatatagttttttttttttaccagttatgctaagattccggcatgacaatttttgtaagggagggatattttgtatacagtattgaaaagctttccaggaaggatagctttataattatgaattactgttcttatagacttggttcttttttggcaatcataaggtacttacatattttctaaccctttttggtcagaagctatcaacttactatagagtaggattagagtttcttattctgctgtatatgttggaggtgagggaattgttcctttcactttgaatgaaaagaattcactttaaaaatttactttttaatcattattgctgtgatgtatctgttctaatggttgatatacatgtgtgctcttcagatccacatttcacttattttgccagccttgggtattatccaacttgatttgccaggtttgtgataaaggtgagtttttaagtgatcaatgtgatacttgaacagatcactaataactgcattggttgtgctgttgatgatggtactgggtgcttatggctgtgactttgctatacttttttagttcttagtagttatggttccttcagtttgcttaaaagtaaaacctttaattagcatttctgagtaaagtctcagaagacactagcagtgtttaagaatttgactttgcaatgttctttttttttttttttttttgagacgagtctcgctctgtcgcccaggctggagtgcagtggcgcaatctcggctcactgcaacctccgcctcccgggttcaagcaattctctgcctcagcctcctgagtggctgggattacaggcgcccaccacaacgcccagctaagtttttggatttttagtagagatggggtttcaccatcttggccaggctggtcttgaactcctgaccttgtgatccacccgcctcgccctcccaaagtgctgggattacaggtgtgagccactgcgcccggctgcaatgttctttttaaccttttcttgaaattctctcagtaatgactcagcgttttcatgttgaccataatttccttccatgacttatctatactttgctgtgttagattaaaacattcataacttttttcctcattcctcataaacttaataacatcctgattttctatccttatttcttcccttaaattttcaaagatgcttttttaaaaattcaccttaagttttttaaggtgcttgttttgtgcaattatgcctgatcctaaagtactatataaggtattatcacagactgcctacggagaggcaacttacagtctaaaggaggaatttaaataaaatcaattatatataaaatgctaacttaaacatgagaaagaaatacagaatttgatgaagaaaaatgttagtgtgggctcaaagtacctggtaagctaggcagtttgacttgagcaggaccacacaagaatgggtaacatgtgcataggcaggaaagagtcaggaaaaaaattcttggagaaaccctggatcatatgtttaagtgatttgtaaacttctgttgaatcatctgttcccttcttgaagcacagcatactattactacttacaggctttttgaaaagaagagtaattgttttgtcctaacaaattttgataaggcttttccattggatgggccattggtttgactagttcctattgcccagtgtccaaaagctggtgagcacagggtctgctgatccctgcggtgacttggccccatttcgtcacttaccagatagctccagcagatctggatacctgagctttctgtttcttgttatctaaatatggaattcagtgattccctccaccccctccaacatctgcctacatatgtatcccttttttttggatttcatagggattttgtgagtacctcaagggacagggactaattctgaacttgagatcaggaatggggtaaagatctgagagaagttataggatgggtaaaaaaagaaaacattggtgggatcccctcctctttctattccctatgaccttgcatgctattcctgggatctcactacccctaactgtaactatggacttctgtgtggttttgtaaagaggattcagtgctgtcaagcccatgattgtcaaacttctctgttaggttaataacgatctcccaactttttttgagataactttatatctctcatctaattgatgaaatgaaatacccaattccttacctacccttttgtacctaaattgattttggactcggagatcagatgggaagttatgatactttatattttctctgccaacttgaaagtgtgttcatcccttcctcctccccatagtgcccaggcctttctccagttaaagcacataacatactatgttgtgattgcctgctagtcggtttttgcccctagaggtgctccatggagcacggccttcctacattgagtattgagttagtcagtggacactaatctttgagtactataatctgtaaatggaggaaagttgctataaggatttttatatatataatacctatatctgtataatatgtgatctagatgattatataccagtgcacagatgataatgctggggttcagagaggttgagtagtttgttcaaagtctcacagccagactgggattcaaatctagatctctccgactccacagccctgcttttagttaagtataatacaatgctgtaatgctgcccaaggtgagattgttcagatagcagagagagaagatggaaagataaccttggaaaacagaagctatattgatcacgtctaaacttggagctcttggaaggaaggaaggaagggtggaaggaagaaaaggagggagaaaatgagagagggagaagggagggagggatcaaagggcgggaactaacactgtaaaaacatagaacaaaaaaggcgaaagactttttttgctaaaggtgagaaaatctccgcactcagaatgttaatgtatgtaattattcgataaagaattataagacgtcaccacagttctgtgacctgctgttactggagtctataggtaatgtttcatcaattttcttctcttcagaactctgccttttgtttttccttcttaaggactttttttaaccttctgcttgtcagtgatttgttgaaacctatcccaatgcatcagaagaatgtaaaaacctatttttctaccccacttgtagttcatatttgtctttccttctctcactcccttcccagtgcccacacccatatttttatagtgtttctctttctcaaacagtagttgctttaacatgacaggcatttccaaagccattgcaaactaataaaattatactccacaaacctaataaaaggccaaggcaggtatattttcttgcctcttattcttctgatctctttctgggaaaagttcagtgatgggcagggaaagcatagaatggtatattttttaataggagtaaagaaaggagttgataccttacatgttagcggttggggacctcttaccaaaatatgatttttacacttttttcttacacacctttttcttacaaccagctactatcccaatatttttgtacatttaatataaacccctatttcatagaattattgggaaagccagtaactgctttgaagaacttaacaatcataaatattaggttggtgcaaaagtaattgcggtttttgccattactttcaatggcaaaacctgcgattactttcagtggcaaaacctgcaattacttttgcaccaacctaaatatatgaagactaataacttattttaaccaggaattgcttttttaaacaaatttagtgcctctgaataggaaggtcatataatctaaattttatttgaaaaaagttaatttggtagaaataaactgtcttttatattattttgatgtggacaaggtaatgcttatcattagttttttcagtcagtaactttgtaaatgttatttatgttctattgatacatgctgtgtaggcaagagaaagttttcggtgtagtccacttggcatcatctatcagttctgctcttaaatttcagttacctagtttctatttaaaactccagcttgtctttctgccttagtagtcagtgttagagtttgttttgccctttaacaatgaaagtattgtatgatatgtttaggtcactcaacagatgttgccgtagtggttttgctcattgtttggcagatgtttacgaaagttcttcataagtgagtttgtaatgatttagtatatttctaaattgctgtaattgtttctgatattaggttttcaaaatctgtcaaatttgccgccattccattataattgttacctctatcttcttttgctcctgttttaaatctctgcctttctgttgtattaatattttatattttaaatcatttctaacttaggacataaatagttcaataaagactttttcctactctgtaaatatgggaagattatataaaagtttaatgttttattaatcttcatagttttagcaagaattaacttttatttctttcgtctgctccaatcctgtgttagatccttgtcccaaggatgttttaatacaacttcaaggctagagacaaaattgggaacaaggttaaagtgctgtgtgtcttttctacactaccacttttcctttaagtgctctgttgccctttcttgtctgtttcaaattttgtttcaaaggtttctaaaatgtctattgcccatgaatagaagcagattaaaataggtgaaaggacatacttggaacttggaataagacattcctgagtttcccagatcccaatccatctatcacctgtctaaacttaggcaaattacttaactttctgagttttctttattttttgtttttcaactgtatcatggacttaagactgtacaaggccaaatgtagtggctcacacctgtaatcctagtgctttggtagtccagggtgggaggatcacttgaggccaagagtttgagaccagcctgagtgacatagagagacccggtctctacggaaaataaaaaagttagccaggtatggtgatgcgcaccattattcctagttattcaggaggctgaggtaggaggatcacttgaaccaaggggatcaaggctgcagtgagctatcactgtgttgctgcactctagcttgggcaacagagtgagaccctgtctcgggtctcggggtgggcggggggagactaaacagagtagatataagggtaatgcattatgtgtcatatagaaggtgtttccaaaagttagtgctcccccagtataacaaagcatagtctaccaaaaatagctgaaatacctgctctttctttcattctgtgctcctcagttcctgtgggctgatagcttaaatatagaagtaaattgaaaaaaggtaaagaccctgaaatatttcctggaacattttggctttttgtcctttctcctaaaagtgggatttgaacttcctctcacctcactttctttgtctctctctgaaagccagcgagcggtatttgagaaaccagaatctttcccaggttgacttttacaaggtcaaattgcctggtaaagtgaacctgataaaccaagtaagccaaataaactgaaataataattttatgttctactgaaactgcttgtatagtaacagcatgattctcaaaattgcaaaaatttcttattttaaaagttgtattgcaattccttttctaatactacttaattattccctttaattggtaattatttcaatgtatttaataaccaaaatgttctgaggattctctgtagcatatcaggcagaatggcattgaggacattatacacatgcatatcatagtacaaattagttaataaaaaataggcagaaaatcttctaagtttttaattcatttagttgaaaaagaatgttcatattgaggattgttcattatgttttgattggatgagtcaacacactattcttacgtaaatttgtatctgatttagaagatacactaccaaagttaagcttgtactacattacagtaaccaatactaatagaaaagtgagataaattatctgttttgttataagccaaattgagaacaattcgctttttagaaaaaaaaatagcttcttatatttgaggattaaattttatacttcatttccatttggagtttttttttttcttttgtttttacattataattacaaaattgtgaatcctcaaaggtcccctctataccagggaactgatctgatgtgcatgtatactttaaaaggctttacacatcagtcttctaacaattactgggagaatgtttcttgtgtatatgggtattgtatcattttgttgtgaaaactagaattcaatcctaaaaagaaccatctttgatttcccatggattaagttgcattgtggggtggggggccagtttaaatacaacaaatacactgagcctgagcctttgttagtgggctactgagtcttcctcagctacaaaaggagctgtctctgtgtttagtcagctacttgggggtggggaaacaaactgacttatattgacatttgcagggctagttaaaaatttttggatgcccttcccactttctttctgactctctaactttctagactattaacagcagctccctgcaaggccagtacatgaattaaatcccatactctgcttttattctctcctctaattctaaaagattggaagttaaaattctttttttttaagttatttttatttttaagttcatgggtacacgtgcaggatgtgcaggtctgttacataggtaaacgtgtgccatgatggtttgctgcacctatcaacccatcacctatatatatatgtgtgtgtgtgtatatatatatatatatatttttttttttttaacggagtctcgctctgtcaccaggctggagtgcagtggcgcaatatcggctcactgcaaccctccgcctccatagttcaagcaactctcctgcctcagcctcccgagttgctgggactacaggtgcgtgccaccacgcccggctcatttttcgtatttttagtagagacaggtttcaccatgttggccaggatggtcttgaactccagacctcgtgatctgcccgcctcggcctcccaaagtgctgggattataggtgtgaggcaccgcacctggccccatcacctaaatattaaggcctgaatgcattagctatttatcctgatgctctccctcctccggcaaccccccgacaggccccagtgtgtgttgatctcctccctgagtccatgtgttctcattgttcagctcccacttataagtagaacatgcagtgtttggttttttgttcctgtgttagtttgctgaggatgatggcttccagctacctccatgtccatctaaaggacatgatcctgttcctttttatggctatatagtattccatggtgtatatgtacattttctttatctggtctatcattgatgggcatttgggttgattccatgtcttcactattgtgaatagtgctgcagtaaacatatgtgtgcatgtatctttataatagaatgatttatatttttgggggggtatatacccagtaatgggattgctgggtcaaatggtatttctggttctagatccttgaggaatcaccacactgtcttccacaatggttgaactaatttacattcccaccaacagtataaaagtgttcctatttctccacagccttcccagcatctgttgtttcttgactttttaatacgccattctgactggcatcaaatggttgatggacatttgggttgtttcagttttaagctattacaagtacagctattatgaactttcatgtagaagtcgttgctttcattcctcttaggcaaatacctaggagtggaataattgtgttacatagtagctgcatgtaaggttttaagaaactgacaaacttttctaagatgcttataccattttgcattcccaacaactgtgtatgatagtttcagttgctcagcatcctggtcagtaaggagtatggtcaaggttttttaattttagccattctagtgtatgtgtagtggttttaatttggattttcctaataactaaagatgttgagcatctttttatgtgcttatttgccatctgtgttttccttgatgaaatgtctgttcaaattttttacctgctttttggttaggttattcttactgaattgtaagaattgtttttttttttttttttttttttttgagatggagtttcactctgttgtccaggctggagtgcagtggcgcgatacgggctcaccgcagtctccacctcccgggttcaagcgattctcctgcctcagcctcccaagtagctgggattacaggtgcctgctaccatgcctggctaatttttatatttttagtagagacaggatttcatcatgttggccaggctggtcttcaactcctgacctcaggtgatccacccacctcagcctcccaaagttctgggattacaggcatgggccaccgtgcctggccaagaattctttatgtattctagaatcaagttctttgatacctgttttgcaagtattttttccaaatatatggctttttcacttttgtgtcttttgaagagagaaatatttttgaagtccaatttattgatgtttttcatttataatttatgctttgtgtatattgtttaaaactctttgccaaaccaaagatcattaagattttctcttatgtttttttctataagtttttgtagctttagccctgacacttgggcccatgatccatttcaaattaaattttgtatgtaatttgagatacaagggtcaaggttcatttttcatgacttaatccttgaatcacttctctgtccactctcttaggcgcttatctagtcatgtggctttaaatatcatctgtatattaatgactcccaaattacaactctagcccaaactgctattttaagagatatctcaagcatgtccaaaactaagctgttaatatccaccttttctcctcttccatgcctgcccctctcacagtctttgccatttcggtaaatgcaacttcattctttcagttgcttggagcaaaactcttagcacatctttgagtgttctctttctctgtcacctcccatcttgatctgttgtcagattccattggcttcatcttcacattatattcagaatcccacctcttctcacgatctcctcttttaccactgtagtccaagccaccattacctcacccaggttattgctgtaatattctaataggtctctctctacttctacctttgcatgtttattaaattaagtgttgtcatttttctgcttagaacctaccagtagcttttcatctcattcagacaaggagccagatctttttaatgatatctaagggcctgcaccatctagcaacccattacctgtcttaccgcatataccaggcccttattcactctgctgcagtcatagaggccttgttggtgcttctcaaacataccaagcacactgcctacctcaggccgtttgaacttgctatttcctctgtgtggaatgtttttcttccagataacttaaaagtttattctctcacttccttaaatctgtattcaactgttacctcaatgagcccttcctatttaattgcaactctcacccagacatacatctcacattccacattgctgctttatttttctctgtaacatgtatcaccatctaacatactatatatgttagatgtttctctttcttccctcaatagaacataaacttcttttgagaagagatgtttgccttttttgttgattgcttgcattcccaacccctagagaagtgcctgacacataacagtatgaccctgtgtaatatttattatatgaatggaggtaagtaacattttaggtggttttttccctctgaatataaaatgggaacattgtgaacagtgcaagtcttcaacaaagttgatgtagacagacttcagctctcataatctttttctcttttttaataaaagaatgtttaacatacagacaaaatataaagagtaacaaaaataacaaaaaaagcagccatgttcccaccacccaagttaagaaacaaatattattaatacttttgaaacatcctttgtgctttacccttactttatcctctctactgtcctccctctataaacctattctgaatttgtttattgttcctattggttttctttatagttttgccacatatgaatatatcattcacatatgaatatatcattcagtttgaactctatgtaagtggaatcctaccacaggcattctgcaagttgttttgcttgacctgatactcctgagtttcatccatagtgatgcatgtagctacagttcatttatgtttactcctatatagtatccccattgcgttgagagaccactctatctgttctcctgtatatacaactttgtggtggttttcttgcttttttaatgctaaaaacagtgctgccatgaacataattgtacatgtttcatgaaacacacatgcaagtttttctatggcagattcttagcggtaaaattacagttccatagggcatttatatctttcattttactagttcgtgccagattgttttcaaaaacaattgtacatatttatacacccgtcaatagtatatagttgttataatatttagttttcttaatgtggagggtataaagtggtgtcacatgttagttttaatttgagttttcctatttcctaatgagactagatatcttctcagttgtaattagccattcctgtttcctcctctgtgaaatgtttatctgtgttatttgctcttttttaattgggctgtttttggtttctgggagttcttcatatattccagatacacattctttgccagttacatataaagcagataccttttcccagtatgtagcttatcttttcactatattttcatgaatgtagcttatcttttcactatcttttgatgaatattaggccgggcacggtgactcacgcctgtaatcccagtactttgggaggccaaggcgggcagatcacgagacggtcttggccaacatggtgaaaccccgtctctactaaaatacaaaaaattatccaggcgtggtggtgcgtgcctgtaatcccagctacttgggaggcagaggcaggggaatcgcttgaacccgggaggcagaggttgcagtgagctgagatggcgccactgcactccagcctggcaacagaagcaaaactccatctcaaaaaaaaagaaaagaaattctaaattttaatgcagtttaattatcaatctttttctttataatttatgggttttataagccttacttaagaaattctttcacatataacatcatacagtgatttttctaccctctgtcagggcagattgcccttgaagcgctccctagacctgtccctgacaacctgttctacagaagagatctgagactcagtcacaatggcagaggtgaccgagaccagctcagttttggaaatcattttcagaaatggctagagagaagtgtgtgtgtgtgtgtgtgtgtgtgtgtgtgtgtgtgtgtgtgtgtgtgtaatatagtgaaacaaattttctatcctgttttttcatttagcatcgtgtttcaaatatttttacatcatttattattaaagttcaattttaatgaatgtcatattggatgggaatcagaattcttatttaacattttgcagttgtaaataagacctcagatgtccgggcttggtggcttacgcctgtaatcccagcactttgggaggctgaggcaggcagatcacctgaggtcaggagtttgagaccagcctggccaacatggtgaaaccccatctctaccaaaaatacaaaaattagctgggcatggtggtgcacacttgtaatcccagctactcgggaggccaagacatgagaatcacttgaaccctggaggcagaggttgcagtgagccaagattgtgccactgcataacagcctgggtgacagagcaagactctgtctcaaaaaacaaaacaaaacaaaagaaaaacaacctcaggaaacagtttataaatctttttgatgcattgtttatttctttaagaaagacttatagaggtagtatgacttggttaaaatatactcttgatatcagcagaagtaataagcagttgaaaataattgagagtcatatgagcgttaagtaaattgattttctgagcaacacttgctacttgcttgattctttacaaagaaagtcaatatttaaaagtatccagcctacttggcttacataaagcttagatttaatgatgtccatatttactattcatacattgtgtagcaattatatataattttccctttttgatatctcacatgattttgaatgtacttagtttgaggaggatttaatgatatttttaattaatcctctcaataatgtttgaaaatggttaatagggtatatatttgggcatcttaaaactgacctattctctttagggtaattaaaaagtcatcaaaggttcagtgaccctgcaaggcagtgtacacttggtatgtgtgaaatacttggtcattattaagccagcttttcttcaagagagatacactatttaattaaggaatgtaataaatcactctctattttattgttattggtgttaatgcttggtcttgtaactctgccctgtccacaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagt

SEQ ID NO: 38014 - DNA, 3090 bp, Homo sapiens; identical to SEQ ID NO: 35952

SEQ ID NO: 38015 - DNA, 49369 bp, Homo sapiens
aggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcaggtaaatccccgcggagtccgggccccacctcccgcccggctctgctctgtaaggcccagcccggcggggcgggtcggaggccgcctggcccctgcggcgggggagcctgcgcctgtgggcccgcggatcccccagctgtggacctcggcgcggagcgactgttggggccctggatcgtgggcgctgggcgggccgggaagaggcagggctgggatccgcgcagtcctcggcgtggactttcccaacccgtctgttgtgtgtggatgttctccgcccgtcttcctcgccttttaaagtggaatccagtaacggtttccggcgtagcactaatttacagtccacgcctgtggatcgattccgtcaccaggaattccagcgccttccagttagggtggttattgccgagtagggggcccagaacgtttctgtgtccgcaaaataccctgtagctgcattttgctgttgtcatgtagctcggcacgttattgatacagtcattgagcaccccctgtagtgcggccttgtttcaggttctgctaaggataggatagcatctcctcccgaaaaccagaccttgtgtccttcagcttttgggctgatgtttttttctcctagccctcgcctaggagcttagcccacaccttttaggttgttgttttttcggttatttttgagacagagatctcgctctgtcgcccaggctggagtgcaatggtcttggctcactgcaacctccgcctcccgggttcaagcgattctcctgcctcagcctcctgagtagctgggattacgggtgcgcgccaccacacccagctaatttttgtatttttagtagagacggggtttcaccatgttggccaggatggtctccatctcttgaccttgtgatccgcctgcctcggcctcccaaagtgctgggattacagggcgtgagccaccgcgcccggccataaaacatatttaaatgggaaaatgtttatcttgaaaggagaactctgaaagtatatacttgttaactggtttggtacctggaaatgttctacaaggagccactctctggtgacagcaggagccccgtgtctgggcagccactgtggcctttggagagctgggctgctccctttctcctgcagaagcttcaggccatgggatagcagccaatgtacttctgtgttttgttttcttcttttttttttttttttttttttgtgacaatctcgctgtgtcgcccaggctggagtgcagtggcctgatcatggctccctgaagcctctgcctcctgggcccaagcaatcctcccacctcagcctcccaaagtgctgggattacagacatgagccaccgtgcctggccactatcgtgattttttgtttgtttatttgtttgttttttgagatggagtttccctttgttgcccagcctggagtgcagtggtgctatctcggcttactgcaacctctgcctcccgggttcaagcgattctcctgcctcagcttcctgagtagctgagattacaggtgtgcaccaccacgcccggctaatttttgtatttttagtagagatgaggtttcaccatgttggccaggctggtctcaaactcctgacttcatgtgatccacccgcctcagcctcccaaagtgttgggattacagccgtgagccaccacgcctggccaattactgtgttttaacctgtttacttgcttttgacattttgatgttacctaaagctttgacctattgctcagactattactttatatttcagggcaatgtagatattacaaataattatatatttgaacttttaaaaacgatttttagtctgcattgctttggtactctctaatgttggtgtgacctccagtattgtttttttttttttttcagagcttacaattgagactgctaacccctacctttgaagggatcaacggattgttgttgaaacaacatttagttcagaatccagtcagactctggcaacttttaggtatgtatctgtttaaagaagcagctgagcatgactgcacacttaccgcctcagctacttgggaggctgatctttttttattttagagacgggatctcgccctgttgcacgggctggagtgcagtacaatggtgtgatcagagctcactacagcctagaactcctgggctcaagggatcctccccactttgcttccggagtagctaggactacaggcgtgtaccgtcacactcggctaattgttttttgtagagacaaggtctcactttgttgtccaggcccaaaggggcctctttactcccttatcccccagttgcagagccttgacctcttaggctggagtgatcctcccacctcagccttccatagagccaggactccaggcacacaccaaagcgcctagctaatttttggggggtattttttgtggagatggggttttgccacgtttcccaggctggtcttaaactcctggactcaagcgatcagcctgccttggcctcccaaagtgttgagatcacaggcatgagccaccgcatctggccaagttgtccttttttaaaaaaaattctgctgtattccagtaattgggctgcttgaaaaaggtttttcgtgttatctagtcagctgcaagaatgtttagtaaggatttacaaagtggctacagatgttttatatccacacaatcactaaaaataccctgcaaataatttgctcttcaataaatcatttaatgaaaccttgtgacattctttggtctctcttggctttaggttaaagaacctgaaggattgacacctctcacttttatttcacgctcccctttatggagttggaacagggaaaaagtaaaatatttctactcctaactaacattaaacagctttgtgccaacacatgggtagggagagtgccgtgcccactggccgtgcatcagcaactggctcatctgctgtcagtgtttaacgtcagctcacgggtgcctgtggctgtgaaacaggaagcacatgcttcagcctccttaagcctgaggtgacatgcaagtggcaaccggggccgtttcactggtgaacccgttcatgtctttgtgaagaaagttacatttcaggtcatggttgtgaaactctttccctatttttattattttttattattatttgagatagggtcttgccctgttgcccaggtgcaatctctactcactgcagcttcaacctcctgggcccaggttctcctcccactcagcgtcctgagtagctgggaagtcaggcatgtgtcaccacgtacagctacatttttgtgttgttgttgttgttgttgtttattattatttttttgagacggagtcttgctctgtctcccaggctggagtgcagtggcgcgatctccgctcactgcaagctctgcctccaggattcccgccattctcctgcctcagcctcccaagtagctgggattacaggtgcccgccactatgcccggctaattttttgtatttttagtagagacggggtttcaccatgttagccaggatggtctcgatctcctgacctcgtgatccacccgactcggcctcccaaagtgctgggattacaggcgtgcgccactgcacctggcctcccccatttgtaaacgctgatttgttcagattttgagacagctctgtgtgaggagtgtcgtgccggcccctcttggtggtggctgggctgctgctgttgccacttgtctggaaaccatttgtgagtcggagtcttgctctgtaaaccaggctggagtgcagtggtgtgatctcagctcactgcaacctccgcctcccgggttcaagcaattctgcctcagcctcccaagtagctgggattacaagcgcctgccaacacgtccggctaatttttgtatttttagtggagacagtgtttcaccatctcagccagtctggtcttgaactcctgacctcgtgaaccacctgcctcggtctcccaaagtgctgggattacaggcatgagccaccacgcctggcgtgtttaagttcttttaaagcaacttcatatattaaagggattcgtgatattttcccaaatttgtgttcataactattttttattccctcacattagcaatttaagtagcaaagatatttaacgtaagttaaaatagtttattattttgtaattaggaaatactggactaagtgatataggatatgctttatttcatatttataaatcttatggatataagtaggtttttcagatggtttttgttttgctttggttatttaggagtacactgttgtcctgtatgcctcccctgtggttgcaaaacttaattgttaaatcctttctctatttctcataggtggtactttctattttaacacctcaaggttgaagcagaagaataaggagaaggataagtcgaaggggaaggcgcctgaagaggacgaaggtatattcatctgatgttcttcagtcagtagctgcctctggatgtctttacatttctgttttccttttagcaaggtgaaaccagtctggaaaatggggagatgggccgggtgcagtggctcacacttgtaatcgaaacgctttgggaggcccaggtggaaggatcacttgaggcctataccacatagcgagaccctgtctcactgcaaattaaaaggctgggcgtggtggctcacacctgtaatcccagcactttgggaggctgaggcaggcggatcacctgcaccctggccaacatggtgaaaccccgtctttactaaaaatagaaaattagccgggcgtgatggcacacgcctgtaatcccagctactcgggaggctgaggcaggagaattgcttgaacctgggaggtggaggttgctgtgagtggagatcatgccattgcactccagcctgagcaacaagagcaaaactccatctcaaaaaaaaaaaaatttaaatttaaatttaaaaagaccctatctatacagaaagaaaagaagaaaataattggccaggcgtggtggtgtgcacctgtagtcatagctcaggagttggaggagcttgagcccaggagttggaggctcagcttcagactcacagccccagggggcagaagggttgaactcagcttcaggaatgctttgcttttggatccttgaggcctctcgctggaaatcagcgttgttaagatggacgccctgctcagcagagctcatctttctagaaaggcacctggccttggaaggcgagtgaggaactgtcataaggactttttcttcccatgttgcttttcaggaaagctttcaggatgtggaaatgatggttcagctattggatgaggggattattattgtgaattcgagtttagcaggagtttgtttcaggagtgacgtccttcttgattgattttgtgtgagacgctgcatttgccaaggccagggacagctttactctgtgagagaggagctctgactctccctactgagctctcgaggggaggtcataactgcgggaagggacaccagtgtttcgcaggtggattcagtttaggcgtttctggctttaggctcatcttcagcttactgttggttttacggtaagtgtcaatgcttacagccactcagaactatcttctaaaagacttctgaatcttcatacaaaattgttctgaattgatttcagggctctttccctgtatacttcaacatttcaataaagtgtgtcctttgacttttttttttttttttttttttttttttttttgccagaatctcactctgttgccccggctggagtgcagtggtgcgatctcagctcaatgcaacctccccctcccgggttcaagcaattctcctgcctcagcctccgaagtagctgggattacaggtgctcaccaccacaccctgctaattttttgttttttgttcgtttgtttgtttttgagacggagtctcgctctgtcgcccaggctggagtgcagtggcacaatctcggctcactgcaagctccacttcctgggttcatgccattctcctgcctcagcctccctagtagctgggactacaggcacccgccaccgcacccggctaatttttttgttttattagagactgggtttcaccatgttagccaggatggtctcgatctcctgaccttgtgatctgctcaccttggcctcccaaagttctaggattacaggcgtgagccaccgcgtcaggccctctttttgtatagtagagatgaggttttgtcttgttggccaggctggtctcaaactcctgacctcaggtgattcacccaccttggcctcccaaagtgctgagattacaggtgtgaaccaccgtgcctggccttgacctttttttttttttttttttgagacggagtctcgctctgtcgcctgggctggagtgcagtggtgtgatctcagctcactgcaagctccgtctcccaggttcacgccattctcctgccttagcctcccgagtagctgggactacaggtgcccgccaccatacccggctcattttttgtatttttagtagagactcggtttcaccgtgttagccaggatggtctcaatctcctgacctcgtgatctgcgtgcctcagcctcccaaagtgctgggattacaggagtgggccaccgcacccagccctggaccttttttttttttaacttttattttgtatttatttatttatttttgaaacggagtctcgctctgttgcccagactggagtccagtggtgcgatgtcggctcagtgcaacccctgcctcctgagttcaagcgattctcctgcctcagcctcctgagtagctgggattacaggcatgcaccaccatgcccagctaatttttgtattttcagtagatacagggttttgccatgttggccagactggtcttgaactcctgacctcgtgatctccccacttcggcctcccaaagtgctgggattacaggtgtgagccaccacgcccggctgacctttttataaaaaaaaatttgctgggtaggtgcggtggctcacacctgtaatctgagcactttgggaggccaaggtgggatgatcacttgagcccaggagtttaagaccctcatttctattattattattactattattattattatttttttttttgagatggggtctcgctctgtcgccaggctagagtgcaatggcacgatctcggctcactgcaacctctgcttcctgggttcaggcgattctcctgcctcagcctctcgagtagctgggactacaggcgtgcgccaccacgcccagctaattttttgtatttttagcagagacagggtttcaccatgttggcaaggatggtctcaaactcccgatgtcaggcgatctgcccatcttggccttccaaagtgctgggattacaggtgtgagccaccgtgcccagcctggagtttcactcttgtttcccaggctagagtgcaatggcgtaatttcagatcactggaacctctgcctcctgggttccagtgattctcctgcctcaacctcacgaatagctgggatcacaggcatgcaacaccaagcccagctaatttttgtagttttggtagagacctggtttggccacgttggtcaggctagtctcaaacttctcacctcaggtgatccactcgccttggtctccgaaagtgctgggattacaggtgtgagccaccacgcccggccgttcgtttttttaataaaagaagaaagttagatcacttggggccaggagttcgagaccagcctggctaacatggtgaaaccccttgtctactaaaaataccaaaaaaaaaaaaaattagccaggtgtggtgtacgtgcttgtaatcccagctactccggagtctgaggcgtgagcatcgtttgaacctggtaggcagaggttgcagggagctgagattgtgccattgcacttcagcctggataatagagtgagacctttctgtctcaaacataaaaaattaagaaagaaaaggccgggcgtggtggctcatgcctgtcatcccagcactttgggaggccaaggcgagcagatcacaaggtcaggagatcgagaccattttagctaacacggtgaaaccctgtctctactaaaaatacaaaaaaaaaaaaaaattaggcgtggtggtgggcacctgtaaccccagctagtcgggaggctgaggcaggagaatggcgtgaacccaagaggcgaagcttgcagtgagccgagatcgcgccactgcactccagcctgggcgacacagcaagactctgtctcaaaaaaaaaaattaagaaagaaaaaagcgacggcgagactcttgtctcaaaaaaaaagaaaaaagaaaaaagtcgtaagagaaaatatatttcctatttatgcagtggaagcggatcaccataaagagcttcatcctcatggccttcaccttgagtgggctgaggaggaggacgaggggctggtcttgttgtcttgggtagcaggggtggaagaaaatccacgtgtccgtgatcatacatagctcactcctgtgttgctgaagggtcacctgtcatagaagagggaagaattgtgtggcctgtgcggattctgcattcagccttgtgtgttgtgttacggttaaccagggacgtgtgccccactaataactctgattcctggaaggaatggcatggcagcctccgttgtcatggttcctggagggaatggcatggcagcctccgttgtcatggttcctggaaggaatggcatggcagcctccgttgtcatggttcctggaaggaatggcatggcagcctccgttgccatggcaaggcaaagccatggcagcttcctggttatcactcctggcatgtggtaggtgcttgtccagtgaaatcctagtcgttgctgcattggcaggtgccctggcgtgaggaagggcaggcagtcaccatgccctttgctctcctgggccctgcatctgcttatggatgaggctgcgtgtagctgacatgcgtgtctctcctgcatctgagtaattgtcgtcgtcttttttttttttttttttttgagatggagcttcgctcttgttgccgaagttggagtgcaatgccacgatctcggctcattgcaaactccacctcgtgggttcaagcagttctcctgcctcagcctcccgagtaactgggactaaaggtgcccgcaaccatgcccggctaattttttgtgtttttagtagagacggagtttcaccatgtgagctaggatgatctcgatctcctgacgttgtggtctgcccacctcggcctcccaaagtgctgggattataggcgtgagccaccacgcccggccaagtgattgttttatgtttattctgttttgggttgaactatagtttgcttggagaaaataatgtctgttaaatttgcgttagaggataattgtttactgagccaaataatctttcttgtgagaacctattctgggtttcccctgggccctctgctgtggtttcggcgggagttggtttgtgtggattttcaggactgctgacttgatcagacaggcacaacacagtcccggccctcaggcaggccttctccctggtctgatgctgaactgcatggcgtctgttcagatgaagattcttttgccacctccttaaatgaaagaacgatactgaatgtggcttagaaacagctttgccagccgtgcagaatgattgtaagtagtggttgcccgaaaagtatttgcttggaataccactcactgataacactggtgaacctggaaggaattatacggagtgaaaaaaggcaccactcactgataacacgaatgaacctggaaggaattatacggagtgaaaaaaggctccgctcactgataacgcgggtgaacctggaaggaattacacggagtgaaaaaagaccctgctcactggtaaggcgggtgaacccagaaggaattacacagagtggaaaaaagactccgctcactgataacgcgggtgaacccagaaggaattacacggagtggaaaaaaggccccgctcactgataacgcgggtgaacccagaaggaattatacggagtgaaaaaaggccgagctgaaagatcacatgccgtatgattttttttttatacagcattctctaaagacaaaaattaaagagatggaacacagattcgtggttgctaggggttaaggatgggggaaggagacagccggagggagcctgtggttggattgcctcagctgcggtgggcacacactgcgcgtgtgtcatgggatgaccccggggagcttggtggaccgtcgtggtgggagagcctggctgtgatactgttcatagttttgtgagatggaacccctggaagcagggggacaaggtattgctctgcgtcatttatttttatttatttatttttttttgagatggggtctggctctgtcacccaggatggagtgcagtggctcgatctctgctcactgcaacctccacctcccgggttcaagcgattctcctgcctcagcctcctgagtagctgggattacaggcgcgtgccaccacacccagctaattttgtttgtttttagtagagatggggtttcagtatgttggtcaggctggtctcgaactcctgacctcatcatctgcctgcctcggtccccacaaagtgctgggattacaggtgtgagccactgcgcccagcctgctctgtgccatttcttacaactacatgtgaaggtacagttacttcacggttgctaactagaactagaaaactagaaaaaaagcagttgctaacattttttttttctttttttgagacggaatttcgctcttgttgcccagcctggagtgcagtggcgcgatctcagctcaccgcaacctccgcctcccgggttcaagccattctgttgccttagcttcccgagtagctgggattacaggcatgcgtcaccacacctggctgattttttgtatttttagtaaagatggggtttctgcatgttggtcaggcttgtctcagactcccgacctcaggtgatgcacccgcctcagcctcccgaagtgctgggatgacaggcgtgagccaccgcgcccggcagcagttgctaacattttcacacagcttcttgtggagaaggcccctttccactgtgaagtgtgaatgcgtcaaggtggagcccctgccccggaggcctctcctctgtcagggtcagctgtggcgctcggggctgctgtcttcaggggcggtttccaagtgggatgagcctgatgtggcccctgtggctgcttccttgagactcagtggtatcagccgtttgtttttagatgactgattgaagtgagttatgtgatcataatatctaattgtcaacaattgactttttttcctcgaagagggattttggcaacaaaacttgccagtggtcctgcaggctgccgtccacgaggtgtgcatatgaggctcaggaggcatgtgcgtttcctgagcgccttggcggacagcctcaggaacacaggcagcaggtgctgaggtcacaccccagttctgtgtgagctggcggctcgtctcagcatcctgaataaccgtcctggaagcacacaggaggaaggtacctgcagccctgggtgcgcaggcacaaatgaccacaacactgaaggcgtggcgggaagaggtgcatcgggcagcgcagtggaagggacgcgctgggcgtttgggttgaacagaagttaaggacttcatgggaaggagatggggggtcttgcaggcagaggaagttccttttatacctagagtgcttttgtttgtttgtttgtttgtttgtttgttttgagatggagtttcactcttcgttgcccaggcaggagtgaagtggcgcgatctcagcccactgcaacctccgcccgccatgtttaagcgattctcctgcgttagcctccctagtagctgggcttacaggcgcgtggtaccacgcccagctaatttttgtatttttagtagagacagggtttcaccatgttggccaggctggtgttgaactcctgacctcaggtgatccactcacctcagcctcccaaagtgcctggatgacagtcgtaagccactgcgcccagccccagctacgttgtgttttttttttccccctgtagagatgggttttcgctatgttgcccaggctggtttctaactcctggactcaagtgatccacctgtctcgactcccaaagtgctgggatgacaggtgtgagccattgcgtccggctggaatttcttatggttcgtttccttaggttaaagtttcagaagtaggatttttgaattaaagaaactaaatactgtctatggcgcttgatacatcttgccaggcagttatcagacagggttgtactggtttgcgccaccccagaacgtgtgcaaggcctgtttgtggaccctccttggcctggctctctaggtcatccacctgcgtgtgctcacagagcatatggatttttccctgcggtgccttcacttgtggctggaagagccttctctgtgatcctgtgtcctgggtgctctgttggcctccttcttgccaccgaggaagacacggaggctagagagggctcactgaacagtgaaatgattggaacctaaggagcttcagcagaaggtgtcatgatggggctaggctctcccgagggctgtgtggcctcagcgtcttgttgggcagatcctgctccctgacacagcggggctaagagccagcctgtgtcacacacctgtgaattaacatgcctggctgaccctcactggagaagggctacacgtttgtgacgaaagcagaagaggtgtttattgtagaccaaatccaagctgtcattttacttttattagaaattatttgggatttggctcatgcctataatcccagcactttgggaggctgaggtgggagaatcacctgagctcagtcgtttgagactgccttggcaacatagtgagacctcatcttctactcaaatttaaaaaattagccgggcgcagtggcgtgcacctgtactcccagctactcaggaggctcagttgggaggatcacttgagcccaggaggtggaggctgcagtgagcccagatatgctcatgaagcactgtgggtttctcctgcagtgcaccaccgcactccagcctgggtgacggagagagaccccatctcaacaaaaataaaaaagaaaagaaaatgggacactgttgatacagtcacagagctgaaggagcagcatgggtcgtgattctggatcgtccctccagggcagctagagtagctgctgggaagtatttctctcagtttcccgggagcagtgtgggtcgtgattctggattggccctccagggcagctagagtagctgctgggaagtatttctcagtttcccagtgcaccccatgtttctagtagaaaacacaattggtaattaaatattggaagtagtttctaacaattggatactcacctgagaacataaatttgctctctgaaataagcggtgggctttaaataattgcctttgtgaatatgaaatttaagtattagatgcacgattaggatcgattgtaacaaaacagtgatatctaaaatataccttcatgttttcaaagtaattattttgccacctttttagtgggtttcattttgtgtttttaagccgatttaaaaattgtttgaattcgtctaaaatgattgttggaaaggaaggtggtacatgggacgtgcccaggccaggctttgatcccagcatgaagcccccgcaagacaatgcaggaggagaagagctgtgaatctcaagaagacgtgagcctctcgtcccggctgctgggtccgtggcggtttgtccgcaggcgcaggtgttctggaaatgacgtcgttaccaccgctgggtctgtggcggtttgtccgcaggcgctggtgttctggaaatgacgtcgttcccgccgctgggtccgtggcgctgtgtccgcaggcgcaggggcgcaggtgttctggagatgatgtcgttcccgctgctgtgtccgtggtggtttgtccgcaggcgcaggtgttctgcagatgacgcccttcccagaactggaggagagactgacctgcctagggggtttgagggaagactgtggcttggcctgtggtggtcactgttgggagcctgtctggctgcaggactactccccacctgggccctggactgtgggaagtgacccctgcgggcattttgcccagtggccatcctggctgtccttttccccaccatgccctcctcagaggcgtctccctggcttcgctgcctggcgctgcttgccacgcctccttgcaggcctccatgaagagtgagtgagcgcccgctgctccagatcccctctgtgctggccccaggccggccttgagtcggtctcttgctgtctgcagggtgcacctgtccacctcccctcgaggtatcccaatgtctggagaacaggggccgaatgtcttttccatcctctgagagctaagcataatgccaccgtgtcttcagtagggtgttaataactgaggaaggtaatttagaagaattcacctggtgcttctcataaagagttggtctctgggaaaattctagagtcaagtggtctggagtatatgcctttagactcaacagtgtatctcatgatatttttaagttctattttcagatgttgtgataacctacaactttctgttaaatgttagtcattctgatgagtaaaaagttcagaatggttgttgggtagggagagagaaggcacaagggtcttcagtgggattgggaaggtattatttcttgaggcaggttgtggtaaaaggtatttgttttaatcgtttttaataacttttgtgtatgttttgatatttagtatttgatcaaactccaagcaactggattcatggccattgtgagcttgcactttgcagcaggagagctgactgcatctgtgacggctcggacggcctgggacggtcgtttcttttctgagacagggtcgttctctgtcacccaggctggagcacagtggcgcgatcacggctcactgcagcttcaacctcccgcctcagcctcccaagtagctgggaccacaggcgtgcaccgttgtgcccaggtctaagtgtttcgatttagaaatggtttcctcttaggtgggaaccactcctgctcctcactgaagtgacctcagcgaatgaagtgtgggtgacctcgaacagcacagcgttagtctttgtctctgataacgtcagggaagaattggaggaagtgcaggatcttctgtgcaggacgctgcccctccccgtccagctgagctttcctgaggaagctctggatgtcgcccgtgtctgttgctcatgtgtttgtttctcccttttgcttctctgccggctcagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctgtgagtgagggtgcgggaggcctgtgagtgagggtgtgggcacaggctggcagcctgtgagagtgaggctgtgggctcctgtgaatgagggtgtgggcgctggctgttgccatccttttggatacctgtgattgagggcatgcttctttctcatgcagggacctcagcccattgatttgcatttatttggttgcctttgtttttgtttttgtttttgagacagtctcgctctgttggccaggctgaagcgcagtgatgtgatcttggctcactgcaacatctgcctcccgagttcaagggattctcctggctcagcctcccgggtagctgggattacaggcgtgcaccacaacgcctggctaatttttgtagttctagtagagatggggtttctccatgttgggcaaggctggtctcgaactcctgacctcaggtgatctgcccaccttgacctcccaaagtgctgggattacaggcgtgagccatcgtgcccagccagatctggtaactttagattccaagagtgcgtcagaacatgtgcttggagcaatttaacccagggtaatgtgtggaccagtgattaggaaagtggtctggggttggtgtggcccacccccgggtctggaaatgaccgtggcctccaccagagcttctgcccctttgctgggttactcaggattcagaatgctttttccttttcttttgctttttttttttttttttggagacagagtctccctctgtctcatccaggctgagatgcaggggtgtgtgtgatgtcggctcactgcagccttgatctcctgggctcaggtgatctacccacctcagcctcccctgtagctgggatggcaggcgcgcaccaccacacttggctaatttttaaattttttgtttttttggagagatgaggtctcactatattgcccaggctggtcttgaactcctggcctcaagtgatccttacaccttggccttccaaagtgccagatcacaggcgtcagccaccacgcctggcgctgtcttgctatttttaaaaacaggaaaccttgttcttaaaatacaccatggctaagtgcagaagacggtgctcattcacgtaaatcctctggtggatgcctgattatttcagtctggaaggttattttaacctacaacactatgctcagctctagacgagtcacctgataaaacagctgccttaaagagaaaatgctcagaattctgtcttagcagtttggggtgtgagtgagggagcagcaggtgccatccccacccctcatccctgtcctctgctggagtttccagttaacctcaaagagagtcccgcaagtccgtctgtgtcctccctttggggtgttgccgtccagtcatgctgaaatctgagctaaacatgcggagtttacttaggaaaacgctgcgtttggagaatcgtgtgccagggagacggacctgttggtgtcctggtgtgagggatgaacagtctcaggttttgtggttaaacatgaaccctctgtggccgcagtttcctaaaacatctgtttttggccgtagtcttgattttgccatcctcagtcccgtgctgcagcctcgccggcctctggggggctcctgctgtgtctgcaggtgtagctgagtctgaggcacacatcagacgtggggctgtgagctaacttgcagacatccctccatttcttagttttcctatgagtggaaaatagaaagtctatctgttgaaattttatttctcaaattgtggttgaggaaacaaattttttagacttggaagtacagatgttccttgaattaggatattttcagcttcccaggggctcactgggaggtagccccatcgtaggtcaaggagcttagtgtgcatattgcttttacaccattgtaaaatggaaagaccgtaagtggaaccgtcgtacgttaggaatcacctctagtttctgaatggtgtcctcttcacaatgctgaggttgtcattaccatgagttccaggcgggctctctgttgactgtagggttgctcgtctgtccctgcgtttctcatggtcccctctcctttctgccccccagcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaagtatgttggatgtatttgttgatgcttgaactaaacctaacttggctttgtaatctgagaaacagattgcaatcaaaaatctcaaactgtctttgcctatagttaactagactttttagtgggagggttaaataaatatagaagtgaatgatacaatgccaggagatttggaaatatagttatccctgggtatccatgggggctggttctcggacttcccaaggataccagcacctgaggatgcctaagcccctggtgtaggatgctgaagtctaagcccctgatgtagatgccgaagtctcagcccccgacgtaagatgccgaagtctcagcccccgacgtaggatggcgaagtctcagcccccgacgtaggatgccgaagtctcagcccccgacgtaggatgccgaagtctcagcccccgacgtaggatgccgaagtctcagcccccgacgtaggatggcgaagtctcagcccccgacgtaggatggcgaagtctcagcccccgacgtaggatggcgaagtctcagcccctggtgtaaaatgccgaaatctttgtgtgtaacctaagaacattctctgatatgctttaaatcatctgtaggttgataataatacccaataccctgtaaatactatttcaatcgttgttatactttagggaataatgacaaaaatgtgtctgtgcatgttgagtatagatgcacgtttttccccagatacattcattctgtgcttggttaaacctgcagagatgaaacctgtggctgtggaggccaaccgtgtgcaagtccgttggagtttgtttagtcactttctttagttgtgtggcgcttctgaattcacattcttgtataattttcactgactgtgctctttgatgaaagcttcccaaatggtcagagtgagtgtgcagatgccggagatacctagtgatctggccagccttgtgacaataacaacgttcagctttttctattttcagtatattttgttttcaaaagtaagcgatcactttcagttagcaaggcaagatcagcctagcagtaagaaagaaagtcaaggaggaccgtgataatgtcctgggcttgctctcttctacagacaggaaaatggaacgggaaaagggtagacacaggaaggtgaaattctcatttcagtgttgagagggaaacagaccaggtgggagctgtcagcacgtatggaccatggaccctgacaggttccttagtaggacaaatgaggggccagcgggtactgaaacagaggtttattgttgacttgtaatctctgaagatgtagaatgccagtgactggcaagtactcccttgatcaaaatgtacctctagccgggtgcagtggctatgcctgtaatcccagcactttggaaggctgaggcagggaggatctcttgagcccacaagttcgagaccagtctgggcagcatggagaaccccatctctacagaaaaaaaaaaaagatgcacctttaattctataacccagcaacacctggaagatcactgctctgaggctgtgtgtctcatgtctttgtaggccagtgatgtacagaagatggagggttggggcaggcccattctcgtgtcttcgtaggccgatgatggacagaaggtggaggtttgggccgggcgcggtggctcacgcctgtaattccagcactttgggaggccgaggcgggcagatcacgaggtcaggaggtcgagaccatcctggctaacacgacgaaaccccgtctctactaaaaatacaaaaaaaattagccgggtgcggtggcgggtgcctgtagtcccagctactcgggaggctgaggcaggaggatggcgtgaacccgggaggcggagcttacagtgagccaagatagcaccactgcagtctggcctgggtgacagagccagactccatctcaaacaaaaaaaaaaaaaaaagaagaagatggaggtttggggcaggcccattctcatgtcttcgtaggccgatgatgtacagaacagaagatggagggttggggcaggcccattctcgtgtctttgtaggctgatgatgtacagaagatggagggttggggcaggcccagggcagcccctcctcaggatgagggcaaaagtcctgggatttgcttttttttttttttttttttggagtcagggtctcactctgtcgcccaggctggagtgcagtggtgcaatctcagcttactgcagcctcgacctcccaggatcagtgattctcccacctcagcctcctgagtagctgggactacagatgcacaccaccacatccagctaagtttttttgtatttttagtagacacagggtttattcttacatttttcttttctttttgagatggagtcttgctctgtagctcaggctggagttcagtggcacgatcttgactcactgcagccttcacctcctaggttcaagcatttctcctgcctcagcctcccaagtagctgggattgcagacgcatgccaccatgtccagctaatttttgtatttttttagtagatatggggttttaccatgttggccaggctggtctcaaactcctgaccttgtgattcacccgccacggcctcccaaagtgctaggattacaggcgtgagccaccgcgcccggcctgagatttgctttttactcttaggctgatcttgcctgcctgattgaagctgatcgcttacatttgaaaacaaaatatactgaaaatagaaaaacctgaacgttgttattgtcacaaggctggctagatctccggcatctgcacactcagtctgaccatttgggaagctttcatgaaaaagcacagtcagcgagaatgagacgagagaacccatttccacaaccattttaatctgcgcatcggtcccagacgtagggattcctcgtctcatcttggaaacattgccagcagtggttctgatttggaagcctgcgtctgtcacgtgacaccgtctgagcctgtgcctgcctctctttcttccggcagtgccctgtactctgtggggatgacggcagtgggcctggccatcctgtggtatgttttccgtctggccgggatgactggaagggaaggtggattcagtgcttttgtaagttctgtaaatcagagctctctgaactctttctggtttgtgtttgctgaatacttttcccataagctatacgatgaatacacagggaaaacctgttgcagagagtagcctgaagccacaattagacagcagctcaccttcctttcccatggtccggctgtaaggcgtgtagtaaccaatgttgcctgagggcctctcacccctaactctggggtgcctgagccttgtgagattacagggcagttgaatctgcgtttttcttttctttttttttgagacggagtttcgcccttcttgcccaggctggagtgcagccgtgcgatctcagctcaccgcaacttgcacctcccgcattcaagcaattctcctgcctcagcttcccgagtagctgggattacaggcacgcgccaccacgtccagctaattttgtatttttggtagagacggggtttctccatgttgttcaggctggtctcgaactcccgacctcaggtgatcctcccgcctcagcctcccaaagtgctgggattataggcatgagccactgcacctggcctttcttttttgtgtgtgtgtgtgtgtgacagagtctggctctgttgcccaggctggagtgcagtggtgcgatctcagctcactgcaacctctgcctcctgggttcaagcgattctcctgcttcagccttccaagtagctgtgactacaggtgcctgccaccacacccagctaatttttttgtatttttggtagagacaggtttcaccgtgttagccagggtggtctcgatctcttgacctcgtgatccgcccatctcggcctcccaaagtgctaggattacaggcgtgagccaccatgcctggctgagtaattttttttaaagcaaattgctagataagtttcttactaattaatgacgaaacatttcccttctgtgcttgaagactgactgtgagcctcgtcagcctgacatgagtgaagccttgggatcctaggatggagacgtggggttggggcggctcaggtgcgtgggctgagcgctggcatcgtgctgctgatttcctgacttcgcccagctccttgcactttgttctttctgcacagaatcagcttaaaatggctcgtttcaccattgtggatgggaagatggggaaaggagtcagcttcaaagacgtggcaggaatgcacgaagccaaactggaagtccgcgagtttgtggattatctgaaggtgaaagcagcgtgggccgggagggaggtgtgagcagaggccggccgtcctcctctcccagaagggctcctgcgggacctggaattccatcgatgacgtgtcgtgggttggcggtgacctctaccatgtcccatggggacaccaagcaggtgctggtgcctgttcaaccagcagcacaagcctcgtgcacatggttcagccaagcagaggctgccaagacccatgcctactgtgccgttagccgtcctgggcccttcatcccttgcaaagctctgtgctttttccagaaccacataaacaccttagccagttggtggcagtgcatgagctgcctatcacgtgcgtcacttacacgtttcctccgcgggcctggtacggtgggtcgcacctgtagtcctggcacctcgaggggctgacatgtgttccctctgcaggcctggtacagtgggtcacgcctgtagtcctggcacctcggggcgctgaggcaggggagtgactgagcccaggagtaggagatcagcctgggcaacagtgagaccctgtctctgcaaaacatttttttatttaattaattttttttttcgagacagagtctcactttgtcactcaggctggagtgcagtggcacaatctcggctcactacaacctccacctccccagttcaagtgattctcctgcctcagcctcccgagtagcagggatcacaggcgcccaccaccatgcacggctaatttttgtatttttagtagagacggggtttttccatgttggccaggctggtctcaaactcctgatctcaagctacgcgcctgcctcagcctcccaaaatgttggaattccaggtgtgagccaccgcacctggcctgcaagaagtttttaaaagtagctgggcgtggtgccacatgcctgtatattcccagctactcgagaggctgaggtgagagggtggcttgaacccaggagtttgaggctgcagtgagctatcatggcacccactgcactccagcctgcgtgacccagagagaccttacctctaaaaaacaaaaaaacggaatccccaagtagttagtgttgcattgtctgctgccgtccagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggtaggtgctgtggttgggggctgtgggtgggcttggctgactacctggctcctttcacacatccttcctctggtgtctggactgaaagggacacgggtgggtgggggagtagagaaggaaagcgaggtctgggttggcggaggggttttgtctgcgaagcacatgatgtttgcttcaaagccaccgtcacttgtggcctggggggccagcacggtgcgtgtgaaccctgaggggtggccaggggcccccgcgagcagctgccgtgtgtctgtttgtagggaatggagctggtagctttagttgtccttggtgtagaactttgtctggcccgggtacaggaagaggctttgttttttattaactgcccatttcctgattctctctgtgtcccctcaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtcagtgctcgtgcgccccgcacccccattgcaccatcagaggaggttttccgatgtctttcagaacaggttgtggtgagccaagatcgtgtcactgcactccggcctgggtgacagagtgagactctgtctcaagaaaaaaaaaaaatagaaatgtagctttcagacccggcgcagtggctcacgcctgtaatcccagcactttgggaggccaagacaggcggatcaccagaggtcaggatttcatgagcagcctggccaacatgctgaaaccccatctctacaaaaatacaaaagtcagccgggtgtggtggcaggtgcttataatcgctagtactctggagaatcgcttgaactcgggaggtggaggttgcagtgagccaagatctcaccattgcactccagcctgcctgggtgacagagggagactccatctcaaaaaaaaaaaaaaaaaaaacacagcttttaattaaaaaaaggtcaagacaatagtaaaaaagacaagtaggaatataagtggtacgtcagatgtaatctttccttttcttttttagatagtcttgctctctctcccaggctggagcgcagtggcacaatcttggctcactgcaggctctgtctcccgggttctcgccattctcctgcctcagcctctcgagtagctgagactacaggcgcctgtcaccacgcctggctaattttttgtatttttagtagagacggggtttcaccgtgttagccaggatggtctcgatctcctgacctcgtgatccgcctgcctcggcctcccaaagtgctgagattacagacgtgagccttagcacccaggctttttttttcattattactgttttttaggggctttgcagcaaaacccagagggactgctagacagattctggaagagctgtgccactcataattttaggtgtaatgagtctgtctggttgtgctgccacgtctctccctgtgccccctggagagggtgtgacgctggttagagggcggagcagagcatcagggtgctgcactgcagcgagggagacaccccatttgttgtgaccccttgaaaatgacttctggtctggctttgacaatttttttttttaatggagctgacccaataaaggtgacatggaattatttttcttctgagctagttttgcaagattattattattttttttatgtggatattgttgtggtaaaatagatagccaggcttggtggtgcaggcctgtgttcccagctgttggggaggccgaggcagaaggagtgctggaacctgagctagggagtgtgctgtgcgatggtctcgcctgtgaacagcctctgcattgcagcctggacaacacagcgagaccctgtctctaaaagacaatgaatacgttcacatagatttaccattttaatcattctgaagttcattgacattcagtatattcgcactgttgagcaaccgccaccaccacgtgtctccagaactttctcttcaaaccgaaaacctgtccccattcaaccctccccattctccatccccagccccttgcagcctgtgtcccgctgtctgtctctgagtttgactgttgtagggacctcatagaattggagtcctacagtgtctgtcctttgctatccgccttctttcaagcacataacatctctaggggccacctgtactgggcacgtgtcaggatttccttcctctttgaggctgaacgatgctgccttgtgtgtaggggctgcgtcttgttatttgcccgtcggtggacatgtggactgtggtgaatcaggctgtgttaacataagtacaagcatcttctgaagtctctgctttgtaagatttatttttaatcagaattctagttacattttaggtattgtagatgagggagactttttttccccaagtgttctggctccgagagagccgttgacttcctgttttctttgttgcctgtggctgtctggagtcgtgtgtgttagcacacatgcacagcccagttttgactactcagctaagggggagcttgctccacctctcattgcaaaatcactttagacttacagaagcgttgccacggtagtcagagtgttctttgatgccttcctgcaagctccctgaaggctgactgtgacatacatggtctgcaggttcggaccaggccacgctgtccgtgactgccccccagacccatccacaggtgcttccgcccccccgatgtggatgtttggtctccttggtctcttcccctcctgtgtcatttgttggtcttgttttttgagacagggtcttgctgtgttgtccaggttggtcttgaactccttggctcatgcaatcctcctgcctcagcctcccgagtagctgggattacaggtgggcttcactgttcctcagtgtttgtctttggtgactgtgacactgtacaggccagtgacattcaggaatgtcatctctggaactgtgacatgtcctcaggatcaggtcgagcagtgcatttggcaggattggtgcagcagtgctgtggtgtgccttgaggtttacagtgtcgctgcacctgtcgctggcggtggactctgctgaggactttggccctgggctggcatgcatctcttctgggtgctccatgttccctgtgctggcgcccgtctcttctgggtgccccgcgttcccgtctgcctctgggctgctgtgaagtcaggtagactgatgcccacagaagtgttctctaggctctgaaagctctgaggttagaagatgaaagtgagattcccgacagtgtgcaggacgcaacgacgtttgcggagaatgcttcacacctctcctgctgcttgtcccccgtgtctccagtcgtctctcaacacgcttattcaggaactaacgcgtgagcaaccgagacctgaatggctgccttctgcacacacagcaagtggtcatgggagtcgagttttcagagaacacaatgtcttcagagatgtggggtgagcagttcagattctgtgatgtctgaggtgtcactgaggagagacccgtcctcagaggtgggtccttggggttcagggaccccaccgcctctgctgggagagctgccctgtacctcaagcggagatcaccatgcgttttagaggcctctggagcctacaggctcgctgtactgcttctctgcagagcatctttatgtggcctctctggtgctgtgtggccttcagtgtggcctctctggtgctgtgtggccttcactgtggcctctctggtgctgtgtggccttcactgtggcctctctggtgctgtatggccttcagtgtggcctctctggtgctgtgtggccttcactgtggcctctctggtgctgtgtggccttcactgtggcctctctggtgctgtgtggccttcactgtggcctctctggtgctgtgtggccttcagtgtggccgctctggtgctgtgtggccttcagtgtggccgctctggtgctgtgtggccttcagtgtggcctctctggtgctgtgtggccttcagtgtggccgctctggtgctgtgtggccttcagtgtggcctctctggtgctgtgtggccttcagtgtggcctctctggtgctgtgtggccttcagtgtggcctctggtgctgtgtggccttcagtgtggcctctctggtgctgtgtggccttcagtgtggccgctctggtgctgtgtggccttcagtgtggctctgaccattgcttctggaggctgctcaaggatgggtgggtggtttgggttttgaggaaatctgcagagcaccttgggttctggccgcagagtctgaggactctcggtgaggcgggtgaggcgggtgaggcgggtgaggtcaggtgaggcaggtgaggtgaggcgggtgaggtcaggtgaggcgggtgaggtcaggtgaggcaggtgaggtgaggcgggtgaggtcaggtgaggcgggtgaggtgaggcaggtgaggtgaggtgggtgaggcgggtgagggcgggtgaggcgggcgaggtgggcgaggcaggcgaggcgggtgagatcgggcgaggcgggcggctgcgctgctctggctgtgtggcgtggacaccaaggtcttcgtcctgtgagtctgcggccttcttctccaaccaggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtgagcttggcagtgcttgccgtgagctctttcaggtccaggctcccagtgtctgggcagtgaatgaggtcctgggaagctggggtcctggtcctggtcccagtgtgacccgggacacccctacctttgtccttaatgtggcagtaaatgtatcaagcacgctctgccctgggagccgtggactgcctgccaggtgggtagatgggcgctggcagagggagaagctgaggcccagcaggagccggccgtctgactcacaactcacgcccgccgactgcccctgtacttccctgggggttgcgagcactgccgagccctgggtgacgctggtgtggccaggctggagcgcagagaaccacacttggggttcagagtgtgttctcccactcagaagcattggctctgccgggagcgggatggggatgcagctttcttccccattttagacctcaggttggaagggcgcactcaggtggcagcagccacttcgggttgggcgtctcgtgctgtcctggtgcgttgagacatccctcaaagaaagcacgagtaccctccacacccacatagccagggcatccactgtcaccactccatgtggaagtcctgttggtaaaatcttgacaagagccatttagagagcacggggggaaattctcccaggtccaagcagaatggacagtgagcctgggggacggatggacaggaggaggcctgggcttctgggctccgcaggcagggaggggccggcagtgtggcttattccccgggtggacgaggagccctgggcttctgggctccgcaggcggggaggggccggcagtatggcttattcccacttgagtcagctcttgagcacttgctcgtggcccagaggtgatgctgctgtttctgccctctgtcctctcagaggaagtgggtgctggttcaaggatctcaggctctgagcgggagagcggggtcaggtctagcttctgtccgtggcttgctccctgtggtgctgcctctgcctgccctgccgtcttccacatgcgtctccaacagggaatggaaggagcctctgacccaaaaacatcccccaaactgtcgggtcctgcggcaagttgagggcctctcaggggtcctgtctgcggccctgtgggaagtgaggctgtggcagccggtcctttatcctgagtttggttgcttgttttttggacaatgtcttaggtcccagtgatggtggaccagcaggcagccctgaacactgaggatactgtgggaaacccaggcaggagctaaggggtgggagctcagggcttgggggtgcagatctcgaggcccaaggggccattttcccagtgggtgtcttgactgagttctgagtgttttccagggctctgaacacagcccttttttggacatgtggtttacgcactctatgtgtcccttgtcctttcaccctctaacggggaacagcaaaagctgctcattttgataaagttcagtttatcaatttttgcttttatagatctcgtttttactgtgaagtctaagaactgtttgcccgccgggcatggtggatcacctgaggtcaggagttcaagaccagcctggccaatatggagaaaccccatctgtactaaaaatacaaaattagccgggtgtggtggcgtgtacctgtaatcccagctacttgggaggctgaggcaggagaatcgcttgaacccgggaggcggaggttgcagtgagccaagatcgcaccattgcactccagcctgggcaaaaaagagcgaaactccttctcaaaaaaacaaataaataaaagaactgtttgcctattcctagatcctaaagattttctcctgtgggtttcttttttcttttctttgagacagagtcttgctctgtcacccaggctggagtgcagtggtgcgatcatgggtcactgcagcctcagcctctgggactcaagccgtcctcccgtctcagcctcctgagtagctgggaccacaggtgtgtgcaccaacatgcctggctaattaaaaaagaattttttttgtgtagttgggggtctcaccttgttgcccagcctgctcttgaactcctgggctcaaatgatcttttcacctcagctcctcaaagtgtggggaatacaggtgtgagcccccatgcctggcctctcatgggtatcttatagaagttttatatttaatccatgatcttattttaagttaacgtctacatgaagtgggaggtttggtcaggttcattttctgcctgtggaaaagtgctccagccccactggtctgaaatgctgtcttctttccaccaagttgtgcttgcacctttgccggagctcaggtgcatgtgggggtctgtgctggctctgtgagtctgtccttccgcacacaactggtctctcgcttctgtgagacgagagcaggtggagtgattcctcccactttgttctttaccagaattgtttcagctattcctttgccttttcctgtaatttttagaatacgcttgttcctatctaccaaagtatcttgctgagattttgataggaacacacacctcttaggagagctagagtaaagagcagtgaccggcccagatctgggccatacgtgtgatcccagcattttgcgcgtctgagttggaagcattactttagcccgggagtttgaaaccagcctgagcaacatagtgagattctgtctctaaaaaaatacaaaaattagctggcagtggtggtgcgcacctgtagtcttagctgctcagaagattgaggtgggaggatcacttgagcctggcagttcgaggctacagggagccgtggtcaccccactgcactccagcctgggcaacagggcgagaccccatctcaaaaacaaaacaaaactcaaaaaacagtgacaacaccacacgctgctgaggatgcaaagaaaccagatcccttgtacgctgctgatgggggtgtgacgtggtgcagcctcactgggaaacagtttggcagcttcttaaaaaactaaacgtgtgctcaccatgtgaccccgtgtccacatgcgctcaccacatgaccccgcatccaccctcctgggtgctcatcccaggaaagcaaagacttaggctcacacgaaatgcctgggcgccgacgctcatttacctgtaatagctaaaaactggaagtgacccaggtgccattcagtggctgagagctgaaactggtgtatccttatcacagtgttctacgcagaaatagaagagctgaaactggtgtatccttatcacggcgttctacacagcgactagaagagctgaaactggtgtatccttatcacggtgttgtacgcagaaatagaagagctgaaactggtgtatccttatcacggtgttgtacgcagaaatagaagagctgaaactggtgtatccttatcacggtgttctacgcagaaatagaagagctgaaactggtgtatccttatcacggtgttctacgcagaaatagaagagctgaaactggtgtatccttatcacggtgttctacgcagcaatagaagagctgaaactggtgtatccttatcatggtgttctatgcagcagtagaaggaaactttcttcctgcagcaacaaggaaatgacgcaaagtgagaagagccaggcttagtatcgtatgactccacttgtacgaaattgtcaaaataacaaaattctggggatggagaacgggttactggttgtcagcagttaggggaggtctccagggaggagggatgcctctggggagggcggttctgtgtcttgaggggagatgctcgttatgtgaacgtgcgtgtgacacaggtgtccatctgtggagcacacacacaggtgagagcacataggagtgggggcatctgagcaggggcctggcgtttccatgtcagtctcctggctttgcctttgttttgcagctactgaacgcacagctgctgggggaccagggccaaagggactgctctgtgctgtttttgcaatttgttgtgtgtctgttaccatcagaatacaaaacttaaaaagtcacaccagggatccggtcccagaaagtccgtatcctgaaaccgcatgtccctgacacatagctgcccagggggagcatgtgtccagtcccaggaagtctgtatcctgaaaccacatgtccctgacacatagcggcccggtagggagcacgtgccctgcagggtggccaccctgatacatagcggcccggtggggagcacgtgccccgcagggtggccatcctaacacatagcggcccggggggagcacgtgccccgcagggtggccatcctgacacatagcccggtggggagcacgtgccccgcagggtggctgggctctgctgaaggccgagctgtgcttgaacccggcgccgccccctctaggagctcgcactgcacctctttggcctggctgctgtttttctttgagaccggtgttcctattacttttcccatttttttcactgtttatacaatctttcagaattctgtatccacagccctggcctctgcaaggaaggcgctccacgacactgagcagtaagccttggcaggccttccagacagctctggaggggccagcttgggtcccagtccccaccctccccagcctcttgttcctcgtgtcatagtgagacaaggcacttgtgcttctgctgcctgtttttgtttctgagtttattttaaaagtcaccgtgattttaagacactgtctttgccttggcgaggtgattctcttctgtgatctcccttgtagaaatgtgactgggacttagcatcccagcttatcacattctgacgtgtggaaccagggagaatggttgtgtctttcaaagtttctttgaaattcgggagcgatttgcttgggagtggggtgtgtcttggactgagctgctgtccagacctggcggctacggcttagtgaggctcaggacagtggccctggagaagctggtcaggcccctcagcctcctcagagcgttcaaggtcctgtcctaagaacatggggttgctggagccagggtctcactccattgcccaggctggagtataggggcatgatcatagctcactgcagccttcacctcctaggctcacatggtcctcccaccttggcctcccaacgtgctgggattattaagggtttcttacattagtcacggtagatcctgctcttacattagtcatggtagatcctgttcttttttttttttttttttttttttgagacggagtcttgctctgtcgcccaggctggagtgcagtggcgtgatctcggctccctgcaagctccacccttcaggttcacgccattctcctgcttcagcctccggagtagctgggactacaggcgcccgccaccacgcccagctaattttctgtatttttagtagagatggggtttcactgtgttagccaggatgctctccatctgctgaccttgtgatccgccctcctcggcctcccaaagtgctgggattacaggcgtgagccaccgcgcctggctatatcctgttcttacattagtcacgggtcctgttcttacattagtcaaggtaggtcttgtcgtatctttacttttaacactgtttattgtggaccttttcctttttttttttttttttgagagtcttgctctgtcgcccaggctggagtacagtgacacaatctcggttcactgtaacctctgcttcctggttcaagcgattctcctgcctcagtctcccgagtagccaggattacaggcatgcgccacacccagctaatttttgtattttagtagaaatgaggtttcacccttttggccaggatggtctagaacttctgacctcaggtgatccacctgcctcagcctcccaaagtgctgggattacaggcgtgagccaccgcatctggccaccagtggattctttttttttttttttttttttcctgacggagtcttgccctgtagcccaggctggagtgcagtggtgtcatcttggctcactgcaacctccgcctcccaggttcaagcgattcttctgctttaacctcctgagtaactgggattacaggtgcacgccaccacacccggctaattttttgtatcttttgtggggtttcaccattttggccagtcttctcttggactcctggcctcgtgatctgcctgcctcggcctcccaaagttctgggactacaggcgtgagccactgcacctggtggactggattcttttaaagcaaacccatagttttgaatcttatatgctctgagtacgtttctttaaattcagagaaacaccacagcatcataacacctgaacgttcttacgagcatccagtcaggtgttcccagcagcttcataaatctcttttcgcagttgatttattcacatcaagggccagtcaaggttcacatacaccagggatcagtgatcgtttctggactcacttttaaattctccgatgacaaacgtcaagcctgaaacccagggcctagggccagacgttgaagataaaatgtttccaagtcacagcctaaagctgggtgttagctaaaatgttacaaagtcacaataatgatgacagggcggtggggggtggggggtggctgttaggaccggctcccagatggcaccgtgaggcagggagaggctccaggatgctgtaggagctcccggagggccttggacagttctgctgtttgcacttgtcaaaataggcaaattcctgttcctcctggtgatgctggctgggagcgatgggggatcgcggctcctagttcagaaggaccgggctgttcctttctctctgggccttaggggggtctctctccctcctgtgtcctgaaggggaacctgcaggggaaatctgttgtgtcaggacccctaccctcagagccactgtctgctctgtcccctcaggaatgggtaccacagaccatgtcatcgtcctggcgtccacgaaccgagctgacattttggacggtgctctgatgaggccaggccgactggaccggcacgtcttcattgatctccccacgctgcaggtcagagccaggatcccagcctctcccactccacctgggccgcccccactcgctctgagtggtctggcctctcctctaagacacttcttggtgtgaagcctgtcacagccccacaggtgctggcagtgtccagcgtggcccccgcatcggctgcacgcccccagcagacctgcccaccggctgcactcactgctgtggcccccacattggctgcacgccccctggcagacctgcccaatggctgcactcactgctcggggttttgcagttctgttcacctgctattggttttccttttatcctgggtatcagtctggtttttatagcaaatcctttgaaacaaaatccaggaggaaaaattgtgggaaactttattcttgtgtggcatcacttccttccatccgtagcgtgggctctggggacgtggactgtgcagctgccctgaaattggggtgggagtagaagtcctgaggcctctcgcctgatccctcctctgtcacagggctctggttggacgttacacttcctggccaaagggcctttgttgctgccctgagggagcaggagttcagctcatggagcggagggtttggagagagggcctccgggtctgctggtgggttaatgttccatcagtgcagcctggggagcagggctgggctcagcggctctcagccggtgctcagtctctgttgggatggagagtgaagggcggagcagaagcccttcccgctgggacacggcttctccaggggacactgcttctccaggggacatggcttctccaggggacacggcttctccaggggacatggcttctccaggggacactgtttctccaggggacactgtttctccaggggatggcagcttctccaggggacacggcttctccaggggagggcagcttctccaggggagggcggctcctggctttttgactgtgtaagaaacattttacatcaggatttagacgcatggaacatgtgtgggaattggaagttttgcagaataagcatttgctgtgtgtgacgtgcttcattagctattctgctataattttttcttttttctttttaatttttctttcaatttttagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggtgtcaaacccctggcctcaagtgatccccacccacctctccttccaagagcgttctcttttttttttttttgagacagtctcactctatcccccaggctggagtgcagcggcgcgatctcggctcactgcaaccaccatctcccaggttcaagtgattgtcccgcctcagcctcccgagtagctgggattacaggcacccgccgtcttgcctggctaatttttgtattttagtagggatggggtttcaccgtgttggccagactgcccacttcagcctcccaaagtgctaggattacaggtgtgagccaccgggcccggccatccaacagtgttctgttcgtgtttaaaatgctgcttgtggccaggcatggtggctcacgcctgtaaccccagcactttgggaggccgaggcaggtggatcacttgaagccaggagttcgagaccagcctagccaactttgcgaaaccccgtctctactaaaaatacaaaactcaggcatgatggcacacacttgtaatcccagctacttggggaccccccccccccacagacaaacatgccgcacctgtggcagtaactaggcttgagcccgactgtctttcctcccctggttctggcaggagaggcgggagatttttgagcagcacctgaagagcctgaagctgacccagtccagcaccttttactcccagcgtctggcagagctgacaccaggattcagtggtacgttctcaacccgcagcctgggcagcgtcacgtcctgagggcaggtggtgtcacctgcgcaaacagcatcgaggcctcctctgtggggtgggcgctgctccttctctgggggcctctgctcagtacaagcctgggagggagctgatgtgtatgtggggcagcaggaggtccagacggcacccgcactccgtcctccgccccggggtggaaaagcagacggtggttcccggtctgtgttgtttccagagatagtggagttatgttgcttccacacagtgaccagtcatgccggcgtttcccgtcagacccagagtcagaccacgcagtcccggcaaagccgcctccctctgaccctcacggtctctgtcaagttgtagaaatagaaatcatacctcaagatgcttttcctgctgtgtggttcacattttaaaagttaatgtcaacaaacctcccttttattatgagatgaatttgccctttgattattcgttagggtctttcactagaattttgtggttactagagagcctttaatttctttgccatcaatgctcatgagctgttaggtggaatcagccacaagatggggtgtggaactaactgcccttgggaggagagacgggcgtcagggcggatggagcctggcggttctgtgtctcgtctgtggaatggcctcagtggaacacggtgcaagtgcctgccgctctccccacccctgctcctggcgccggcgcctgccgctctccccagctctgctcctggcgccagctccccgtgcctctctcccagacgctctcaccagcactcttggttcttggtctcttttccctctttgttcttccttttatttatttacttatttattttgagacagagtcctactctgtcgcccagactggagtgcagtggcgtgatcttggctccccgcagcctccgcctcctgggttcaaccgattttcctgcctcagcctcctgagtagctgggattacaggcgctcaccaccacgcccggctaatttttgtatttttagtagcaatagggtttcaccctgttggccaggctggtctcaaactcctgacctcaggtgatctgcccacctcagcctcccaaagtgctgggattacaggggtgagccaccatgcccggccatctttgttctcccttgagggccccttcctcctcttaagccctgatagcagaaacccacccacccacaccgtggctgtttgtgttgacaggggctgacatcgccaacatctgcaatgaggctgcgctgcacgcggcgcgggagggacacacttccgtgcacactctcaacttcgagtacgccgtggagcgcgtcctcgcaggtacagggggcgcgccctgggtgaaggccctccttagcagggcttgaaccccagaaatacccaggcaggtattgagaggtgaggtggatggaaccatcacacaggaaggaacacacgttgcgtttcagttctgcgtaactcatgtctttatgataccttgtacttttccttagtttaaaatatcacagatttacctaagagtagacgctcgtccaacagaaataaaaaatgccttgccaaagaaagtgaaaaaataaaaataaaaaatgccccccaaaaataaaaataataaaaactaaaaatgtcttgccagcctgggtgtggtgggctcagcctagccccagcctcatgggggctgagctccagccgctgactgtgggccggagggctgctgccgcccgtggctgtggagggacagccgtgctttcagcgcagcaggggctctgcggagaggtgtggatctgcagcaccacctctggtgaaactcatggtcccgaccgtcagtaggaacgggagatgagttttggtgacgggtgaccggtgggctgaccgcctctgactgccgttccgtggctgctcagtgtggggtctgcgacgtctgtgaggagagaggaccaaactgggaatcggagctgctggaggtttccatagctatgatggcaacacccagacgtgatcagtcatctcatggaatggagttcagacccgcactgtcagtgtgagacaggttgaacgtttgaaaagggaagtggttcttgccccaggtgtttgaggagcacgagcctcctttgcgagctatccctgcgagaaccgagttcctcaccctcaattcgagtgaattcctagcacgaacacgcctcttgcaggtccccagggcttcagcttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccagtaagctgaacaggggagatttaatgcaaacatttgtccctggctgggcactgtggctcatgcctgtaatcccagcactttgggggctgaggcaggagggttgcttgaggccaggagtttgagaccagcctgggcaatacagcaagaccccatctcttaaaagaaaagaataaagagtattagccaggcatggtggtggagcacacctctggtctcagctactcaggaggctgcagcaggaggattgcttgaacctgggaggttgaagcaacagtgagccgtgatcgcaccactgccctccagcctgggcaacagagtgagaccctgtcactgacagaaaaaaagccttgtccctgaggcaaaaagcttctgaaggggtgagtagaagccataaggatccagaaagtgatggggatgggagctgcgcctccaggtctgaggggagagggaaagtaagcaggaggcccgtaactcagaggaggcctctgcccatcctgccagggagaaagtcaaaagctgctgttctgtgacccttgccccgaccctgtggcacccccccaaccatggggcaggaggagacactcctcagagggttgcacttgttcctaaaagcagcaggagctatttcgatgattgcaacatttataaaagaagaaatcacgacctccttcaacagccctttgacctgaagagtgtcgttttgagttggggtgtccagagccgcagctgcagctccaagaggcagatgtgcagagagaggcttgctttgaccacacggggcaggagcagggcccagccagggagaggccggggtctcagctcacccccccgtcattcttttttgtttgttttttgagacggagtcttgctctgtcgcccagcctggagtgcagtggcatgatcttgccctactgtaacctccgtctctcaggttcaagtgattctcttgcctcagcctcccaagtagctgggactgcaggcgcccgccatcacacctagctaatttttctatttttagtagggacggggtttcaccatattggtcgggctggtctcgaactcctgtcctcaggtcatccgcccgccttggcctcccacagcgctgggattacaggcgtgagccaccgcgcccaactcataccccggcattctttcagggactgccaaaaagagcaagatcctgtccaaggaagaacagaaagtggttgcgtttcatgagtcgggccacgccttggtgggctggatgctggagcacacggaggccgtgatgaaggtgggtcttggcaggtgccggctccacgggccttggccaaaggtgggtggggagtcccgcctgtgtctgtagctgactggggagtcccgcctgtgtctgtagctgactggggagtcccgcctgtgtctgtaggtcatgtgagaggaaagcctgccactgtcatgatccatggagcagggtgggtggcgactgatgggcgggaactcggacgtgggaggcaggagtgggctgtgtcacatcggagcatggtgctgctactggggtgactcgtggaaggttacaccatgcaatggggtttcgctgcctttgcctgtccaccccaaatgactcctaacattggaaagaagtgagttgagtgtacatttaaaaaatactattctaggctgggcatggtggatcacctgaggtcaggagttcaagaccagcctggccaacagggcaaaactgtctctacttcaaacaaacaaacaaaaaactactcttgtaggcagctgtgaactcgatggacatttattcttaccaaatggtgatgttacagcttctctaagacgtggctccaccaccgggagtccgagtgctgccaagaggaggtctctactcggaacgcaggtgccgtctttacagtggagccccaggaagccgtgcaggtttgaggctcacctgagaaggcggcagtgctgtgttcctacctcagggttcactgcaaacaatgcatacgctgtagcagttgccagcttggtttgtcagtgctggtctccgtgattggttctcaggtgtgagttgtagcaaagttgcgtgttaatcagagagcgtcctgcccatcccagggtctcagcagggctgaggcagcgtttggggaccagatccgtgctgctccttggcgatgtgcaccacagtcatgggaccagagctaggcccactgtggggcgagtggacactcagctgggggtcccatttatgggacactaaaaaactcagcagtgaacacgacgttttaacacggtatgtcaagaaatcaaaattaatgcagggactttgggaggccaaggcgggcagatcacttgaggtcaggagttcgagaccagcctggccaacctggtgaaaccccatctctaccaaaaatacaaaagaattagctgggcgtggtggtgcgtacctgtaaccctagccacttgagaggtagaggcacaagaatcgcttaaacccgggaggcagagtctgcagtgagccaagactgtgccactgtactccagcctgggtgacagagcaagactgtctctcaaagggaaaaaaaaagaatttttactgtatttgatgggcaaaagtcagatagtcacaatgaaaaagtgagtctctttcccaaggctcagtgtcctgccaggaaaaggttgtgaattggctgttatggttttggtcattaatgcaatcatcactgcagccgttatttagagcttctttttgttttgagacagggtctctctctctgttgcccagaccggagtccagtggtgcgatcacagctcactgcagcctcgaccttccgggctcacacgatcctcctacctcagcctcctgcatagctgggactacaggcatgccccactggtggctcgagtgatttttatattttttgtagcgaaggggtctcgttatgttgcccaggctagtctcgaactcctgggctcatgcaatctgcccacctctaactcccaaagtaccgagatcacagatgtgagcgaccccgcccagcctagttttagattttaaattaagcgtcctcgggattctcagagcacttggatgtggccatctcgccgccacaattctcagaagcagcagctgggccagcccctgccccgtctccgtccgtctcccactcagcggttccgtgttgtcgagttagctcgttgccccgcgccacctccttgcacacctgatgtggggctgtgggggagcagcagaggtgaggacagcctctgctgcctcagcatcgtggggttctcattgctctgaaccctcagtagctgtcgctggtgtgaggggtcagcgcagcggccatcgggggtgaaacttgtccttcgcctctcagctgtcttctacgggccttgtcttcttgactccctgcctgtctagtcatgtatgagaagacacttcccggcagtgtgtgaacaggcacctgtggtgggaacgctgctgtctctgggctggccatctagagtgttaggatcccctgttgttgtagaggatgctgcacatttgccttcctgctttgagacgctttaatgacggagacctcttagtcccacaccttcctcctcaaagcccacgcatcctgcctactgacctgggtcatcttgaccttgtgccaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggtgaggagcagcggcgcgggccctggaggtttcagagcgcttttccctgcatgactccttctgttccagtgcatgccatggggtgaatctggtgtagacgtagctttgaatttattaagtattttgtaaaagataagttgtggtcataagagagttggagctaagcaagacttcttagataatttaattggacaaaaacttaacctatatgccaactctagacacatttaattggttaattgttggtaatggctacaggaaacggaataaaattgaagcggcttcattgttctgaagccattactgcactgggatatccagagagctgaaggagggtcccgggggcccctgggctccaggtccatgggtttgcctcgcataggcctgggcttgtgcttgagaactgccatgcagtgagctccagtatgcccccgggttctagatttccaaataaaagagcatttcggaaagttttaagactctcttaaggaacagtggtgaggtgccaacgtcctcactgtccagcttcacggtgggtcctcgggaggaaggggatggaggtggtgctgcctcagtgctctgaccgggacacctggggcccagcactgctctgcgcctgcagtgctgaggatgcctctgtctcgaccccgccctccaggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgtgagtcggctctggccacaccgctgccctctgtgctccccggggagggagtccctgggtctaccacacaagggtcgcccacggccgccccagcggagctcagctgcaggccccacctgggtttcttccttctgggctctgctgtagttcccacctgtggagtattttcttctcaaatgaggacatagatgctcctaatgaaattatagatgtgaatctgggaagaatatcaaataaatacaccgagcaatagacccagggcccacatgtccttcagactgggccaggaagggccgatgtgtgcctgtgaggcagctgtgggtgggtgtgggtgggtgggctggcatgcggagccctgctttcctggcactggtcacaggggcaggagaccacctgtcggctgaggagtcctgttcctcctgggaggggaaaggccgtgttcccagtctgccatttcttttctgtgctttggtgctggagccaggcggccagccttgcccctgacacagttccctccactcacaggaagcaagactgctggtggccaaggcctacagacacaccgagaaggtgctgcaggacaacctggacaagttgcaggcggtgaggccctggccaggcgtgggggctacggcgtcacacagtgtccacacagcacccacggtccccacccctctcgtgaagtatttccaaggcacacagagtacagagaacactctgaccgatgtgaattctacccagctcaactgaaacttacgtgttccatactttttatcctgaactcgtcaagtgtgttcccccgaggtagaaagaaggctgccacagtctcctgtgcctcttcctgccattagcaattaccaatgttttgtcagttttgtttaatcttttcccaagtcttacacttttttcttgaacatttttttaaaacaaagctttaattttagagtaggaatttttttttctttttttttttgagacaaagtcttgctctgtcacccaggctggagtgcgatggcgacatcttggctcactgcaacctctgcctcccgggttccagtgattctcctgcctcagcctcccgagtagctgcgactgcaggcatgcaccaacacactcggcttttcttttttttttttttttgagatggagtctctctctgtcacgaggctggagtgcagtggtgcaatctcagcttactgccacctccacctccccagttcaagcattctcctgtctcagcctcccaagtgtctgggattacaggcacgcgtcaccatgcccagctaatttttgtatttttagtagaggtggggttttaccacattggccaggctggtcttgaactcctgacctcaggtgatccgcctgcctcggcctccccaagtgttgggattacaggcgtgagccacagccccacgctgattatagtgttagatgtagaaaagttgcaggcgcggtgcagagagctccctgccaccctgcctcgctcccgtggaggcccccatggggcagtcctcccacctgaggagcccccgccgacccgcggtgttgggtccacacgtgattcagatgtgctgagtctccccagtgtcctttccggtcttgggagtccacatggcgtttgatcgcccatcttcttaggctcctctggggtgacagttcctcagacctcccttgttttgagggctctggcagttttgaggattggtctcatgttttgtaggacgttcctcagttgcgattgtctgatgtgtttctcacagtgggcagagctggagtgaacgtttttgtccctgggtttggtaactgctgcttagaactcaggagaggtgcacggctctttgtcccatgttgtgaacagatgggtaggcagtggataggtagttgtttcttcagcctccccttgtgtctttcaagcgagcactgtgtgtcacgtggggatcgtgtttggggcccttagactgtcgtccccagccagcagcagccgcctctgggcaggtgtgggcggtgccgtccccggctgaagcaggcctgcctgtggacccatgctcatcacggttgacaaagcagctctgcagagctcgggcacatcacagtgggagccacaacgggagcaaagctgcaggcaaggcttctcactggctgaggagtggtgtgtctgccccgtgtatgaactgtcagctactcacacactcagtgggttgcagaacttagtaaaatcccacaccagccctagagaggaagtgtttgtctcttgcaatacagccacaggtaaatcaccctagcttcaggggttaccattttctttagaaaatctggaagagtgaggaaaggagcaggtaattaacaacaacaacaacaaaaaatctggaagagttctgccttcacagaaaccagtgaaatgtggctgtggcagtgttttctgtggtctggccaggccaccccaggggcaggtccaccggcacaggacagtcggtgtctcaagtgttttccaggatcccacctagaatggcagaaattcacttccccaacttgagaggtcccagctcacacaacttcgcctcagattccttctcccagtgctgctctcctcaatcaggagggttcagcattttacccatctccttccctgtagacacacacgtcttgtttggtgaaagaaattgcagttgccaaaaataagccaagattttgaatagaagtagaaaaattaatgaggctggccgccggaaaatcatttatgaggttgagatgggggtgattcttctttcggagctgcctccgtgcctccgcttccctgggaaagtggcctgtcctgggtgtcctgcacacagacaggccctcacgcctcttgccacctccccaggacatagagatgctctgtctgccctggggactcacacactgctatgcctgttctttctagctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatct

SEQ ID NO: 38016 - DNA, 205998 bp, Homo sapiens; identical to SEQ ID NO: 37565

SEQ ID NO: 38017 - DNA, 65507 bp, Homo sapiens; identical to SEQ ID NO: 36904

SEQ ID NO: 38018 - DNA, 65507 bp, Homo sapiens; identical to SEQ ID NO: 36904

SEQ ID NO: 38019 - DNA, 63829 bp, Homo sapiens; identical to SEQ ID NO: 35906

SEQ ID NO: 38020 - DNA, 11093 bp, Homo sapiens
aactcattggcgccaagatggcgatggagatgaggcttccagtggctcgcaagcctcttagcgagagactgggccgcgacactaagaaacatctagtggtgccgggggatacaatcactacggacacaggattcatgcggtacgtggggacttgggggagtcgaggcttcagagagcggcttcagggctctctgcacgtggtccaggcctcgtatccctgtgtgtgtaactccccgcgggacccagggcacttcgtctgagcatcctacacacctcgcttccgagcctcgtgcttcttgctccctgcatcttgtgtgtccccgtctgcatttgtctcagctccctgaaaccctccactcctgacctccggtggctgtgacttttgggtcttctgcctgaagtccaaatctttgatccttccttgtgggagacctggaaagctggggagggttaggtgcaggctcttttccagttttcagctctctgaggggacggtgggcgttcttggctgcctcctcttcagtttagaatccgtaattgttcgatcttagggcaaacagttacattgtgctgcatgcacccatttatacacattttgaatctaaggggtgtagtgcagtgtattgtggttaagagggaaggctcttgagtcagacagttggggttccggtcctgctaccatcacatcttattagcggcattgcctctccacggtcagtttcctcatctgtaagatagtgataataacagtatgatacggtaatgaggattaaatgagacaattatgtaagaaaagaagtaaaaccagccattatatcatcatagataacactagtgtttcaacctttattattattatttttttacttgtatatgtacaaggggcacagcattcatagcattgccctttaacctgttagtttaaggttagtggataccaggaaatttttttttcttttttgagacggagtctgtcttagatcagtcgtgcgatctcggctcactgcaacctctgcctcctgggttcaagtgattctcctgcctcagcctcctgagtagctgggattacaggtgcacgccaccatgcctagctaatttttggttttttttttttttagtagagacagggtttcactgtgttggccaggctggtctcgatcccctgacctcaagtgtgatctgcccgcctcggcctcccaaagtgctgggattacaggcatgagccaccatgcctggcccctaggaaatcttaagattcattctttcattaatgctttcaacatatattttgtgcagttgggttattatggcagagtgaaaaatctctgtcctggtggagttctaacagggagagatagataataagcgcaatgaataagttattcagaatgttaggcaataatgcaatagggaaaaaagtggagcagggtcaatggtatgtggggggaatggtggcaacagggtgggctgtgttttcaatggcacagtcaaggtaggcctgctgcagaaagtgacacctgagcagacctgagtgagaggagtgatgtccaagtagctgtctggagaaggagcactgaaggcagagggagcagccagcacagaagccacgctttgcagggggagcctgttagctttgaggaacacgttgttcttgaagggagagaagtcatttcgagttaccctcgtatcctttctttgtatcttcgccttgcatcaggggccatggaacgtatatgggagaagagaagctcattgcatctgttgctggctctgtggagagagtaaacaagttgatctgtgtgaaagctttgaaaaccaggtgagaacaaaaggtgtgtattccctttcttgcagcatcaggttgtacaaccaggcttttcctgccccctccttatcccccaccccacccctgcctgccctgtcatgctgtaagtctgaggttttgaccatgactgtaggtggggtggtgcagatcagtgcaggcttcagaggtttccccatgttatgtcaccactccaagccttggttacctcctctgcaaagtgagtataatagcatggcctacttcataggattttctctttttttttttttttttttttccgagatggagtcttactctgttgccgaggctggagtgcagtggcgtgatctcggctcactacaaccttcgcctcccgggttcaaacaattctccttcttcagcctcccgagtagctgggattacaggcgccctccaccacgcctggctaatttttttcgatttttagtagagacagggtttcaccatgttggccaggctggtctcgaactgctgacctctgatgatttccccccacttggcctcccaaagtgctgggattacaggcgtgagccactgtgcctggcctaggattttctttagaattcagtgagatggtgcctgtaaagtatttagcacagagcctgatacctagaagcattcaatgaaggttagccccagaaagcaagccagtggggttggaacagagtgagtgagggggagagaaggggcagatgtaagcagagagctgaggtgggcgggcgtgggcctgccttgtagccagagtaagcattttggcttctactttgtgtaatctgggaagcactggaaggggtggagcagaggagggacttgatctggacttaagctcactctggctgctgatgggagattgaagggggatagggcaagcttagggaggtggattagggaccatactcatgatctgaagtgatggtggcttcaactaaggtgggagcagtggaaggtggaggagtgattggaatctacacagattttattttccgagtgtttttttaaaatcatgaaaagctgttgggttttgtattctttgggctttactgtgcataggaccccgtcaactgtgaatagaaataagtttacttcttcctttccaatttggatgccttttatttcctgcatatgttttaagggtagagccaacaggttttgctactggacttgtcctggagcgtgagagagagagaggaatcaaggaactctccgaggtttttggcctgagcaactgaggggatggagtcaccgttgactgagatggggacaactcatcccctatctcggtttgctatggaggactggagggggctgcgggaaagcttagttttgtgcttgatacatttgaaaatgcctgttagtcatctagatggcagagttgggtagctagcagttgagtaggatttggaattcaggagagtggcacagtcacagcacagagtggtgttttaaaggtattagattgagtggccgaaaagtgaagaggtctaaggacttagcctcagcactgagtacgtctcattagaatcgcgggtaaggaactagcaaaggggcttgagaggagcaggcagtgagtaagtggaggagacgtgagcagacttgtgtggttggagtcctggctcagatttcctttctcttcctttggctggtgcagaactcatccatgtgccacaggaaaatagtccgtgtttttcattgtcgtgtaatcgaacaaaatagggtttttgggctaaatgaactacttggaatggtgatatgtctaaggatagttaatggagactttatacgtggaggaatgtttgaagttagcagtttctgaaagtaagtccagacaatatagttacatgaatttgctgaatgtggcgcctgttccaggctttcaccctgttgaaccgacatctcaaatggtgtgtggtcttgtcagaaagtctgctcacagatggatgaaccccttgtgttttgtctttcagatacattggtgaagtaggagacatcgtagtgggacgaatcacagaggtaacgtcgatatcagattggtgtttacaaagtcgaggcaggctggcgatttcattcatgggacagtcattccacttgtagttacatgaaaaaggcattcattgcatttggccgttgtgtggcttctgatgtaaatatgtggcttgttcgatttcagattactggttcatgtttttttttttttgagatggagtctcgctctgtcgcccaggctggagtgcagtggcatgatcttggctcactgcaacctccacctcccaggttcaagcgattctcctgcctcagcctcccaagtagctgggattacaggcacccgccaccacgcccagctaatttttgtatttttagtagagatggggtttcattatattggtcaggctggtctcaaactcctgacctcaagtgatccaccagcttcggcctcccaaagtgctgggattacaggcgtgagccaccacatctggccttactggttatttatgatatgacacatgaacatggagcatgtgtccaggtgtggaacttggcttataggttcaacagaagaggtggaaggtggagaccaactccaggctggattcggtcttgctgctctcgtccatgaaccttcctggaggagagctggtaagggctacagctggggccatggactagggcccagtgggctggggggagccgtgggaccctttgttccaccagaggactttgatttacactgaggttgcccctttgactcctgtttgtctgctgtgaagtttgctgcctagatgtgtatgtagacttttcaccctgtccaggtctcccgaaagagggagcagttggcatatggtaggatcagaaacatccatggggtgggatcccaacagagagttggggagagaagcccttagatgctggttgttaacagttttcctttttggatataacagccttgcatagtgaagatgttccttgaaaagttgtctttacattaggtttttgtgaattgaaaggcatttcattcaaccatgtgtggaatgtggttgctggcattccagacaaccacagtaactaagccacagccttttgtaaaatgccatggttcaccttgatcttcagtccagcgtgtatttacagagaggcttactgtgccaagctctgtgccgagtgccaagcacgattgagttccccagcaggggatataagataactgacctagtccctggcagtagaagaataaataagctgtggttatacaaaaggaaatttcagtgagagaagcttgtaggaaagacaggcattggagttgatcctggaaggatggagagactttgaatgactagttcagggaatctgagataaagggaaatgtatgagcagagatatatccaagcaggagttagtctggtcctgctggaccacagagggctgtcatggaagatgactatggaaatgttggctaggtgagattgggaggggtctgaatgttcctcagagaagggagggaaagaggaagaggagctgtggaaaagtcttttgagatggaaagtcgtgattatcactgattcccctcaagtggcttgggttacctactcttgctatagttctcagtgcttgaatattgtggttggcctcaaacatctcaaaaggaagtgaaagagaagtgatggagacctttctgaggatctggcttaagtaatgtcatttctttgtgtatttcagaggagaagatctgcagaagatgagcttgcaatgagaggtttcttacaggaaggggaccttatcagtgtatcctgcgctttgcactccagcctcttgatgcttttctgtgggactgggaaatgggccttccattgtatgtctctgacggaagaaccatgtcatccttgcagggatccgagtcttagaccaagtgtcgggctctgctgcatcctttctcagtctccttaattcaggctgactccccagctcttgttgggacctgctgctaagtcatttctttgggtcttgtaacttacggtggcctgtgctttagactaggcttttgttaatggtgttaacttttagcgcagggagtggagaaggtgttgttcacgtcaagatattaatgacaggccgagtgtggtgactcatgcctgtaatcccagcgctttggaaggccaaggagggaggactgcttgagcctaagagttcaagaccagcctgggcaacatagcaagacccccctctctacaaaaaaattaaaaaagaattagccgggcgtggtggcacatgcctgtagtcctagctactcaggaggctggggccagagggttgcttgagcccaggagctcaaggctacagtaagctatgatcacaccactgcattccagcttgggtgacagaacaagactctgtctctattttatgttattttttaaatttttctttttttttaatgacggagtcttgctctgttgcccagactggagtgcagtggcgcgatctcggctcactgcaacgtccgcctcttggattcaagcaattctgccttagcctcccaaatagctaggattaccggcgtgcgtcatgcctggctaatttttgtatttttagtagagacaggtttcaccatattggccaggctggtctcaaactcctgacctcaggtgatctgcccacctcggcctcccaaagtgctgggattacgggcatgagccaccatgcctggcctctgtctttattttatttatttatttatttatttatttatttatttatttatttttttgagacggagtttcactcttgttgcccaggctggagtgcaatggtgggatctcggctcactgcaacctctgcctcccgggttcaagcgattctcctgcctcagcctcctgagtagctgggattacaggcatgcgccactatgcccgactaattttgtacttttagtagagacggggtttctccatgttggtcaggctggtctagaactcctgacctcaggtgatcgacctgcctcagcctcccaaagtgctgggattacaggtgtgagccaccgcacctggccttctgtctgtatttttaaaaaaaagatattcatgacaaccaaggggagaggtaaggtcacagtgatgtgctctgggtcaaagattgttgagcctggaccattggagaggggaggaaaagatggaggtgtggggtcaaggggagaggctgcagaggacaggacagtgtgtggccaaggctgctgtttgttccttcatcaccctggccaggctgaggtccaggcagtgttctctgacggagctgtctctttgcacacgaggagcctgaaatatggaaaagtaagtcgggctcttgatgttcctgtttgctgactgagactacaaggctatttttgaatccccatagctctctggaattctggcctaaagaaccccagtagctaagcattaatagaggctggcatcccacaaactgatcgtgttccttaaacgtaacatcaggacggtcagggttcacagggtcatgggtcagtagccttgtaaagaacaagttttatcctttttctccaaggagactgactttcaccagaagagcccctccaactgtgggctgggaggtgcagctgtctctcttcctccagggggcgctgcagctcagcactggggctgaggctgtcctgggaacaaaggcaggctgggtctggttaaacagcccttagacaaacgtccaatcagtccagtggatgttattgctggcaaagcttgctctgtcatctgagcctctaaatggaatttcactgcttttcttgtacgaggttgcattattgaagctatttactattttaaggagagcatacttcctaaaacaaattaggatttactagtctcttagctttatctgggtgaacgtttttattttctgagtggaacaaaaacctcttcccttaatggagtggctgcagacagccacgttgatgtacatggagtaggcagaggactgctgcagtatgctgactttcacaaccctgggtcctgcggactcttccttggcaggacgtggacttgagctgtcctgccaggaccagacatggatttgcacccagctccacccatctccttacctacccagaggcacacatctcacaggcaagatgagtgtttggggttcaggtatgagctagggtcatggaacaacgcagtgctcctgggccagcaggaggctccagctcacttcctcattggcttcagcttctctaatgtctggcacatgagttctggcttagagtgcaaggaagactgcaaagggaaatgacagagaagagtattgaaggtcaccttctgctgggatgtatgaatagcctctgagtcccaaagcgttctctgcaaaaatgtgtactatgtgtatgcatgtaggcgacagcaattataaacaggaaggacaccaatttgaatatacttaggatgtatattctgtagtctccttttcattcatcccgccaatcttgcagtgacctagcttcgtgatatatttctttagctaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggaggtgagcaaacactgtggccattttcagtgggatggagggggctcagtctttgctgtgtttttgtggccagtgaagttggttgtttttagctatgttactggtgtaggctgagtcactttgactttccatcacggtatgttcatgaagcccatattatcttctcttctaaggagatgaattcagtgaatggtttggtgtttgttggtggaggtggcaaagttgcagggtaatagccgaagagccagtgaagaagccattctttttctgtttttttgtttgtttgttttgttttgttttgttttgagacggagtcttgctctgtcgcccaggctggagtgcagtggtgccatctcggctcactgcaagctccacctcctgggttcaagtgattctcctgcctcagcctcctgagtagctgggattacaggtgtgccccaccatgctctgctaatttatctatttttagtagagatggggtttcaccatgttggtcaggctggtcttgaattcctgaccttgtgatccacccgcctcggcctcccaaagtgctgggattacagacatgagacactgcaccctgccccattccttttaatctcccttggaattagctgtttggttgatttggagttccagggtgatactgtctgagtcataaatgatttatttgtgaatttctgtggctggtcacgtattttggtcctgtttgtatttcccttcccctctctgtgtctccttatagcctgtctctcttgctgatcgagaggtgatatcccggcttcggaactgcatcatctcgctggtaactcagaggatgatgctgtatgataccagcatcctgtactgctatgaagcatcccttccacatcaggtactctccccagggcctctcccttcttcactgatctgtgagctgctctgttgtttgttcagagacaatatgcacatctccccaatactttcccaacatccgtcagtatgaactggcctgaaacagccttaatgagtgtctggtagatctttccctaagaaacttgcaatattctcaatgcctagtgtcagtctaaggattttggggcaggaggtgtcaggtgggactagtttatgagagcaacctctggactacatcttacctctcccaaatttcagccagcttttggatgaatgtcagaataatatctttgttcttgtcgactatatcccagagcatcttgctgatttattaggctgcttctagcagatcatatcttgtaacgcttagtctctgagacatgaaaggaatacagaaagtttatgttaacggcttgatttatgtttggattggcttggtggtctgtttatggttggtttcttttctgaacaaatgccttttccctttttcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatggtctgttttggcctccattcctatatcctttaaatgactgagaatgcagctggtaaagttggaagaataaagttaaccaagcaggccaggcacggtggctcacgcctataatcccagcacttagggaggccaaggcgggcagatcacctgaggtcaatagttcgagaccagcctggccaacaaggtgaaaccccatctctactaaaaatacaaaaaattagccaggtgtggtggtgtgcacctgtagtcccagctatttgggaggctgaggtgggagaatcacttgaacctgggaggcggaggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacgccagagttctcgctgaagaatgtgag

SEQ ID NO: 38021 - DNA, 86085 bp, Homo sapiens; identical to SEQ ID NO: 36931

SEQ ID NO: 38022 - DNA, 129098 bp, Homo sapiens
ggccaggccgggacccacagctccccatggcgggaagggccaggccgggacccacagctctgaatcaccaccccccacccccccacccagtgcagatggggtgagggggtcaagtgggagaacgaggcgggggcatggggccagcgggtcctagtgctctccgcccaccagccgccaccacccccagggaagcctgctccagggacagctgcggcccttgctcgacggcttcttccagagcagcgaccaggtgatcgtgtgcatcatgggcaccgtgtcagacacgctgcaccgcctgggcgcgcagggcacagggagtcagagcctcggcgttgccatcagcacacgctccttctttaatgacgtgagcactggggcagggcggggctacctcctgctcacgccctccaggaccctcctcccaacccagctcccttcctctgccaaagggggaaccccaagctgcaagcagggaggcccaggccctggggagctgcccgcttgtggccctcggttgaggtgggcgctgagcaggtgggctgggtgggcccctggcgctcaccccttctccacagggctgaactagttctcacgttcagtctccaagtgcagtggtctccggccccacgacagcctacccagatttgctttctgacatgtcagcacggttagcgtggctgtttttccttcactggggaatctgggggataggcgcccctcaaatgcattcatgaggcctgggctgccaggatgcagttgtgggtagaagggagatgtgattcttacatcctcagggacaccagagagccctgtgtgaggggggagccccagcccttcccttccccgggagccgagagcctgggtgaaggaatcctgcagaaagaactgagttgtacccctacaaggtgtggggtcccaacttggaccaaagctgggacccctggacaggtctggccgtgcctctgagcctctgccttgcaggagcgggacgggattcgggcggcagccatggcactgttcggggacctggtggcggccatggcagacagggagctgagcggcctgcggacccaggtgcaccagagcatggtgcccctgctcctacacctgaaggaccaatgcccagctgtcgccacggtcagtgcccaccccaggaaaggcaggtgataggccttcaccttggccagggctgggacccacaggaggccagggtacggggcagacggatggcagcagcactgcctgagagttgggggagctcccacggggcagcaagtggcgggcagagggtctggccatctgcactggtttctgtgaccacagttggcctgcccgctcccccactgcgcacacgcatgcgagcgagacttgccgtcgatgcggcaggacccggtcttttctgctcactgctgtgcccccagtccctgtaacggggcagggggtccagcagctcacagagcttgtgtgaatatggactgtgccctgcctgccgtggcagcacatgccctgtgcacagcccacgaagtcagagcttggcctcgcgggtctccctgccatggggaaaaggatacggggcaaccgtggaaggggcagggccagggccgcgggcagaccagcctgggctccggggggccaggtgctgttgccagggtcggggaggcttgccgaggggcacaagcaggacagaaccagggaacacccgcacagcaggctgcctccagtgcccatggaggcctgtggcctctaggggaaagggctcagacataggcggtgggtgaccctccacgcctgtccctgcagcaggccaagttcaccttctaccgctgtgctgtgctgctccgctggcggctactgcacaccctcttctgcacgctggcctgggagaggggcctcagcgcccgccacttcctctggacctgcctggtgagaggcctgggatcggtggggaggaacagggccagggagtgggggagaccaggcttgcggctcccccattcactcccgtctcacacacagctgctatagcagctccaggggctgggcaaggcaaactggggctggaggaccctggtatgcccagggcccccagcccgtcccagccaggtgtgctctcctccggccagatgacccgcagccaggaggaattcagcatccacttgtcacaggccctcagctacctgcacagccactcctgccacatcaagacctgggtgacactcttcataggtgggagggcgaggccgggcttaaagacccccaggcctgcccccacccaagcacccttgaccctccctgactcaccacccacaagagaggaaagggggtggatgaggaggagcttggggctgaagaggggcaggggtgggctacagccccccaggagacagggagccctgagccaccagctgcccgtctgttacacaggccacaccatctgctaccacccccaggccgtgttccagatgctgaatgctgtggacaccaacctgctgttccgcagtaagcagccctccctccagagctcccgcagcccgcaccctcccacccctgcccaagcactcttaagacccactgcacagacagcaagactgaggccccagaagggaaccccctcctgccccccctacccagcatcagcatcaggacaaagacacaggcctcctgggcagcacccagccgccatcccaccttcatgtctggaggctgaggttggcccttcccctccccaggcccccatcagggcacctggggcctaaggctcacactcactccacagctgcctcatggcaccaacagaacaaggggctggggaatgggggtggtgggttagtggtggagggaagcatcccaggcctggagtcacaggaggtggggtctgagctggccccacccaccacccaccccaccccccacccccccaacacctgggctggagtaaaggggctgctcctgcgctggggtcacctctgacctgctcctcctcttctggagcttttgaacatctcagaagtgaccctgagcccagcatccgggaattcgccaccagccagctctccttcctccagaaggtgtcggccagacccaagcagtgacctccagccatcctcccccacccaccgccttcccctcccgtgtccacctggtcagccctgccccatccgccccccacagagcttggttgcataacgtttttccatttgaaagaaagatctagattcaacaaaagaagcgttatgcgtgtcagctccctgcccaccacaggcccctctgctgtgaccaagccaagccccaggagacactggcaggacttggggacaaactcagggtcaggcccaggggacagagacaaactatgaagtctgtgaagtgccctgcaggtggatacccgtccactcctggagacagggtcaccttgactggggcctgagcccaagccacagcctgccagggtcccagggtcctgggggctggggctgggcaggcactcaaattgagggcagcctccgcccagggtggccactcaatcttcagttgtctccatcttggcgcgccacagtggctgggggctgacggtcggacggggtcccctcagtcgggacccccagcctcgggcccccagcgtctccctccacccccaccaacatcctcctcagtccattcagggctagcagcagaaccagccaggcccaccctggacacactgtcgcctgaagcaggagtcttggttctctgagcctcagctgttccatctgtaaaatgggcagtaagacctttctcccgagacccttggagggatgagtccagaggcaggtaccctggactcccagagagccaccaggggacctgcccaaccttcggcctcggcctgggtttccgcctggcctggggtccacacagctcctggagagcccctccctgcagagctctgcctggggccccatcccatgctgcatctgtctcgggatcctgccaggccagccaccatcccaccaatgggataatccagactgcaccccttttcccctcctggccagcgcggacccccactccacactcagctcaggcagtccttccacctggggcatctcccccacctcccgacgtggtactctgcactgtgccccccccaggccccgcctccatgcccctgtccccctgccccctaacaaggtggagcacaccaaggccccacctccatgcccccatttctcctgccccacgaggtagagcacaccaaggccccacctccatgcccccatttcccctgccccccaaggtggagcacgccaaggccccgcctccatgccccccattcccccgtccccccggcaaggtggagcaccctgaggccctgcctccatgcaccctgtccctcagtccccccaaggtgcagcaccccaaggccccacctccatgccccctgtccccgccaccccccgaggtggagcacccctagctgtaactgggaggcttaccagcctgtcttccccccaaccctgctagactgtgagcctcttggggcagggacatggctacacagggccagcagaggtgaccccaaaacttggctggtggattgaaaaaatacagcaaacttcacccaacatgcattggatttacttgagttccaaatgtgtttgaggaaaggagagaataaccatccgggacagctgttgccctttctccacacaggagctgggggagccaggtctgcggcccccttagccatctgtcggtcttgggggcagggctgcctgagaaggggcttttggggtttccacatctccccatcttgtccactgacctcctccagcacctgccccagtcgctccttgcgggaacctcctggggccccaggacggagaccactcccaggctctccacaccctggagccagccctaggcccaccttcctccccgctggggccatgccctccatgcaccccggcccagggtggggccagcccccaacacagacactgcacccaggaacacatgagcatctggtccacgccctccggcgggccctggtccaggcctctcacatccagccccaggtgcccaggtggcaccctccctccctgggctgatggatggtgacttcctccacccaagccaccacctgcccccttctctgcgcctcggagccggaaatgtggacacctggtttgggcagcacagggaccaaccagccggacacaggccctgagaagctgccaaatgaatcccagcccatcctgcagaggacagtgctggtgacctgcctcgccttccaatgtcacagtcccaagaaccgtcaacacggccaccctggccaaggcagggctcccacctcggtatcaggacaggacagggcaggctggcccctgggtcggggtgcaaggacccagagcggccaccagagggcagcgcaagagcacgcgggagccccatcctgggcaccagcccaggatccagacagcagcctctggggcccccaggccaccagcccgccccgcctgacgctgtagcccactccacacacacggccacggctcctgttttattgccttcgggtgtccggagcacctgactgccccggggtctaataatttaaggtgccgagaacaggtcaggacaaggggtcgcaaaagaggggctgggggcccagtggttacaaaatatacccccaccccacaacaaacaggctagaggagaccagcctggctggtgtgggagggggcgggcagagggcgcccgacccacctcagagagacagagccacggccagcgccgccagagggagtggcggagacaggagaaagggcccagaggccacccagggcccgaggggctcctcgctcctcggacacaagtgcacggaggtgtcggggaggaaaaggcgatgtggggccagccaaggcctggagcccctgctgggctgggcagagcagggctgggcagggcctccaggtccagccaaggtcctgacctacatgacgaccaggcccagccaaggtcctgagctacataacgcagcaccgggtcttgtgcgtgtgtgggtctttgaaccgcagcctctgtttgggccggtatttctccaggtaggtgagctgcttgctgttgatggctccgcggcgcttcctgggaagaggggaacaggaacagagatcatccaaggacctggctcggccatctcacctgccccagggagctggaatctgagagtgcagtgggctggagtaaggccttgaggctggccaagcccctcctgtcccagggccttggcacggctgctcccagagtcacagtcaccctttcctggccccctgcagctcacccctgcttgccttccaaactcaccaaagcgccacctcctccaggctgactctgggctccctacggcccccaggcttccctagctcggtaggacccaccccaaggccatgagcagacaacaagggtggtgcctgggcacctccaccatccaggaaggggggcctgtgagtaagggaggggctgagcccagaattccagcccagctgcgcgaccttcccttacaacagggacctgggctgcatgctcaccctgtccccaccatccccaccacctggtccttacagcggggacctgggctatgcgctcaccctgtccccgccacctggtccttacagcggggacgtgggctgtgcgcttaccctgtccccgccaccgggtccttacagcggggacctggactgtgtgctcaccctgtccccgccaccgggtccttacagcggggacccggactgtgtgctcaccctgtccccaccatccccaccacctggtccttacagcggggacctgggctatgcgctcaccctgtccccgccacctggtccttacagcggggacccggactgtgtgctcaccctgtccccgccacctggtccttacagcggaaacctgggctgtacgctcaccctgtccccgccacctggtccttacagcggggacccggactgtgcgctcaccctgtccccgccacctggtccttacagcggggacccagactgtgcgctcaccctgtccccgccacctggtccttacagcggggacgtgggctgtgcgctcaccctgtccccgccaccaggtccttacagcggggacccggactgtgcgctcaccctgtccccgccacctggtccttacagcggggacccggactgtgcgctcaccctgtccccgccacctggtccttacagcggggacccggactgtgcgctcaccctgtccccgccacctggtccttacagcggggacccggactgtgcgctcaccctgtccccgccacctggtccttacagcggggacccggactgtgcgctcaccctgtccccgccacctggtccttacagcggggactggactgtgtgctcaccctgtccccgccacctggtccttacagcggggacgtgggctgtgcgcttaccctgtccccgccaccgggtccttacagcagaaacctgggctgtacactcaccctgctcccgccacctggtccttacagcagggacctgggctatgtgctcaccctgccccgccacctggtccttgaccacatgtacctggctggggtgaacaggaagacttcctggagaggatgctgcagccacacctgagaggccctgaggtgacaggcgttgaggggcgggggctgcccacccagcgcctctggaggctcatccatccccacctgccatgacctcaggcgtggccacaggctggccctggccaaggaagtgggagcagcagtagcgcgaggagtctctgcccagcaaagctgcaggtgccccgtgtggctccaccgtgctcgtttcctcgcccagcagccggcacactggggaaggcgcagccctcagccacgcctccgggtagggcccccaccaacagacacgcaacaggggcaagaaacgcccgtgctgttctgagtcgttggggttcaggcctggctgtttccgcagcatggcccaacctgtcctgaccagcgcagcctcaggtgcggggagccacacagcaaaagccacaagggagagacaagcccttgctcggtgagacgtggggtggggagagaacccggggaaggtgtgcacccgcatgtgtgagagtgcatgtcatgtatgagtgcacacgtgtgtacatgcctgagtgcatccatgtgtgtccatgtgtgcaaatacccgcttgtctgtatgtgcctgtgttcacacacctgcctgtgagtgtgtgcctgcgtatgcctgggtctgtgtgggcacacatgtgcttgtgaatgtgtgcctgtatgacccccatgcgtgtctgtgtgtgagcgtgcacatcccatggtccccagggagacctgagcacctgcaggccacgctctcgcacagacccacagggcgggccacgctctcgcagacccacagggcgggccacactctcacacagacccacagggccagctggcatggctgggaacaagcctgcctctgggaggaagagatggccccaccagccaagcctgtccgaggagtaccacaggtgtgtcacactcacgggcacacacatggtgggctgggcaggggcaggcttcaggtgccgcatccgttcctccagagttggccctgccatcccggccagactcccccaggaccccctgggcagtgggcagatggcagccctccccagggaggccaccaagtgacagggatggggcaggcgagctggcctagaagcctctaaggagggcggggaggggctgagctggagagctcggggttggggggaggggtggtgagcagctagactcagagtagtcctgagacactagcccactgtcagcgtccctgggggtggacacggtgtggtgtggggtttcaggttctagtttttcatggagggactgaactggctggctctgggggtccttccacccccgtcaggatggctgcgacagaaggagctctgtctgtggagggcgggcaggacggcgtggcgggtggcctcgctgtgtccctgtgtggctgcatggtcactcgggggctgctgtccccacccatcagaaacacctcaggcttccccgtttctgcagcaaggcccagcttgtgctgatcgacgcagcctcagagcgacggaaccacacagccaatgccgccacccttcgtgggcagccggatctcccctcccccagcgctcacagcccaccccaccaccgcggccactcactggcggatgaactggatggcgtcctcgtacttcatcccgctctcaataagggccagcgccacaaggactggagccctgggggcaaacagcagggcgggggtcatcggagcctgcgcacccctgtccccttggcagggcacctgctgaagatgcagggcacgggggcccaaggggcccagaatcccccctgcctgaagctcccccatggaggccacagcctcacagcccagcctgagcactgggtctaaatcctggctccctcctaggcaacctctctgtgatctgctgggggagggttaaataagagctggcgggtgaagtgctaagagccggatccatgcctgctatcaactctgctcgcctgggtctccctctgcagatgggggtgtcccactggtcatgtcatccgatcccagctgccattcttcctcccgttctcccagcagggagtctgaggccccagctgtgtgtggggggatctttgtgtctggagagggggacggcagccctttcctacacaagatgtcaggatggtttcaaccatagcaggaagaagttgggttagactttgggaagcacttcctctctgtgatgctgggagaggaccagtctgggagccccagcactaggggcatgggcctcctgggaaggtcgcgtggacgtgtgttcaagacccacatccaaaagcgaggctgtcagaccacgagatgcccaaccacctgacatggcgagccctaccccgccccgacactcaccggcccaggcccgccacgcagtgcacagccacgcagctgccgggggcctcacagaacttggccttcaccaggctcagccagtcttccactaccttgccgggcgggggcgccccatcgtcaaacggccagtcctacggagggaagcagacatgaggacccccggctgagggagggtagagaggcggctctggggctcaggcgaggaaagggagctctgagaggcagagggtgccaggagcccactagggtgggggcagcagacccagagggcacacaggaggggcacagcttgcctatgggcaccccatggtgagtgcttcagactcctcatcattccctgtacactgcagctatcccctcctccaggaagccttcctggaccaccccacccctttctgaatagagcctgctccagagtcgcacaaatcctaatccccacacctgtcagcccgagctctggttctggggtcacaatccctcacgcctgtgtgccggtggcagcctgagaggttttgggtcggctggtgcaaagggtctcatcccctgtgctggcatgcaaagatggctggcacatgccacacacagcccaggtgccaggaaggactgaagacagggctgtggggcgagacagggcccacatttctgagggcaggactcgaaacaggcggttccaccgggccccggcccattgctcctgggggttaatttggtcttggaagatgacctgtgcttcccactgtcccgtcccccagcgccctagatcggtgggcaacgtgagtcttcctaggggagggcccgggccagggcgctgcagtaggagtggacacgtttcagtcttgggaaggcgggttcatgcagggactgtgccaggcatggggctgtctggtaccagggagagcccgctgggcccactgaggcagacacacagccctcgggggcatctcacccctccccagcctccaggcagggcaactcctagagacaaccggtgtcacggctacttacgtctgaccccaatccctcccgctgctgtggaaggggagggagggtgtgggcgcaccccgtgcgagaagcggggacatgcctttgcctcccattcttccaagcagcctcgctttgaggtgaggaacccaaggctcggagtgacctgcagggtcgcaaggctggggagggcagaggcgggacgcagcccaaggcctgtctgaccccaaaccgccagcgctgccaccattccaaaccgccaagctgaggtcacaaaactgcaaccccagccaaaagcagagtcctgggatgaaaagcagtgactgaggggtgctccgcactgaggagactgaggcccaggcgcagctgggcaggcctgcaccaggggggcagtcgtccaccgggccgggggtggacccccctggggctggctctgggcctgcagctgctgtggcccacccccccaaggatatcgcagcagaaccgccccaccccccgcccagacctgggtccccagggccaaagaagccgaggaaactgcccaagggccctccccaggagcctgctgcctggcaacagggccccagccgcccaggcagcaagactgagatgcacccaagacaggcccagaggagggcctgagacaggcagaggagcccacccgccaccttggccgatgcaccaagcatgtgccacccctgcctggcgaaccgtgctggcccaccctagagacagaaagacgggtgcgcaagggtgactttcttgaggtcacacggcccaacaccctggccttcccttgatgtacccagacacacacgtggcccaggcacagacatgcccagggctgccacaggaggggcaccaaaccctctgcgcaggcccggagccccccgccccaccctcccccggtggcagcagtgactagggtccccgtggcgcgcgcctcaccacaacggtgatgccatccttctccagcggcgttttgtcataggtcacttcacacacacgcaccacagtggtagccccgtacttcttcaggtcctgggggtgggaggacggaggaggcagggctgggctggggctgcagggctcagggggcaggacccactcaccagggctcccagggcacagctgtgtcccccacagtcacccaggacttggacatgtcccctcagacctctcggggtggagccctgtcccctcagtcccctggggcagggtcatggcccctgaagcccccagggaagggcatgtcaccctccagccaggcagaccctgatgcagtgaggtccaccaagagtggacttcaggctccactactggtcgaggtagtgtctggctgtcgaagagcctgtcctaggtcccttgggccacccagcagaggcaaaggtgtccccacctacattcacggtaactggcagctgggaccccagctgcccagcacaccactccctcctctggggtgctcaggaccccagatctaccagcaaggacatttcttccagaaaagctactgggtccccacagcaggaactggactccccagcccacgtgtgagcccctgcatccgaacagcgaccccagctgagccgcagggatgggtccagtttttagggtctaagaggggcgggcatcagctggggcgcctcagagcagggagggtgggcaccgctcagatggcagccaggaggaagctgggccctgtacgccagcagggaagccccacacgaccagggaaaaggtggtggtagttcacagccaggccgatagttatacccccactgcggaggatccactccacaggggtcacgtgcgggggctgttcccaccccacctgctctcgtagctattttgggaggggtgaggaatcagctgatgggtcttgctggtcacgggacagggacctggaacacagagaggccagcacccaactatctgagaatgcagggagcaggcagggtgctgggctctgtggccatggggtacctcagaggccctctgcaccctcagcagagggaatggccacccagcccacggctcagccctggccctggtcacaggctgagcccttcctgatcctggtcacacactgagccctgatcctggtcacgtcctgagccttgatagtcacacacctctgagccctaatcctgatcacgtgctgagcccccaaccctggtcacacattgagccctaatcctggtcacataccgagccttgatctgggtcacacactgagccctgatcctggtcagacactaagcgttaaccctggtcacaggatgagccctccctaaccctgctcacctactaagcctcaatcctggtcacacactgaaccctgatcttggacacacactgagcttcgaccctggtcacatactgagccctgatcccagacacacaccaaaccctggccctggtcacacactaagccctgatcctggtcaaacactgagccccaaccttggtcacatactgagcgctaatcctggacacacactgagtcccaaccttggtcacatactgagccctgatcctggacacacactgagcctcaaccctggtcacacattgagccctgatcccagacacacaccgaaccctgaccctggtcacacagagccctgatcctggtcaaacagtgagccccaaccttggtcacacactgagacctgaccttggttacagacttaaccctgatcccagtcatattctgaggcctcaccctggccactcaccgtgctgttctcgccaatctttctgtagatgctgctgttatctcaggggtctcagctgcgagagggacagccatcttctgtagggcacctggctcagtgtccagggtccaggctccctgatggcaaggtgcccaatgcctcctgctgctctacagttcttaatgccctctcacgcccaaatctgtttcattatgacaagaccatgatggcttatctcatgtcacaggggaaaggactcagccataaatgaccctgcacacagctgcagcctctcacacagcctggcacagtcagaggctctgtcaacggccccgcacacaactgcagacgctgcaaacggccccaggcctgcaaacagcagggcgttctgcagaggccaggctcctccaggaggccatgcaggtcgctccagactccactcccaagaaagcttctgtaaacgcatctcgtcccatctgccagggttgccagcggcaggtatctctgctgcctctccagggcacagtggtccctccctcctgtggtcagcgctgacccttgctcagtccctcctcacacagagatctgggccctgaagcccctagtccagcctggtctaacctgaggcctcatccagagcccagcaacatctgggacagcaaagggctcgggagggccccagcccaggccacggctgagcacgcacagcctggtccatgtatccccctgcctcaccccctgcctctatccacacagcgtggagtccctcctatcacacgccagccccctgcaggcctcccaggggaccccgttgatcccccaacaccctcaaccccaacccccggggcacccccatctccctcctccaggatcctgtaacaggcgactgggctttgttccaaggctgtgagccctgtctggccagccggggctggggacccctcttgcgaggcctgagggcagctcagccgggcttcccagacacctgggccacctgcctgccacacctccgtctccactcacctcaatgaaggtgctgagcgtggcgttggtggggttgtgggtgatgaggaagcgcatgtgtttgtagctcacctccaccggggccgggcggttcatccgagccatggcgcctcccgacgggcccggcagggcagaagggactgcagagaaggctggggacacgacctgagaagtccccacacacccccaaaaaatgaggagaacgagatccctgtgcttgtccaagagaaacgagatttaaaaacccacccccataccccgcacaaatattgtgcaaatacttgggtgtgggggaggaagctgcccactgtttggataattaaaaaagaaaacccaactcttaaaaaagaaaaggaacaaaacagcccgccgccccccccaacccaaccaaagtaaagcgggcaactccaaactcccgtctctcagagctggatagtcataaagaggcaaaaaataaaaagaacaaccaaaaaagctcagcaaagaaaacttaaaaactcaaagtgaacccggccgccaagcagtgtccagagctggaccccacaccgggggcgccctctccacattggtggatgggcagacagcccccttcactcagaggtgggccccaagcccccaagggccagaggaagaatgaacttgaactgaaccaactccagctgccttgggccaggggtcacgggcagtggccgtggggacagcggcctctgacgtgtggggcctgtgtcacgttaccccatcggggtacggtgagtcctggagtggggcagggggctcaggcggtagagctggccccaggctgggcagcagaggccatcggcaggcgagggcaatggtgagagccagtggcacggggacccctcagcaggaggcgcggcgaccctgggcgcagcagtgcttagggctgggccccgtggcccactccatgaaccccaggtgggtccacagcacacagcatctgtggggaaagacgaaggaaatgaatagaaagggatcacagggggccccgcctcccacaaggggttcatgcctgtcatgagcccacagtcacaggcgacacctctcccagagccctcctcctgaccatgctgagagaatgacccttttgggtctatttccttatatgggagcacaaggaagcacggctcctgccaggactgacccagggcccagaggcgacagggtagccaccacacagccagcagggcatgacggaggacagaggggacagggatttcagggacacacacacccccgaggacatgatgaaccccagcacacagatgacagatccctctgtggggacagaggccgagttcctaagaagcctgagcctggcccctgcccacctgctgtgatctgcggaaactccaccccaggacagctgccctctcctcttccgattctcagccactgtgaacatctgagcccaggtgtctctgggtggcccatcctcagggaatggggcccaggcactcggtcagtgctgccagcacagggaggtgaggggcctggccccacacgcggccgtgggccaccctaatcgcctcttgctttctgcagaaagtctcctgcctgtcagcagccccctgtccaccagtgtccccccgccactgtgtctccactgctcacacaggtctcagccaggctcggggataaacaggccagctctgcccctccaggagctcagggaggcggggacagaacacgccaatgggccagccatcaggcacacatgccaaggtggtgacagcacaggtggccaggagtgggttcacaccatgacagggccctgaagaggggaggcggcagggggggccacagcaacccaaggcacctccacgcctgcctctctccctttctgggtctcatgaccccaaagctcccaggcaaaggggttccaggagcacgcagcccccttccctctctacggaagggctgggaggccttgagcaaggtgccggcctctttgttaccccatgagcacgatgaggggtgacacaagtgacccaagctgtatttgggcactgctgctgaggggtccccgcactgctggccctggctgtgacccagctgttagcagactctccagccccctagactcaacccaagcccggccctgtcactactgcctgctacccaaggaaaggcacttcagggcccctcgcccagcagagccctccattccccaacccaccccctctcacctgtgcccctgccccagccccagcacccccttcccagctgcccaccaggcaggctgggcccttggagcttcagcccaggtgcaggtagggcttgaggcctgggcccctggactcagagggtggctacctgggacagtgggctcctccctgcctgccctccacaccctgggtggcagccagtgctcatgggctcagagcagccgccacacctcaggctctgtccactgcatggttctgggaaggttaaaatgggcggtgggtgtcaggcgcagtggctcactcctgtaatcccagcattttgggaggccaaggcgggcggatcacctgaggtcaggagttcaagaccagcctgaccaacatggagaaaccccatctctactaaaaataaaaaaataaaaaatgagccaggcatggaagtgcatgcctgtaatcccagctactcgggaggctgaggcaggagaatcgcttgaaccctggaggcagaggttgcagtgagccgagatcgctccattgccctctagcctgggcaacaagagcaaaactccgtctcaaaaaaaaaaaaaaaaaccggtggtggggtgggacccccagaaggaggtaaaggtggagacaaggatactgtccctggtcccgccagtccccaccttgcccgactggagggagcacaggctctgagtgtgggtgagggaagccaccacgtgctaacagcacacaaacacctgggtccctcttggggcagcaggatgtccctgtgtgtgtgcacacgggagccgagctcatgtttacagaaagaaaggaagaaaagcaccagagaaaccacagtattgggcctctccctgaggggctgaccaacccctcacacctacagctgccagggacccaggaagaccccacaggcaccagcacgtggcctggacctgctgcctagtggccctgcacaggtcctcagggctgcaggctactgggagggaggaggctccgaaccaccccacactaccccccactgaaggcctaaggatgccacacatctgccggaatcagggggttagcctgggctacgctcaggggtcacagcccaggctagaatggggttaggggtccagggagaggctggaccagggtcttgccacacatcccacttgtctctgcagcctagggcccctacccctgccccaggtgagagcaaagcaatgatgccctggcaccactatgtggctctgccctgcctggtggctgtcccccaagggagaaaacccctccataaccacacgcccccagtgaggtcaccaggtagggccctgagagcaagggttaaggatccccagggatgggcactgagaactccctgaagccaaagcctcaggcttcccatctgcgaaatggggacaggttgcccctgcctccatgtgtcctgagtcgctaccacccccaccaggcccgcggcccacagcacggggacccactggcagccgtggcccctctttccctcctgctacctccttccctcctgctaccaagccctgcagaacccttcccaagatctggctcagcctcctcgggccagcaggcccagagccctcagctatttctcaagaccctttaagggagagtccatccttgtccctgtttgcgagatgaggaaacaagccagggagaggggagaacattctccaccagggccacaccaggcgtccagttaactgggttctctctggctcaaatctaggaggcaggaacaacacgcagcgccctgcacagaagaggaaatcgaggttcagggaggctaccgccctccttcccgatggcacagcagcttaagaagtttgaatccagcccccgcttcagacagggcgccccctgtgattttgggggaggaggctggaggcccggggctcagcgggtctcaggagaagtaagctgcgccgcggtcagggctgaggcgggcgctctggggagtcccggggaaccagtcgcgggtggggtcgtggtaaggggcgcggccccctccctgggtgccagcggggctcccgcccagccctccggagggcgccacctcctccccggcggggctggggtcccggaaggcctgggtccgccgcgtccccacctgccaggctcacccgcgccgcaggcgtcccaccgcctccatacgcgccggcctggcggtgcccacggtgctggccctgggtcggggcgccgcccctccgccgcggagccggctccaggcgctgccgccaccgccgcctgcggctatttatagcgcccgggcgtcacgtggggggcgtgaccggcgggcgacccggctgccgggggctcccacacctgccgcctaaatatagccgcgccctgcccgggaaacaaaggggccgcgcagggcgggcgcggggaagaggaagcccagccaggaaagggaagtgcggggcgcggcgagggccgggggcgctgccgcccgggacccctccttcctcccgccggccggcccggcgccctctcccggtgcgcgccctccctagaacctcggagctccccctggccccctcatggggctgcacgggcctgtgggctgggggtccggagggcaggagccgccgggccgcgctcctggtggggaggcctggacagagcgcgcccagctttggaaatggaaatgcggccccgccgtgcaggtgctgtcctgcaccctgaggaggagggcgcccgagtccctccagttcagaccccctgcccagcccaccagccccaccgcccgggcactcctccatgaatttactcagcacccaccgtgccagacactgctgtcccctcacttaatcctcacgaccccgctgtggctggctacgctggtctctcctagcgtactggtgaggaaactgaggcactgcaacgaggaacaccctgaggtaacaccggcaggcaggattcagccaggcggcgggctccacaaactctgaggctcggcactgatgccccctcttccaggaagccctcccagaccctctcaagcaaacgcctccctgcgactcctggctctgcctcctgggagcattgtgccgggaactcatgtgctccccagactatgaaccccagggatgcagctggcatcaccacccactctgtgcccgccctggccacccagggccctcagagcagggtggagcggcaagggtggtacccccagcacagggtccctggaggtgtggccctgcttgcagctctcaaacaacctggtccctgcaatctgaggtcatcaaggggcccagctgagagcacgaccccccctccccctgccaggctctccccacccacacttccagaaaacatcaccatcagcctggcccagctgtgccggcaaccctcgcctcctcccacctccaggtgggcaagcaggctggggagcagaggacaggagggctgtgcccagtctgaagggccccatgggagcctccacccaagggcacaccaagccaggtagccctgcctgccagctcatggacccccaagggtgtgagctccctggcaagggcacccacccacgtgggtgcacccagctccacagggagacgctaggctctgactcctgcccagtgctctcagctcaccacttccagcagcgtctccctgaaggttgaaggcaagaatgggtcagcttcagggactctgccccaccaatctccaacctcagccactttctaaggataccaggctagacactgcattccacaagcaagacacacacctgccacactgcactgacaaaccataacagcacagagaagctgagcaacccttctgagtcacacagccagaaggcagaaaaaccacatttggagctgggtcttgctgcccccgagaccctgcttatccccaccctagccctctgggagagaggacctctggggtaagctgctcctgccccccagcctcagttttcttatccataaaaggggtctcagagtgaaagttcccatcaagctctgtgatgctacaaccagacagagcccgtcgcctctggcgctacaaaagtggaccccagcatcctcatcacccccacccgggctccacccccttgcctggggccctctggccgggcctgggaggcacctgctgcagctggcacagccccaggcctttcggagaagtctatttataaccaggcaggagccgttcctggaatcctcccagagcgggcccaagtccgcccattgctaggggggccaggaggggagacccaagcaggccaagcccacgcttgatgcactaggacgccttcccggagtcctccaggcccctgcactcggcagctccaagggcccagcctcctcactgccacatccccccatgccatcccatcccctctccccaccccaccccacaccctctccccaccccaccccacaccctctccccaccccaccccaccccagtccccaccccaccccatcccctctccccgccacgccccctacccttcaccacccctgccccctgcccccccgccccgccccctgccccccgccctccgcgcacgtcaaaagggcccacccggagtcatgtgggaggcgggggcgcggggctgggcactcccccgaaggatcccggaacgctccggctggggcctcgaatagggaccggggccgcagggtcccagggctgcggcgggcaccctggtcccggccagagggcaggagggtccctccagcgctggcctgggctctggggcccacgggggacagggcggtccctagggccctgtaacagcgggagcgagcgggagggggcgggagggggatggcgcacggagacccaggccctgtagttggggtggggaaagactgggggctgtccagggctccggcctgtctccccactgcctgctgcaggctgggaagagggtcccagggcccgttccttgccgcgctggagggagcctcactgcatccccaccacttccacctgcccacacagaagggcccggaccctgcagcctgccccggcttcactcccaggtggcagccctgggctcagcaggccctcacttcatcctgttgtccccatttcctccaggaggaagtgcagggagacaggggaggcgactcagtggaccccacccaggccccccgccacccacacccaacccccaccccatatacacaacttctaacatagttccttccgcaggaagtgggaactccaccagtggaggaggggctgttcctgcagtccagggcccgggtcacttgcccctcccccatcaggatgctgccctaggcctggtgatatcaggagggggcggagccctcgtacctcaccctggaaaggatgagggggcgtctctcaggccagcccagcccccaggactctacctcctggggcagagagcggtcactaagaagtccacccttatccctgctccccccagccaccaagacagctgcgccataactcaccaccccctgcctaggcacccgatccacctgtgccagtctggggctgcccaacagtccctaccccccccccagtccagggctcttcccaagctcagtgcccgcattctcctcagccacctgcccgaacctctcctgctcctcaagaccccggccaggtgcagagactcacacacctgccaccaggctgctgctcccacgtgccctctgtctggctgcccttctctctccctaccgggccacctcttccagcctcccagtgagtgaacctcccctgccccagccaccttccaccactacagtcccagaagccaggtctacccaccaggctgggcccccagaccctagggccacactcggccccttttgatctccccatgggaggatacaaatctcaggggattattgtacacaaatggcctaatgtccagcgagtggacaggacagctccacaatggcaggccaagtcggtggctcagacaggactcccagtccagtgctcatgccttacctcccaggatgactgagaagccagtgtggaaaccgcccaatgggaagctctggcaagcacacacactgacctgcatacacagagatgtgtgctcacgtgcacacacacacacacacacacacgccacagaaacagatgaccagatcagatgcctgtgccgggaagatggggaccccattgccccgcagcagtccagccccacgacgcccaccagagcctccagggacaccgtgagcccgaatcctccatgtcctcctgtccacacagcatctttacaccaagagccctgaatcctccatgtcctcctgtccataccgcatctttcatcttgcctggaaggcctctgcccaggctggaaggaggatggcacagccacaccagctgtggaccagtcactgccctccctgcggcaaccctgacccatcttggaacagacacagctggactcctgagtgtttccaaagccatggcgtctgtaacatgcaggttcccaggccacacccagaccaggtgccccactcacatgcgcacacgtggccccaccttgccctgggcaggagggagccgtgttctgacggccctaaccctccctgcccccagcctcccaccccagagctctgttataacacacctgccagcagcagcttccgttaagagccagtcgctctggagtacggggtgttgggtcggaaattgtgcggctccaggattccagacaggaggaagcccacatgaagcctgccctggccctggcattaggcctgcatgcccacggtcctgctgccttcctcctgggccccatttagccagtgccatgccacccacatccaaggcccctgaaggccagtacccagaagtgggcatggtgtcccggagggcatggagtttcattcggagctcacagcctctgagaaggagcctctccccgccccagtccctgaggccctgccaagaatgcagaggcccccagcaggcccagaggaggcccctgatctggcctcccggagagttcagggcctccctggcacaccaggcacagcccctaccccttctgtgccacacaccagtggaccctcagcagacacagctgactccagggcaggaaccgacccccaagctctccaagggtccgcatggcctgatggtccctcctgctggccggaggaggctgcccaggaaggtcctcacccaccagcatcagccagaggccccaaagtggtccacaacaggggaagggcatgaggccagccctgagcccactgggcctggctaagcctccaccccaggtgccccctgggaactgcaaaaccgtcccgtgcatgctgtgtgcctctgggcccctctcctgagctcccagaccttgttagtcacccacacaacatgagaattatgaacccatcaccagatgagaatacacaggaactgcccctggcagtgcccacagagttgtcacagaggctgagagggcagggtgggcagtgggcgagctcgctgtgggagggctcaagctaagcctgctctgcagaaaggatccagagtttggctgaattccatgtgcctgcctggatggagccaggccttgggcccacagggcctctccacggagaagaggccatggctcctcctcgggacccctggaccatccaggggacagggccctgagggccatgagcatgcagccagcactaggcaggcaggcagcccctgcttgctgttcctggcatgcctgaccccaaacccaggagcagactcacaccccacccagcaccttcacgggaacaggagttctgccctctagcaggggagccaatccctcacgcccacccagccacccatgctcacttgggaggtggggagctgggccggcctgttcctccacagtgggaccctgtcagcagggtgtccaggaagcttgtggtccctgagggtggctggaccttggggccacttccaccatacccagacgccctggacagggcagcaggcatgtacacctctgctgtgtcacagaaaaggaagagcccacgcttagccactgcccagcgcagcacccccatatacccatgacgcccctccctgaacccagtgtccagtcccatggaaggcggagaaggcccaagaacccctctgtgtagtggcctcgcgtggtgccctcagcacaggcaatgcccatgtccatcctcagagcagtcctggaaggcgcccatcaccccattttgtggatgagtaaaccgaggctcaggctgtgcagtcagcgagagctctgagaggctgagacaggattcagggcctacccagggtgggcactttctctgcattttcttcttaaaacagccaagccctacactccatgtcagccccagcaggcgcggtcaccctgtgctcagtccctgggatcccttcctctgtgccacccagggcccgtggggtcggggacaggaagggggatcgagatcatggagctagccagggccactggccgaggctctagtggacgcacgtcagaggggcctgaggaaccgcgggaaagagctctgacctggcctcgggaggccacgtccaaaatagccagccctgcacggtgaggggactcagccggcatgcacgtaggcctcttggccccaagcgctgccaagctggctgcggaaggtcacagctatttctgggctggcccgatggtgagacgcagcctggcacccccagagccagtgcacacggcgccactgaggcccagggggatagggctacccccaggacacatggtggaggggctggaggggcccgcaggttccccatggtgcctagatcctactggggggaccagtgctgatggcctttcctctctgagccagctccctcccaaaaagcacgtgcagtgctatgagtggattggtttcatagtcacatcactggcttttacaggccaccaccatatgccaagccttgtgctgggcacttgggttgacaaagaaccagacctcgtccctgaaacaatcaagagggggcagaaaaagcggggctcggccactgtcttcagctcctgtgaccctggcatacaggaggagggtggtttgtggcagggaggctgctaggcacacacaggtccaccccatgcacacagaggtgccccacgccttgccagcccacaacgccagtgctgccagcactgactcaggctccatctaccctgggtcttggccttccccatctgacaaatggggaacctgaggctcagagagggtgcgagactcagccagtgaccccggctcaaagctcagctcaaagccaaggcaggtgggttctctggggtccaggggaggggacagctcctttccacccgcaaggcctggccattgctcagcccatggccactgtcctcacacagggctgtgtgacctggttcccctcctggctccccattgtgagctgtgtgatgggtacatccctcaacctcgctgtgcctcagtgtgctcatctgtaggatgggttcgctggaaggctgtcctctgtgcctcagtgtgctcgtctgtaggatgggttcgctggaaggctgtccttcatggacctgcccttggttttctcctgggatctgagggacattattaccctttccaagaggcctcgcttgagtccctggaacactggcactttgccaggtacccacaggggctgtgaggacaccgagcgccccaagaagaccacagttcccagcaggtgcctcagaaccctcaggggagcctgcgtggatggggcttcttccccgcagggcttcttaaagcccctgttcctccacagatgtggggacctcagagccaggcaggtggccagcagggcatttctggaatgtttttgaaaccaggcactagcaacaatggtgcctcaccgaaccccaccttggcaactccagattgggccagccccactcccccagtctggctgggagcctgggggccggggcctcccgactcctgcccgtctgtgtggctgtgggcacttctgtgatcctggggcctcatccatgacacagaacctcagacagcccaggccatggcatgagggggtggcaggcaggccatgtgggctgtgaccgcggtgaccgtccgcagcaggggctgggcagagccaggcctggtcacctccccgacccaggctgtatgtccccatgttcgtcacagccgtggtgacagtggcttgagggtagcaagtttagctcccggctgcaggcattggctgccatgacaacagccaaggccagactggatgcccagcccaggtgggtggcaggcaggcactgccccagggagtgggcccccgcaggcaccgctgggcacccagccacggcccctcgccagcgcaagcagggcaggagggggcctgggtcacatggtgcatcctgggagctgggcacgctgggcagcctgcactgcccgctttgagcacctgcccagctcccaggagagaaggaggggaaccatcagaaccagcggacctaagggagacctgctctcccaggcatctgaaggctcagcaggcaggtggggaacacaccagggaggggccagaaatccacaggcgctttccagaggacctcagctcagaacacatcctgccagcctaggggctatgtggagccctctgccatcttatgccctgcctgcacagcccctcaggggctctgggcatcgccgtggtgcccagaaggggtgggcaggaggtcgggccacaatcaccaggcctgcaggcagactgggtgccgggtccacagatggaggctcccatccctcccatccccctgccccaccaggagctgccaccaaatagccctggacctgaagggtggatctggggatggagggagctcacaggagctgatccctaccccgccagctccagggctcagagacagccccgggccaggaactttgccctgtctggcagtgctgtggccaggccattcacacgggcctgttggatgctgcagctcccaggcctcccctagcagggcccagggaggactcgggaaaggcagcggtgggtcagcaccttggggactgagaggccctcaggccacactgccttcatgttggggccagggatccccagggaaccatgcagactggaaccccaccctccagaatcaaatgccccaccagtccacccagatgagcaaagaaaacaggttatacacatcagggcgtggtgacactacacggcagcgtgggtacctcacaaccttgtctgtgccttcactcaactccccagtggcaaggcactctgtgagggccggggaagggccttctcactctagtctctagcgcacaccaagctcctgccctgccctgagccctgggtgggtgccagcatccctctgttccccagcagctggtgacgtccccacagcactgggaacccgggggcagggcaacgacactttcaccctattttacggacttctgagagctgctcaggacagagtctgtgtaggcgggggtgctatcctaatttattttttgagataaaattcataacacatgaaatccaccattttagtcttttttttttttttcagacagagtctcgctctgttacccaggctggagtgcagtggcacgacctcagctcactgcaacctccgcccccgggttcaagcaattctcctgcctcagcctcccaagtagctggaattacgggcgcccatgaccacaaccggctaatttttgtatttttagtagagacagggtttcgccatgttggccaggctggtcccaaactcctgacctcaggtgatccgcccaccttggcctcccaaagtgctgggattacaggcgtgagccaccaggcccagtcattttagccatcttaaagtgtaaccttcagtgtttttaatatattcacagtgctgtgtaatcatcaccactaattccagaacacttccatcgccccctcccaccagcagtcactccacccctcctcccccagcccctggcaaccacaagtctgctttctgtctctgtggacttgcctgttcaggacatttgctgtgaatggcctcacacaccacgtggccctctgcgcctggttcctttcgcttctcctggcgtcgtaaaggctcagccacggcgcagcctgagtctgtgcccgctccacctgttggccgcctatattctactgcaggagtgtgcaatcttttggcttccctgggccacgctggaagaattgtttaggaccacacataaaatacactaacgctaatgatggctgatgaacaacaacaacaacaaaaaacctcatgatgttttaagaaagtttacaaatttggccaggcacggtggctcacgcctgtcatcttaccactttgggaggctgaggcaggtggatcacttgaggtcaggagtttgaaaccagcctggccaacatggcaaaaccccatctctactaaaaatacaaaaattagctgggtgtggtggcgggcacctgtaatcccatctacttgggaggctgaagcaggagaatcacttaaacccaggaggtggaggttgcagtgagccaagatcccaccactgcactccagcctgggcaacagagtgagactccatctcaaaaaaaaaaaaaaaatagaaagtttatgaatgtgtgttgggccacattcaaagccgtcctgggccgcgctgctggctgggcaagcttgttctactctgtgggcctgccacatttcgtttatcctcagctgatggacatttgggtcatttccagctctgtctgaattttaccctcagggactgagccagggggctgtgcaaggttgggaagagggctacaccttaaccatcacccacaacttctgttctcccaagaccccattgggtacgggaggttgaggtcctaccagatgcacccttacagaagccccagctttgtgcccacgtgtgtgaaggaatggagagggcaggagagggactggaggtggggaggcctgagagtccaggccagcatgtggactgtggggacacagggcaggcaggcagaatccacaccttctaggttctgtccgggctgtgccaggctgccaagggaggatgctgggcaggtcagggaggaagagaggtcccagtggccaggggagttggggagggactctccaggatccccagcagagagggcaaagggtacctcccaagggcctgacctcctcccctggagagaatccagaaggtgaaggtggcatcagagatgggccctagaggacaggaaagatttctgagcgcatttttggaagttcaaagcataacctgcatgaccttgcacatacagtgggcacagggcaaagacttatttaattcgctcagtgggaacagcaggaggcaaagccggctcagaggaggattcagggcgaagtgcctacagcccttgagagctggcaagatggattaagatggaaagaagaggcgggctgtcggtggcatgcaggcaacacagccgtcaccactcgccatcttctgtgccacacagaatccacttgcacctctaccaaaactgtagttcacgcaggatgtcaatgagtctgggccccgtttgatcacaaacactggggtcacatatccccagagttggcctaattggtccaacagagcagagtggaagaagtgggcatccagatgggggcgcggcttgagcaagggccagaggcaggagggcaggacttcccagggggacaccccagggaactgctctccggaaagggcgggctctgggtggcagcagaaagaggacggcaggacttcccaggggaaaccccagggaactgctccccggcttctcagaagtgcttcagggcacggacaggcctccacaatccccagtccaggcacatcacagaatcaagtgcaaggtgaggaaatggaaagtccccggaatccccagatggggcaggaagcagccgtgggtggccgacaagtgaaatggtgacacctgagcccagatgcctaaagccaccgcccagaggggctaccgagggtcaccaagaatctgggatacccatctggcatcctgggtatccccaccactgcccccaccagtgtcctcgacctaagtcagatcatagccccctccgctcaaagcctccagtggtgcccgcgtcactcaggaaagccaaaaatccttatcgccctaaaggccccacgcgagctgctccctgccctctgacctcctaccactcccctctcctcatctgctgtagcctcacctgcctcccagctgttcctgcaacttgccaagcacagtcctgcctccgagcccttgcactgcctgtgctggaggccaggagcatgctctgtccccacatcgtccggtgctggccccttcttaccactcggatctcaggttcagcatcctcctgttcctcctgctagccaccgagacctgtcctctgtcccccacacacagtagggatcatctgtcccccttctggcaaagcttgtcagcctctctccccacgcaggacaagagaccggccacagctccaccctcggctccctggttctcaatgggcaccgtacacagcaggtgctggctcagtggatgtgtgaacatattcgactgtcctgtgagtgggagtaaggcagagacaagcatcctcagtgatggatgaggatgctgaggatgaagaaaggaagacccgcccgcagccattccttctcacccaagcactcccagcaacacagtgaccagggcatctgtgggtggacccaaagtcactgcttgggtggtcttggggaaaactggctccgacctcagggacccggaggttggggggcctggaggaaggagcgtctgctgggtgtctagccaaaattgcctggggagcccccaaggaagactggacatgccaagcacccagaaagaactgggggccacttctgcatggggcccacaggatcaggagccaggcatgcaaggcccaagggacctgggtccccacagcctcgctgctccctcaccagggggccaaagccctaaacagtcccagagaggtcctgctcattcctgggtcagcccctgcagccctgttcgtgacttgtctgtccctgtcatggactgtgggcggcagacagggagcgttgactgacccatgccaggtccccaggatcaggcacagggtcaggcccaaagcaggtgtcagttaatgccgtgggatgaggatttctggcagtttaaattacttcttgaacactcctggcaatgtagacagtcagtgcccaatgagtgctgccagttggtggtactggcagcctgagtgccaggcgctgctccatgccctttatatgtaaaggctgtgtggcccccacagtggagacaggtaggtgcgggagggagctcagagctgggacaagctgactcagagctgccactcctacttccccacgcaccccatggctgcctcctcctggaggccctcagggggtccttgaggatggagcccctgcctctgcagagatgctctgcccccaagcctctgctgactcagtaccacctcccaaggacccgtccattctgtccatccaaatcccacctccctggaggcccattcaccagcccacacttactgggcacctactgaataccatggctatactgtgggtgcaagagagctcacgaggagaaaggcttagttcctggcatgacagcaaacttggcagagcaatcaggagctggactcatgggggccagagaccccaggaccccaggacagggggagagaggccctcagctgctggggggccctgccccaatggaccctccaatcctatgagagtcccctatccttgatccagtttctaccccaaccccctgaaagggggagaggcgcagaggccccgaagagggcccaccttgtcctgcaccatccgtcaagtacagcagctcctcaaataacactgttgctttcaacgtggttttgtgataacgctgacgagaaaaaaaaatcgcttccctttcagggccattgcgtggcatgtgcacgagctccccaggtctgtgtgggttttctccctgtcctccggctcccccataccccagtgctgtgcacatccggtgaacaggcgtgtcgccgtggccctggctgagtgggtgtggctgtgcatgggagtgtgccccgagaggggatggtgtcctgagcagagtcaggtcccaccttgtgcccagagctgctgagacaggctcagccactcatgaccctgcactggaattagtgggttggaaaatgaatgaataaatgaataaaaattattgcaaaataaaaattcgtcaaatagacatagtcagacgaatgcgtggcaatacaggaagccgccacgtttgtgatcgtttgattttgaagtgcgtggtggcaggaggagctcccgaccatggttgccgtgagatgtgtgttccgttaccactcactggcccacggaaagctggggaagcaattctcttccctgtttaattcacttttcttacatgtatgtgtagctcacatttacttcagtgtttaatgttagaagtgtttggggtcttcattggaagcctggtgacgtttttgtgaccagaaatacctggcaggaacttaactcttatctatctctatcaacttatgggaacactagtgtccttaaaccaattttcacttaaaactggcatcgttttgcttaaagccgcagcttccaagaacttatggatgatgtgatgtgaggacttactgtacaccatgcccaggaaaaaagtctggggtgcccctgtggccagcctgggcccagccaggccatctccccaggctcgggactctcagaccagagcctcccccagaatcccacaacattctcccatctcagcagcatcagcaacaccagggagggcagtgccacggcacacacggtgcccagcctccttggccccgcgcgaggccgctgcagccttcctctggggctgcgtgctggttgcatgccctctttcacttactatcttgaatgagtcaggaaggagaggctgatggggctcatcctggggttggcccagggctctgcgtctctgacctggggagctggctaaccctaagtcccgtcactccctccgaatcagaggcacccacaccccagggctgctgggaggctggacggaagaacagcggccctggtgcacacaggaggtgcttgggaccagccagggaccctcctgagacatctattcctgctctggaccggcccgctggccaggcacccaacaaacaagcccccgggctgcccgcaggcacctggatccgccaaaggcccggttctcacgctcacttcctcttcaggggaggctggggatgcttgccaggcccgaaaccccaagacactctcagggagggctttactcaagacgatcatgagtaggcaccttctaaagggatgagaaagcggaagcaggggggaggggtggggggaaagtgaggaaaaaggggagcaggaggtatgggggaggggaagaggggtagccagaggcggaagggccaatcctcagcctccccatgtgggcgggggcagggctgcctgcccccactccacccagctcccgaaggcaggaggccgggacaggcgcgaggccgccaagaacacagggcgcaaggccccacggaggtcaaagatccccctagggccaggtagtccctgctggcagtgtctgtgggaaaggccctgggcctagccagctacactcaggcctgtcagtgggcactggggctgccacaaatgccggggcagctggacccatcctgtggagtggaaacccaggcccctgagcccactccaggagggtccagacctacagggttatctgggggagccctccctgagcagggcgccagagggctggaggaggtggtggagagaggggttctgcagggccacaagtaccccgactggtcccatccatgccttcagcccctgccagctgtgcctgcccacctctcccttcacctgctccacccacaccttgcagcctcagacccgtcacccagggcggcctccaatgtttctagaggctgcaccctctgctggcacccctctccccaactcccttctcctggacaccccagctgctgcccaggtctcctcctccagccccgacccagggtggcttgtgtgatatcaggggaggtgtgggatcccgggagctggaggaatggccctggcatcacggggcccccctgggctgaagctggagtggcctcgtccatgccttgagactgtgagcttcatgggactgggccctgctggggccacagcgggggaggggtaggtgactgtgtggatggacagatggatgcgctcggtaaatggttctgtccatgctccggcccacgtgctccagtgccttggagccccgctccacctgctgttctctgagctccctgcccccgcatgctatcctgggactccacagcacagacctctgagccgatggctgtcctcacaggcccggggcccctcgggacggcccttccggtgacttcctgccagggaggccagggggaggggtaaacaaggcctccagatggcttcctgtggctgggcagccgtgggaacagcccggcccagggaggctaccaaaggaggggagggtgggagcaggggccagccagcagcatccgtcagcagagcatctgctgagatggacccgctgccctctcggagcctccgacatggccggggggacgtcacaccctgtttacagagggggacactgaagcacaggcaggcaagttaccccagggccagcccaccaaacccagtgccctcccctccacaccagagactcccgtctctctggcctcatctgcaaaggagcagatgagctggctggctagaggtcacctcaacgacaggacgtgcagatgtgcaggtgccagcttgtctgtcttccatcccagcactgccactccccaactgtgctacctagcagagtgccagcctcagacaccagcttccctccctgggaaacaggacgaccatggcagctgccaccaggggaccctgaggtttaaggatgtgccctgggtgagctccggctgctggcccagaagaggctcgcgacggtgccattaagagtgatgccgttccgtcaggtcctgggtccccaggaggagcctgtcctcacccggcttgccccttcctggtgcctcgtgcatgactccctccgtactgtgatgccatctcctcccaaaagcccaccctgactacctgcttcctgccccaccacgacctctaagtcttggggacacatgctccagggagggaactgccatctcctacaagtcctactcacccatgggatttctctggggtcaggaccgcccctctctgcctactgccatccccacggggccagtgtggacccgggcagccccccaagagttatggggaggcaggagctacacagcagccaggatagggatgaaggggctggcagacacacagccgggcaccaacaaccctcccatctgacccagggttctgccagcgggccaagaaagactcaccccggtgccgagacgcacatcctggctgtccatggcctcacttaggagagcccatcatgggggtggggggatggctggttaataaacaagcatctgaccagacccagagaccagggtccaagggtgccatcgggagaggaccccagtcaacacccagggaaatttcaagtgacactgtaaaacagcacccgaggccggcacggttcttgtgaaatgaagcagaagcccagagctactgcagccgtgtatttcccaggctgtttgaatttttataatgaacatcaccaaatgtgtgtctaaaacaataaccacgtttgcgcctggcacagtggtgggccgggcacagatgtgggccgggcacagtggtgggcaaggtgcagaggcgggccaggcgcagaggtgggccaggcgcagaggcaggccaggcacagtggtgggccgggcgcagtggctcacactgtaatcccagcactttgggaggctggggcaggaggatcacttgagtccaggagaagcagcccggctaacatggtgaaatgccatctctacaaaaaatagctgggcatagtggcgcatgcctgtggtcccagctactcaggaggctgagtcaggagaatcgcttgtgcctgggaagcggaggtttgcagtgagctgagatcgtgccactgtattccagcctggacaacagggtgagactccgtctcaaaaaagagaaaacaataactacatgtttgaagcgttgttcaaatgtcgcctctcccccatgtgagctccttgtgggtcccgcagtgctgccattgcacgtccccagcctgccccaagaacacaacctggcaggtagggaaactgaggcacccatggacagccctcccccaggtcacaggcctggaagagagtaaagggcatgccaccaggaccccgtccatccattgcagtcaccgactcagaagcaagcagcctggctcaggtggctggagctcagctgccaggcctttgtcctgatcccacccatctgctgtgggggccggggtctcccccaggctccccattctccagacacaaaaacggaggcccagaaagggcaggagcagggagagtcggcagagccagggccaggccttgtagctccccagggccatgcggaggggacagggaggccaccgaggggaggggcagccgggagccccgggcacccccagggaccccctgagctccacacggcaattcccagcagatgggcctctgggcagctggccagagggaagcaaagcccgggaggaagggcctctgcggctgacccaggacggggagattaaaggagaagatgtttgccttggcaggggccccaggaccaggcgagccagaggagggggccagcgttccaggcatcagtagaagatgccagagtgggggtgccaggagtaagaggcaccggctctaggggcaagggcggagtggatgagcaggtaaagcacaccgtgtgccacaggaggggtggtgacagggacctgaggcaggcgggcagaaaccctgggtggggtggcggggaatcctccgagccctcccgagcctcttccaggaagcctgagtcacaggagggacccagggccaggagagcagccgggagcaccggtcccgtgggaaggggactgagatggggacagggacagggcagggccacccgtcacctcctctagctgggccaggcctggcttcgaggtctccgtggcgggtgaggacgaggccgtgggaacaggctcctgcagctccccagagggactagggggtggtagagctagacagagtgggtccagcccatcctgcagaaggggaaactgaggtccaagagaaaagcctcctggacaatgacgtcatcaactgaagtgtcccctgggcagcccaggcctggacactggggagaacaaggcaagagtctccccagccaggccctgagcaccctcatccgggggtcttcaggttccagagtccagttctagcacatccaccctcagccatggacccgagaccctccaactcccagggttagagacttcctcttgatgccctatttccaggaccccaccccagggaaatctgatccccgcaggccctgctccacctcaccacctcactctagaacattccctggttcctgccactccatgccccaggatgggagtcagggacttgaaccctagtatgctgagtctggggtgttcccagacgcccgtctgcccacatcagcaacgctggctcctgcaggggtgctggaatctctgggagttggaggctgtgcctcaagcagaaccaagcaatcagggagtgcttcccaacttataaccactcaaatggtccagcctcttattggcaagtgcagagcagagactccaagggatgttatgcccacctctgagggtcacctagcaggagacctgggccccactggcccactccacccctcatccagcaaataaaccctgagcactggctaggccaagccctgggcagaaggcacaggggccctcttcttggccatcccaacaccactgggccctgaccacatcttccagggccaagggctccagcctgggcacctccaagcaggcctcaggcagacgcctccctccctgctccgcctgcgctgactgtccagggtcctgcatccaggtctcggcccgtccaggactgagccacacacagcgaggctcacacatgataaaggcaggagccgggccgaccctggacagagagcgggctagtggtgccaagccctcagaaccaggggcagcaggaggagcaatgcccaactcaggtccaatttctgcaaaacattttgttcaactcccttccagctctgatgggcaaagataacagaatctctctgaactatccagaaagatcactgccttttatggacaagaacactggtcccaaagaggtcgaaaccaggctccacagccaccgaggcactcaggccccaaggcagggttctcatgaccaatacccgccccgccacctgccttgtgagggtctgcaggggacgtgcaccccaccttcacctcctgactcactggactcccaactgaggccagcggggagcatgtgcccagcgtggggcagccaggtggcggagttgtcattgttctgtacttgtggtaggagctgggcatggcagaggcccttcccagcaggactcctgccctctcccacccaaccccaacccaggacaggccttacaggcagaagtttcagcccacccgggggctccattcaggtcactgggacctccttcagagagccccccactgcctggagcctgtgtgacctcatgaagtgacagagcatcagcctctcattgtacaatgggcaggcagcctgtcctgttgtcacagggacccaccaggatgaggttggcacagccctgcacaccctggcagccaccttccccgagccccggcttccctgcgtgtaacacagctctcactccggctccaggagccgctctggccctgaggaggtggctagagccaaattcaacacagatcaacctgtgttcatccccctagccctctggggtcttccagcctggcttcctccctggccgggaaaacagcaagggaggagaggctgtgggctccaggcccccagccagcccggctaccctcccacaggagtacctggctcaagggcaggtcccagagagcacagcccaggctgtttccttccctggatcgttcatccactgtgtctggaaccccagcgggctcagtgcactcaggacccgcacgtcagcttgtcggctccacacatgcagcccctcgggttatgcgtggtcttgtcccacgtgagaagggaacactgagactcagaaggtgacatgaccaagctggcgtggccaagctagcccttcccgaggccaccgtctccccaccctgtagcccccatccccacctcatctcttcctggccaaatcatcagcggtgccctttgtcccccgtgtgcctgtggtgcagctgctccacttggcgccagctcctcggggcagggctcgggactgtcctgttcccagtgggccagagcaggcacacagtaggtgctccagggctgtgggctcggtgagagaggaatgctggacgggctgcccggggccagattccataccacctgatgacctggagctgctcaccccactggcaccatcacccaaatgaccagcaccctcccctgcccatttactgacctttccccaaaaaggaggcatggccagcgttcaaattcctgctctcctcccagcagtgaccctggcacgtcacttctcccctagggtccttccctggctctagggcaggacggtaatatgaacacttacccgccagaggtctcaatcctctaggatgaagggagttaaaatgcatcaagttttacgtatgagtccatcacggtcctgaccaatggcacccacagcccagataatggggccggttctggctgtaccgcaatcaccaggcactgccaaggagccccaccttcacatggcacggggttacagtcacggcaggggtgggggttacacatcaggttaggcctgcttcctctgagccagtggcagggttggcgggggcaggtggccaggacagggtgggagaggggaggcagccccatctgtccccagccagggtggcccttggcaggcaacagcaatgactgtgctgcatttccactccttctagaagcataagccctgacatgagggcacccctacatctggggaagacaccaggagaggagccggggggcatgggagcacccctacatcccgggaagatgccaggagaggagccaggggacatccccactgggtagatgaacgggggctgcaggagggaggggtggcccacgcacctaccccgggtagatgaacgggggctgcaggagggaggggtggcccacgcaccttccccaggtagatgaacgggggctgcaggagggaggggtggcccatgcacctatcctgggtagatgaacgggggctgcaggagggaggggtggcccacgcacctaaggggaagtgggggtgcactgggcaatggcccccagttcccctccaggaggaaggtaaacctgagggcccactctcaggaccccagctgagccctgagccatgtggtcatccctgaccctcagttccgcttccaaaccaggaggctgccactaaagcagcccaagactgagtggcacgtgcctggcgggaagcgatgccccacctaggggtccttagggccacacccttggctgggaggaacagcctgtccttattttctgaactgtcttttgtacaacagccttggcgcagctcaaaggataagtgaggttctcagggtcctgacctgaggcgccccaaggaggggagacacgcgcacactctctgccaggtgaacgcctactgggccatcggaacccacagctcgtgccccacccacactggcacgggctgtgtccacgtagccctgatcccgctcggctaaagagcgcagctctcagctgccgtaggtagctgccaggaccctccaccctctgctcaggctcctgggtggaaggaagcacccgtccctgtccccgtcccaccttggggaggcccccctctctccagggaggctggcctacccgactggcaggcgtggggcacactctgggccgcccccaaccgcacacacccaactcgcggggcgccgaagtcaggcggcggcgatgccaacccgaccacgtaactgtgcgaagtgcagtacctcctcctgcagcccacagccactcccacccaactctgaactgtgcagagaggacggggctcatcggccctcggaccttgcccaggtccctgcctatgggtcctgcgagccggtccaggtcagaaggagggatgggaagtcttttttacctcacacatgttcacccgtgtgaccaagcttcaccactgtcctgccaggaagacctgtcattgctcccattttacaggtgtggaaacggaggggcaagaaaccaagtatccagcaagacactgggaggccaggccctcctgcctctagcccagcctcgggctgctgcacttgctaggaaacaccactgcaggcagggaggggtgccagggaccagagggagtaggtgacagcaagggcggccagggtggaggtggggagaaacggtgctctcgaggtgagaaagcgccctggggtggtctgggacagtgaccatctggttacagcctttggtcagatttgggaccttcatggaacaaggcaagcccaaggtcttggggggcgaaaaatcaccactatctgccagccccaggcccaggagctcccagctcagcccctctggccaaatgccacctggacaccagcctggtacactttccacttaactcaccctttcgccaggacctgccaaccagggagaggcctccccaagctgtatcaccgccatctggatgtaagtccctaaggaggtcacgtgcataggcattgggcaccagcggacactctgcccaccctggcggtgagagggagggctcacaccagcttatgcccccctctcagtctgactgtgtgcacctctgcccaagtcctcagccagtaaagtcacgtctgtgtagcttgggagtagttacaccacagaaattggccaatgccaattcaggatttggttaagcatctgttaagcatgccctcatgtcatctttgagcccagccacccatggtgcctccaagacctcctcgccatccaaactgcccacttgtctgagaaagctgcccacctcccggccttcctcctgcctcccatgtccagtgcctgactgcatcagccagccaccctcaccatgttctgggctgttacttgggacagagaggggaccagctgaggcccccagccttactccagtggtcagcgcaagcttccgggaggagggcaaaggcagagaggagcaggcagctgaggaaaccacctggaggctgcatctcatccccgcctgcattttctcccatcacgccgactgcctgcgggggcctgtccgcaacctgccccgctcagccagccagccatgccccatctccaggtccagcattgggcctggcacagagtaagtgcttggagaacacgttgggggtgttgaggggtgaccagctccctagcggggctatttggaaacagcccaggaattcctacacagggcagcttctcctccttcgtaaccacagtgaggggggccggcgtggtgatggggagatccccaatgcctaattccactcaggtgacaggttcggggcccatttacagcagctccaacgccccctttgcagatggggacaacaaggctctgcttagccccgcaggctaggggctgcaccaactccacctttgtgggcctcagtctcctcatctgagaaatggggttaacgaacttcttgggaggattgcaggaactcagtgaagcacggctctgcacagggctgccaggcggcttctgtctgtgcaaggccacaggcaccctgtgttcagtgacctcctctggtctgcagccgaggacactgctccaacctgggagcagggcccccagggtccacagactaggtggatgcccaacacccaccatcgtgtgcggggcacaccccagagcccgcaggcagagagagggggtgcagcacgtgcctttctgtcttggctgagggtgcccgggcacacactgtgaccagctagcctggacctcacgctgcccttggagccgctatcacagagggccagggaagcctccctcataaagggcttccctccgggaaccggcagggtgaaactgctctgcccacttggagctaagcatgccaccaccccacccctgggccaccagctgcccaggggcgtgtcaggagtcacccgtttaatccctgaggcacgtggatcaaggctgctgacctgattctaccggggtgtgcttggagggctgaggcgccgcccgagtcccaacactggtatggtctgaggcggactccacccggcctgagacctgacgctctgctttcccctgacctccactgacatctacgacccgccctggaggcacggaaggctgtggggttccagccccccaaactgtgcagctgaggaaaatgagccgtgaatgggggcagagccagatcctgggcgggaccctgcgcaggatgaactcagggtaggaggtctcccgcgcacccagaaacgggagcgggtcacccccttccagccaggggtgttctgtggctcgcctggggaaacagcggcctcctgaggctcggccccggcacgtggcagcctccaggcccacgttcccgccggatcggccgccaggcgcagggtcccgggacgcgcgggcagggggaaggcggcggccctcccggctgcgcggccccgaagccgtgcccggagcgggcggcgggctcgcgcgcggacggccccccacgcgcctccacaaagcgccgcgcgcccccgccccgagcgggcgcggaggagactgacctggcggtccgggcggcgccggcacgacgggtggagggctcgggacgcgcgcgccctcgcgcacaggcgcggccgcggctccaccggcttagggcgcgcgccggacccgctgggtcacgtgggggcacggcccaatgggagcgctccccacgccgcggccgcgcgcccgccgcccccgaggccgcccctgggctgggaggaggcggctccggtcgcgcgggcggcctcggggactgaccttggctcctgtgcctgccgggcgcctaggccaggtcggcctggggcaggcgggcgtcggaggggcagttttgaagcccgagcgaagaggcagagggcgggatgcggacgaagccagggagttcacgaaacttctggagttctcagtttccccctaagtcgactggggctaggtcccgtgccgccaggcgggctggctgaggggatgggctggggcgacaagacggcagccgcctggcccgggtacttggggtcagaccggcttcgaggcccccggaccgccgtgttatcaggacgggtagggagcccacgggacgcgtggtgctcagaagagcggggaggcgtgtggacggggcctgcccgagctgcaccaccgcctgcctccaggctgcgaggcccgcccaggcgaaggcggcatctcagcctctagcccttggggaccttgaggacgtcctcttatgggtcagccgttcctagggaggcttgtggctccagttactggaaaaaccagtgctggttcacgcaggaggccccagtacagggggaaacagaggcaagctggggtctcccaggcggcctcacccacccagccctgttccatgccagtccctggacccttggcccagtcagatgttcaactgctccagccctgcctccacttccctgaaagatgcttttccacccatccaccctcagcagccagagggaccccgggaagatgggagtgagagctgccttcgtctgcaaaagtctccagacaccacctcactggtgaaggccagagaccctaaactgtcccaagaccacctgactgggctgcctccctgccacctggctgccagcctctctcagagcgcctgcaagctattcctccaacccagagtttccttcccagctaaaggcctttgcacctgctgttccttctgcctggaagttcaccgcagactatcccagggcctccatccttcccattgcatggtccccatcagctgccgccgcctctgagagctcagtctccactggccatcctgtctctcagcccactgcactctccactctgccagaaagtcccccaatcagtgacaacacaggtcacggtccacacctcacctggtttgtccccagtgcccagcatctggcaccgagcaggtgcgtgcaaatcctggacaggtgggcaagctgatggtgtccagaggcccctggtccttaagggcaggggtggggatggctcagaggacataaccttgcagacccgggttcaaatctgggctcctcagctcatttggtcctcacacagcccatgttgggagagctagtgttctccctgttttgctgatgagacacagagaaggtcagcaactcccgaagattgcccagcaagttgggagtaaagctggtgcaattcccacgtttagctgctaaacagggtgtcctgtacttggtgtgttcaagcagaaatccacacatgggaaggtcaaggcaacatccctggtactccagctttgaggtcctaggaaaaagggaacctcccattaaatgcttctattgccgggaagttcagcacctgtaaaagcagccccttcccgtttcactgtggctgcattttaattcttattttttaaatgtttagcttaaggccgggcacagtgactcacactataatcccagcaatttgggaggctgaggcgggaggatcacttgagcctaggaattcaagaccagcctaggtaacatagtgggaccctatctctacaaaaaataaaaaattagccagtcatggtggcatgctcctatagtcccagcttggagattgaggtgggaggatcacctgagcctaagaggacaaggctagagtaagccctgatcccgccagcaccccagcctaagtgaaagagcgagagcctgtctcaaaaaagataaaaaaaaaaaaagcattaataaataaatgtttggcttcatctagcctgagcagcaccaacaccccctgcctgtttcatgctattttcctcctctcctgcccaaaatctcagagaggtttctatcccagccacccaaatttgctggggtgagtgggctcccgagaggctggagcctccttcctccccacgctcttaccatcctgcagggagtcgggagcaaaggaggaggctcctccatgctggattcatttcagttctcagacattcaccgagtgctgaccacatgccagggacttacacccacccaccaagtccacactgagccctgcagaggaatccctgacacccccattttgcagattaggaagcagaagctaagcgaaagcagaatcaagattcaaacccaggcacggtgaaaccagagctgtccaactgctgtgagtggaatgggccgggcatgaacaggcttggggagaatcctgggatttcatagccggaagagagctcaaagtgatcgtgttttacagaggagaaaacggggcctcagagatgatggctgagccgtgaaaaggtggggtcagaagccaggcccagtctcctgaattccagactccagaatctcccccaggattgaggaatgttccacagaaagaatcccagctccacctaccccagtcactggacctgcccagccctggaggcatggccaggaggaggcccccgcaggtgggggattgttggagagggatgccaaccatgcaggacgatctagacagtggtgaggcccactggggctggcaggattagcagattagctccaaggaggacaaagacgaggtcagcgttaagtggatttctggaaagcctcctccagcccagcagggccctacaggaggggcccaggctgggggacctagatccagccacggagggcatgggtgggctaatggcaccagcagcagctcttgagcccccatcactgggctgcacactttgacctctcctggcctcagtttccccatctataaatgtcatagtaatagctccaacctcacagggctcttgggaagacccacaagatggtggctgtcaagtgctgcgttgcttctgcctgcgcagaagtagatgtctttatgactgtccttttgaatcctcctcaagccctgagcgtcaaacaaaataaaaaagagcttgttgttcagtggttagttaggtaaacaggagcggggtgcaggagtatacatctaggaagagagtaagtgtgcggaacgatgctctctgggccacttcacgtcccctctgttccctgatttcagtggcagtggcccattctgagcgagcttggaccctcctcctcagtgcctgccttccgtgtgtaccaagccctgaagggcagaggagggccagccctccgcagtgtggcagggctctggcggatacacctgcctcccatctgcagaaggaccttcctcaggtgtccggcacacttctcaggaggtcctgaaaccagctgagacctccataacacacctgtgttggctccctcacctggtcatcacaaataaaccacctgcaccaatgtccctatctcaggctctgctatcgagggaaccagcgtaagcagccacgcccctgatgcgaagaggaagcagggcttgagggaggccaggactcgggggattggcgtgcaggagctgggaaagtcattttcatttccctccttcccctagtttcgttaatgcagccacgctactgtgatggtgacattttcatttgtgtattagttgtgcctgtaaaacctgctctctctccgcgtctgtggtcaagagttctgagtggctgggcggggcggttctctggctggggtctcatgagatgcagtcagatggccagggttccagacatgcaagggcccgactgcggctgggggatccccttcggaaccctctcactgtcccagctggccaggccatgcaggttattagctgctgcttcagagtcttcctcaagacgcccctctgtagggatgcttgggtgtcctcccagtgctggggctggcctcccccacaaggagctacccaggagagcaagacacgtgtgatctgacctcagaggccacccagtgccacctcactgtgttctgtggggcacccaggcctgccctgacttggtgtgggcagggtggggcggcttcccaagcctgcagctggtgccacctacaaggatgagggaaggccactgcaggctgagctccggccccttgggggctggggtggaggtatggcagtgcctgacctggacttctgagaccaccagtgaggtagggtgtgggagtttggtgggacactgagctgggacctttgcagcagtggggctaccctaagcctggatgctctagctgtgtcgcccattggcagctgaaagcgctcctggctccccctgcccctgagtttggcaaactttcattgagcacctgtgccaggcatcactgggacctgcagcgggagcccccctagacagtgctgcagctactgtcgtgggggcatccaggaggcacgtcccaggcactgcatctgagcagggacctgccggccaagcgttcttcctggaggaaagaggctggagctcagcaggcaggaggggcgccttggcggagggaggatgggggagtcagcagggaccctgtggcctggtgctggggtcccaggcaagagctagggtgtctcctggggatgacggggcctccctgggggtgaccgtggccaggtgtcccaccacacacagccctgctggcctcagccccatctggcacctgccattgcacttgtgacccccagctcctggaggaccaccgtccatagatgcttccgccagtgaggaggccgggacacccacgctgcggcattgaggatgccgggagggtcggggcaggcaagcttgcgaggagcgggcctcaggcacgccacacgggcgccccctcgtggggcctgtggggcagggccgctgcactgggtacgagctgggcacaggtcacgggcaccaccctcagcccggttgaatgctctgctgttgctgtagggcgacgttgaacatttttgaatgagaggcctgcatttccactttgccccagggccctgaaattctgtatcaggtcctgcctgcgggtccctacctggcttcctcatctgctgggattcaggggatactccagcaaaaagcgtccacatgccagccctgcagcaccccattcagggcaagaggcagagccgcagccggggtctgctcctcaccccacaatcccggtgaaggaggatgcgatctgcaagcgcggggccctccgctcagtcctttgaggctgagtgtgttcacagcttgactgaggctcccgcacacatggcatggccaaagggagacctctcgtgcgtctgatgtgcccccatcctgtggcccatcaaggtggggtccagctccgtcctctctgcactgcagggtccagcagagccggcctggagcggctggtggggaaagtagaaccgtgctccctgtccgccccaagagcagggctttgggacaccacagctgggtgtggcctcaagggtggtggagggatcggggactctcagagcaggcctggcagctggtgggtgtcgggggctggcccagccaccaccccctacttccatccatggagactatggccctgggagaggcctcctcagcacccagggctcccaggggtcaggaccctcccccagagatcagcctggaagggcctgtcctttcacccccaccaatgcagggagagcctgctccatgagttgcccccaccaggtcctgagacccagagcagaagccctccccagctgcagcccagaccactggcaagtggggagtgacaggctggtctgcaggaagacccccagctgggcctcagcaagcccgcccctcagtgtgacttaggaaaacctgtatcttcagagggggagaccccacgggaggtctccagggagagtggggagtggccttccaccggggcctgcccaaccccccgacccacacaggttcagaacgccgctctcccctgtacccctggcccaccagggacccaggagtgaggctcctgcctcctgtcctgaagccctcacgtgtacctctgggcaagggtattgacagaaggctttcatcccaccttgttttctggggacctcttagaccctggaggggcccacagggctcagagacccttgccaaaccaggaaaatgacactgtttctggcattgaagttcccaaccctcaatccaagaacaatttggagaatttgtgatgaggctgtttctcctgttttttccagattcagtgaaggtccctgagctgaggacgagagaggagagatgatgaggaaggcaaagaggagacagggggaggagagcgaggaacagaaggaagaaggggaggagggagaagggaaaaagagggagggagggggaagggaaagagagagagggagggagaaaggagggaggaggtgaaggggaagatgagaaggggaggaggcagaagatgttctgggaagggacaagagacgggcctggtgcctgggccccacgcctcccgttcctcagcagatgaggcctgttgggaggctgaggaagggagattggtgtccccacagggagcagagcagggctgaatctagggatgcaacaatgcagagggtccaaatgtccccaccaggcccagaagagggcgggggcagctggccccacccagggacccaggctcaggcaggctgtgcactgcccagcagcagggaacgtggggccagggcctccatgcctgatgtgtgctgagcctgcatgctgagccctccatggggagcctggtgggggacagagggcagccacagaacaagtgaccctccctggaggtcgtggggcccaaacactggatgctgcccaagacacggcaggtccaggctgaggaacctgaggtcccgaccctctcacgtgggacagggcctgcaggaggcagcctccaggccccccgaacctgacaacccctcatcctcctggcgtgtgggtctgtcttctccactggcctgggatccatccacagttgccatctccctcgtccccaccagtgggcactcagggacaggagttgagtgaggctccatgtgagatgcagggaacacaggcactggtgggggcagcacagcttgctggagtcccagcttcctggccgctctggagtcaaggaaggctgtgggtctcataccacgtcctcagggctgctgaccaccctccacgggggcctttatcccaggaaaaatccctcattcccgggaagctaccattgccaaaaatatggcctgacaggcacccgtctgacaggtgctcctcaagcacccatccgcggacacatgctgaacccatacgatgctctaaacggggcgtgcacactgcagccctctcagcacaggggccatgcaccaccagttaccaggataatccctgtggatgtcggattacagcctgctgggctggagaagtggctgccctcagcagggcgcgtgcctccccagtcatcccagtccccctctgcaatgacagagccccagggagctgcagagaaggggatttcttcttgcaaacaaaaccccacagggagccccaagatctagctctagtttattcctctatccagcaagcatcagtcagacaccttctgcctgccaggcctgtgccaggacaaggcgacaccagaccctgtcctccggccacatcagggaggggttggcgaacaagggaaggaacaacaggaaggtgccagtggagaggccaggcgcgtgccatggcggtggcagtcctccttcctgcagatcacccaaagccaaacagcaaggaaatgcaggcgcggggaagcaaagccaggagcccctgatgcccatgctgttagccacccatccacctgggtgcagaagatgctctcggggttcacactgagagacaggctggagctgggcgatggcccaagtgagttcggaacaggctgtggggcaggggcactcccacatctccagcagggcttagagaacaggcaaaagtggattccgatctcggcaaggcagcgagtatcccctccttggaggataaccgagcctctctggggaactcctggggtggtagacgggagaggagatttctcaccggaggggagaccagcctgctgtcctgggctcgggagcagctgaaactccttttggggaatgctcttgggagctgatttataaggcacaggaagagccccgtgtggtgcagccccaccccgcttgtgtccaaacacagcctgttgctgtggacaccctcacctcgctcctggcccagggaggggcgacttgccagggcacacagagccccctaccaggagccagcctgatccctgacctctgaccctgggagcatgtgggaggtgctggctgaggaagcaaaactgccagtgtggcgtccatcacactttccacatgttttagcagcagggtgtttgtttgtttgtttgtttgtttgtttaagagacagggtctggctctgttgcccaggctggagtgcagcggtgcgagcatggctcactgcagccttaaactcccgggctcaagcgctcctcctgcctcagcctccagagtagctaggactgtggcatgtgcctccacagctggcttagcagcagattttttcttgcaaacaaaacctcacagggaggaactccaggttagagaactagcttattcctatactagcaagcatcagccaaacaccttctacgtgtcaggcctgcacaggacaaggtgataccaggccccgtcctccggccacatcagggaggggtcagtgaacaagtcaaggagcgacgggaagatgctgtgagcatggccaggcgcgtgcaggggcagcggctgcttcccctccctgcagaacacaccacctaagagagacactgctcataactggagatcagcaacatgcccagttcacagagagggaaacagaggcacgttgggagcaagtaactgcggagggggatcagttatagaaggaatgcaatgggatgaggcccaggtatctacccaaaagaattaaaagccaggacttggctgggtgtggtggctcacgcctgtaatcccagcactttgggaggccgaggtgggtggatcacgaggtcaggggttcgagaccagcctgaccaacatggtgaaaccctgtctctactaaaaatacaaaaattagctgggcgtggtgttgggcgcctgtagtcccagctactcaggaggctgaggcaggggaattgcttgaaccagggaggcggagcttgcattgagccgagatcgcgccactgcactccagcctgggtgacagagcgagactccatctcaaaaaaaaaaaaaaaaaaaaaagccaggactcaaacaaaaacttgtatgtgaacacgcgtagcagtgctgttcacaatgaccaaagccaggaaacactcaaatgtccgtcaaccatcactggatgaacagacaaagaaaaggtggcacatctcagcagtggaatagcatgcagccatgaaaaggaaggacactctgatccaggctgcagtgtggacgattcttgagaaaatgaggctgagtgaaagaagccagacacgacagactgtatatcacatgattccatttatacaaaatgcccagagtgggcacatcatagagatgagcacagattgttggttgccagggctcggcgggaggaatggggtttcccatttcgggtgatggaaatgttttggaagcagaggtgatggggctccaccctgtgaatgaaggcgggttgcatactttaacatggtgaattttgtgttatgtgcattttttcccgaataagaacaggacgccgctgtggaggggagagaccgctcacggggactggatggccaggaagccactgctgtgtgccaggccccttccaggcttggggtcatgccccctcatattaggcatggccaccaccactgactgtggtccttggaatgcgagtagaagagatgaatgtgatggacacttcagggacaaagcttttaggaactggtgccctgttcttccactctcccccaccacaggggacctgaggccttgtgttgagacagcaccggctgcaggcaatggcggagcctctgtcattcaggtccccgagccaccaaggagcaagagacccatcccccaccacaccgaccagcaattcatggcgtgagcgagacccacacctccatcaataaggccacagaagaatcaggggtgtgtgtggctgcagcaaacccagatggtcctggccacccacctgccctgaggggccaacatttgagctcggccctcaatgaggtgagcagtgaccggcctaaaggaagaatgctcctggccaagggaggagcagcgcgaaggccccacagcagatgtgtgcctggtgtgttcaaggacagtcaggggccggcagaacccgcagtgggaggcacaggctatggggtgaagcactgtgcttcctcatcaaggggtgggagcccctgacggttttcagcagggagggatgcaatcagatgtgggctctaggaggacactctgccatgtggacactgggtactttgagaagcaagtgacagaatcccaggcttcccagtgaggaaatttaggaactcacataacgggaagtgcagagggactgtgggctccaggacagggtgaccacacccagctgtgcctctctaagattttccccaccatcattctcaggcaggttcccctcatgctcacaaaaaggctgcctgtctatccggggacaggagggagctcagaacccacaataagcctctggtcacctgtcattggcccaaagctggctaggctaacccaccctaaaccaatcactggccaggaggaagggtagccaatctgtgattggtcagcagtgacaatataaaagcctcacaacccagccatacagaaaaggctttgggagctcagaccctcagaaagcccagctccagcactattcaaccactcgccataactccccactgcctatagggcagagcacaaactcctgagtatggtattctaggctctgtgtctctagatgatttcacccttgcaatgaccctgagaagttaatatgattactcccttgagagatgaggcaaccgaggtatggggaagttaagtaacgtgcccaaggtcactcagccatcaggtggtggtggcaggactcacactcaggcagtggcccagagcctcctctgcccacaccgccagcatctgaccagccccctccatggacggccatggtatttcaagccgctgcctgaggttttccctgcgggtcctgccgttcactccatggcaggcacgtttgctccctggtcttcacagaaaaccaattcgggcgtcccccactcaaaaagccttcctgggctcactccacttagcagcctgaggcctcgcctcagcacttcccctgtcctgagtgacctccaaggcctcgcctgtgggaacgagaacgaggacgaggctgggaacagggcgacctgagacactgtgtggaaaggacgccctgaaacccccatggtccctgccctgtctccagcctccctgccgcacctgcagtttctgctgatggccccagtgtaaacacaccaaggcgcggggagaagaagtgtcagcccagccttaaacaaacctgctcagccggagatggggagcaggctcgcaggcagcatgggctctggctggagggatttggatgggatttaagcaggacttggtttacagagggaaaaaataattatctacaaggcctcggataaagtaaagcccatttgttcctgagtgaatgaaggaacacgtggaaactgacgatgtctacctgggactgggctcagacagttactcaatgtgagcccaactggaggctggccgtgggaaacaagtgggctgaccccctgtatccactcgaaccggcatctcagtgtgtgcgcaagagccaaaggccggctcaggcacagccaccctggcagcacatcagaatcatggcagagtccttaaaatgctgtgaccggccgggcacggtggctcacgcctgtaatcccagcactttgggaggccgaggcaggcagatcatgaggtcaggagttcgagaccagcctggcaaacatggtgaaaccctatctctactaaaaatacaaaaattagccaggcatagtagcgggcacctgtaattccagctactcaggaggctgaggcaggagaattgcttgaaccctggaggcggaggttgcagtgagccaagatcacgccactgcactccagcctgggagacagaatgagactctgtctcggaaaaaaaaaaaaaaaaaagtgctgatgaccaggtctctgcccagaccattaaagtcagcctccctgggccaggcccggatgtctgtgtttgatgggaactcccggtgattctgatgcacaggcagccatgggcacacacgggctcacttgaccccacacagccacggaccagacccaaaccacaactgttgcctcatttactcctcacacggccccaaacattgctgtcctcactatgcagatggggaaactgaggcacagggaggctaagtaactgcttctggtgggaggcggtggggcccgggttgagatccaaatttgccatcccaaaatgtccccatcaccccgttgatgagtcattttttgttgcctcctccctcagatcagggtccccagggcagatactgtcctcatcagacctgcagtcctcaaggctgtgtcctgcctcctgacttgctccacaggcgcctgtggggaaggggctgtgtgctggcatgggtggtcctgggtctgagtccggactctgccccctgccagctaggtggtcgggggtccgcatcccacgcctctgagctacaacccctgggccccttggtaagggctgggtcctggcaggcttcagggtggggcgggggctggttcctgggtctgggactctgggggaggcagctctggtgggcagggaggtgtttcacccctgccctgcccctgcccaggtggaggacatgacacattaagtattcccccggacggtggacagtgctgggaggcttccctcaccctgcctggcagtcccaaccagatggacccaaatgcagagtgaggaagtgcagagcccatggcccagctcccagcaggaagaacactgagccaggggcagcctggccctgaacacttgtgggactttggcaattactatgcctctgggcttcaggttcttcatggataaattaaggagtctggacccaatccagtcggggccatgttgcctgctctgctggtccactgggccggttgcccagagggccggggagggggtgtccatccaggctcctggggagcaagagcctcattgattggtgacgcctgcccaggaccagccagggatgaggcaggcgtgcgccagggcttctctcctcctgtcaccctgcacccacaacctgggaagggaagttggcattaagctacacatttctgcctctactgatgtacaggcctgatggtgatatgcaagtgactgaacaattagagagcagaggggtttctgtattaaaatttttaaataaattaataataaatacaaatcagtggaaagaagaaattaacagtcacctgctttctcccgcccagaactaatccttgctaatgtcctgcgagggttgcttccagtcactccaggcaactttttgctgttctttaaggaagaaaaggacgtatgtttatagaacggcacgagctcaccgtaaagatgtcaaacacggccaggatgtacaaaggtgaaggatgaaagccaccgggacgctgctgcctggaactaaccccacacggtggtggccggccccccggcagccttctctgccagggtcctggagaaggacagatagacacatggtcagctggacaagtgaggcggatcttccacaatccatttctctttggatgttgatggggctcatctgaggcccatcccagtctctctgacagaaatctgcccctgaaggagggtctggggcatgggggcagagaagcccttcccaacagctgacctggctctaactctccaactctcagcgtggctttgggggctgcctgccccatctgcactgaacggggccggaccacaccgtggttctaacccacgtgggttttcagacccttcacagtcccaatggaccctcatggcacacacatgggcagttgcacacacacaaagtctaggggttcgtgaagccattggagctgcccaggaccccagatccaaaactctgaatcaaaggatgttgcccccccacccaccccagctaaagggacgaaagattctaagagcttcctcttggagaatattttcaaatgacctgactgtccacctgtcccacacacaggtgtctggtagaaacagaggctggactggtggccaggaccccagggtctttgctgggtctgagagggccacacccccttccctacccatgaccatgcccagtctgcccactccccagacacccacaggcgggacacagcaaccatctgcttctagacacgatccctcagtagcccatccccagctgtcctgcccctgcccgcagtgataggaggccccacccagaactggcctttagccgtgactcccgcctgagacctgctgcccctcccaccacccaccagtggggtctctcctccctcccctccaggaagccccacctgctcctccaccgaccgccaaccttaatcccacctgccacaccaagcagggcctttggagacggggctcccccaggtctggctggggtctgcagagtttctcacttgcagcccttgcaccccatggccggcccttgtgaggaacagcacaaggtggctccgtgccctgctgcggggccactgtcatgaagatactgccgtcaccaccatcgctatcatgacggccaattgtccctttgtgtttgtggatctgctacctagtttcctgccaggctcaaggctctcacgccccccacagagaagggcctgagtcgcagggtcagggaaggcgcccagtctgggcacaaggctcatttcctgagagcagggtggggggcggggggagtggggactggagcccagagtccagctcatcagagggaacacagggcccaaaatccagacgttcaccatgaccctcttcaaaagcagaggcccgagcaggatgggaaccggggagctggccatccaaaagcaccccggccatgggcagccaccctgcagcctgagaacgtgcttgccctacccagcctccctcacctcttccctgagcttcagccgctcccaggaatgtgcctgccctacccaggctccctcacctcttcctgagcttcggcggctcccagccgcccccaccagctaagcaccttccgggcctgctctctgtccttctgacacgcctcataagcaggaagtggcctggggccctgcacgggcaggcctgctggatcccagaccccagcagctctactgtgagaaagatgtggggagagcctgggaggggatgtggggagcgcctgggaggggactttgagcacctccctattcctcactggaaagaggaccgccaaccccaccccgggacaaggcgcagaggtcatgagaaatgccctacgtagggccacctggtctatgagaggccttcttaagggggccagagtagatggggggtaacctgcatcgggttgagtaccctgactgctgactccagccagaggatgagccctgatctcgctcgcacactgagccctgatcccgcttatgcactgagccctgatcccgctcacacactgagccctgatcctggccacacactggtcccctaccctggtcacacactgatccttggttctagtcacagcctgagccctgatcctggtcacacagtgaactctgaccctggtcacaggctgagccctgacccaggcctcacacttgaccccccatatggccccacgagttggtcaggacagagtccaatgctcttgactccaagtgagccagctgaggctctgagccacgaaaccctggccttggtcaggggccatgctgggacctgagcccggggcttagactttgagcctagttctcactcccacctccaaagcacctgaggacctggcctcagctggtaccctggaggagcagtgacagagttggaggaggtagcccctcctggatcagcacccatggggctggaggcagagagggtctgtgccccagacagtgaacaacagccggtaggggttcagaactaggcagagccagggctgccagtgggggctgagctcccctgggaggcctccaggaagaccgctcaggacagaacaggccgattttagggggtagcagagacagggaaggtacttccttagtgagagactccatagctcttgggacaacctcaaactgggccccaccagcaagggctggaattccgatcccaaggagtcctcgtctcagcccccagggcaggtcccggccacccgctggtcccttctccaagtctcaggtttctcgtctgtaaaatgcaggagacaatcaggttcacagtggcttgtagaaacttttgaggctgtgtgcatttcagggtctggctcagattttagaaagacagtgagatgcacctagcggaggtcacatacaccccatggggtctgggaagcacctccaccacacacactgatacttctgccacgagccttattggtatgcccaccgggagggataaatggatgctgaataccctcgggttgggtccagtcagtttacgcggctgagtgagcttgtgtcaaacctacctaaatgcttccctgtctcagagaagtttggatttcggggtcctgggctggggcctcagcagaggcacgtgagatctggtctgcagcccccgccagggccccgcctaccctgttgggaccgcccattggcgggtgccatccactcccctttgctcggttcccagcgccctcccccgcttgccaaccgggagagttggcaccagccttccggaacgtaacctaccccgccaacaacagcttccctcctcccattcccgcgcactcctccagggcggcaggcagtcggcagaggcagcaggcctctataaatagtggccctgactcctccaccgcctcgctggggttgtacccccactgcccagatggacagacccaggtcgggaaggagacaggctgggacttgcccagggctcccctgggaggtaggggtcagccctggtgagtaggggaggaacccactgcaggagggtctccgcacagggaaatgtgaggctcacagccatgggagccagtccgaggccctgggctcacctgaatggttcaaatcctggctccacctctcagtagctgggtggttcctcagagcttagtttccttgcttatgacagtggaggtaacatcagcggtccatcccactgccgccatcccccaggaccactgcatccctttcacttactaagagatggtctcctggcccctaggaggagagggcagggtgagcaggtccagctcttaggagccagaatgagatgaagctgctgcaggaaggactaaggttagaaacgggaaagaacttcctgttcgtaagagcagtgtgtgccaccccggaaggctctgtgggaaagtttatacaggcagaaaaggggcccaagtgcctgcaatggggccatggcagcctggagccctgcccttcccacccatttttaaaatgagtaggcatttgcatttattgagcttctactatatacctccccacatgctcagcaacagaaaggaggaagaaaccagcgaaacgttggccgtgtctcagaggagtcaaacatttggctggagacaaacttggcccaggaaaatcccagcaattgatccaggcccagactgccctcagaattcagggctaagacaaaccagtcagggcaggcttcctggaagaggtggccttgtggctagaggctggtttggatccgtgggaaaggccttctaggtggagagaacagtggggcagagttgtgcaggtgggaaggctctcaggcttctgcagagacagtgaggagagaccttggggtcacattctcggtcctgagcttgtgaccagtgcttgggagggcttgtcccagaaaccctgaacccaagcaacttcctaaaagttgttctcagagccagagagttcagagcctgggtctccacgtcctgctccttagaggtcaccagtttccctgcccaccggtgccagatgtccagccagtagcttttagcctgtgctggcctaggccattttggccactcacagtgaccaaagctcattgctatgagggaaggtggaggggttgggcagagaacagcagctgccactgcagcgtccccacacggacactacccctggacatccatgctccctgctcctgggccaacgaggaagccaaggtcaggagaacccgggtacccggggccgctcctctgaggcctgccgagcagacagacacagacagacacagctattcctgtcccaaggggccatcgggggctgggaagtgctgaaatagaaagcaggtcccgagccctgctggggacgtggcctgttcttgacctgggtggactgggccaactctagagggagttgcagctcagcccagcctggccagtttgtggtggctggcctgggccaccccgggcaggcgcctgggcccaggagggatcttagacctcacactctctcccctggggttcccgggctgtggggtccttgtcacagttccccaggtgatgggttcctggagcttccagagagaaagctctggcaatttgggggctttgtaagggctgagagactccaggcctggtcccagctccaccctcctagctgcatgaccttgggcaagtgactttgcctctctgagcctccctttcctcttctgaagatgggaacaggatgccccattataagattatttgggggaattaatagacctgaagtgcttcccctgtgcctggcccgccagaagctctcagtgagcggcagctgttatagacttgtctcggtgagcgctgcatgttgagtgactgacctgctagaccaggggtttcaacccttggatcacatcccaggagggctccacgcagcagtgcctcatactctgccctgttttgtgttccagtgcctgggataagaggtgccaagcagggcccgcatggccaccacccccggccaccaagcctgctggacctgtgcttgctctggcacctgtgctgatcccactagagcccctccctggctgggccaagtgtcagaggaggctgtggagagagggagcagggccaggcccctgagagggtcccggggcttcccctctccctctccctggggagtctattgccacagcagccccaacgtgggtcagaccccaaaggctcggccgcctcctcaaaccccaagtggaaggtcccggggtggtgggagcccagtggcctggcctctgagctcccaggttcctgcctgactcttcaggggcccagctgtgtgagcccgagggagggaagggacttagtccccttgctctctgtgaggaccctcaccaggaggtgggcgggatgagaagtgctggtccaggcacaggccaggtggaacgggacacacgggaagccccccacggtggcaatcctcttcctgctgtctctgccctgggggaacccaccactcacccagcacctcctgggctggccctgggtgggcctggagacccagatggtgggaactgcacccctgcccagctgccagctgtaacctggctggccacaagaaggccagggcgtgaaggggcacccctgcccaggtggcaggaaggctggcatggagctgagctgcctcggagcttcgatagctgaagcccctctccggccttcatctccacatgtataaaaggtggggccaacttggcgggttccaaggtcctctggtcccagtgttccccctgaggccctgctgccccattctgtaagctaagactcagctagccccacacgcattccacactccacactcagacctcaccccaggctcctggacccatggcaaggccaggcagagccagtgtgaatcctgggagagcctgcaaggctggtcaccagacctcctccaccagcaatccctcccggattgggtcttaggagcctggggctttccctctgctttctcaccaataagccccgcgctgctgtcccccgccattccctgcggggaccctccctgggctccatggggctcaaggctgcagcttcttccgtgtgggccccttcagcagtaccagcccacactgagtctcaccaccttgtgccagctgtggccagggccacagccctgccagaccccatgatgaggcagtgttctgtgggtgccccttcccacagtccatgagactgggtttaacagaagggtactggggggctgcaagccaggcatggttccagccagggtctgcatgccccatttgctgtgtgactttggacaggccttcctccctttctgggcctcagtttccctgtgtgtaagagcagatgttgagacaagatgccctggggggaaccctcagtgttgagcaggcataagggggtgccttggggcaccgagggggccagcccagagggtagcagtcccagcagccaccctaggatgactccctagagccccagagccgcgcgctaactgtgcaccaggcacagcaccaggtaccctggacgtccccagttgtggctgagttccaggcattcagccaagactggcctggatgatcccggactctgggtacttccccacccacctctcaaaggctctgccctgcagggtctcatagcctgccctggttcttctagcctccacccctggagccccgacatgctctgctaccgtggggtccgcgtcttcccctcagataggaggaggccgcagactgggcccaggctgcccctcactgctgtgggccttggggctggtcctgtccctgtacccccagcccagtttccttggttcccactgtggggctgagcctccctgtggagctgtgatgtggccggcaggacccagcgcttcctgagaggagggacgccccttcccagccgtgagcacaggccacagggccaaggctgaggatcagagcagacaagggaggcgccaggctgggcttgaacccagggctgcacaaggggcccccacattccctggacatgcaggctcacctctccctggggcagagaaaggctcctgcccaccccagctcaatggcaggtgcctgcccgctacccagcaagtccagagtgcaggagagggcctgtgggcactggaccccccaggaaggagcctgcaggtctcccgatcacccctcatctggaagctctgcactccccctctgcccctcctccatagctctggcctctcgagtaggtgggagtcctgcagagctggctggcatcaccccaccttcgcaggcccccttgggaggacctcacccctggacacatggcagaaaacggctgccagcctcccggggctgtttacatcctcgagtggcaccaagacgagggtctctcaggaggacagacgaggtctgcggtgtcaggcaccagcaggggtggcagaacccgcctgtcaccaccatctgctgttccccattatcctgagccctctccaccccggggactgctcagtggcccgttgttggcttcatccctcaggatggggaccctacagtgccagcactgcccatgatgggcggggcttgtcagtcttgattgcagcgttatgggattcccaactgcagctgccacagcgagagggccttggcgtcacaggccaagggtggaggacaggagccatgggtccacctggctcccatggaggttcacaaggggccacttctgcctcctgcccagggtggcctggtagccctgctggcggctcatgtggagatatcattgtggcgcttccctgcaccctgtcccttggggaaggaggaatggtaggctgctgatgcctcaccgctggcagggcctccaaggatgcttccatgggcttgagagggctctccaccaggcccagttccctacagtgtctgcccaaggggcccctcccaccctgcaaagtgtgccagagcccaggatgagcagtcctgccctgcgaagggccagtcagacacacctgaaggggtcctgaccctgggcacagccactctctgacctctgacccctgaccccagtcacagacagcctggcctgacctgccagcctgataaagatgacaaggaggaaattgtccctgtgccctgtctcctctgagggttgtggagtgttggccctgagctcgggacccccatccctggtgtccccccaagaggatccctgggtcctgctgagaagagtctccctgggggaggagtcagggaggctggcgtgggctgtgacccctccccaggcagttccccgctgtttgctgggggaccgtctctgagatttctctgagaacaagcctgagagtgcaaggctggagccccaggccctcagaggtgggcatgaggcctggcactggtgcggtgactcagccaccctcgcctgctcaggaaatctgagcctcctctggctccagccctgcccaatctgggctgcctccaggccacccccacacaaaaatgacattgcatccacccccaccttccacaagcccggtgaaaccctgcctgccaggagccagtcctggtccagagaggtgcaagaggctggtggccagagactcctgtgcctctctgggcctcagtttccccagctaaaacagacacaacgatgttctaaaggagataattgcagcctgtgggctcagccctgcagccgcagggaggctgctccagagtgaagaaaccatcctctcccagaactttcaatggctccctgttgcagcactctggtacccatagaggctgctgagactcagtgtagaagtcccctgcccactcccagctttgctccccaggaaatattctgatggcctcctgtccctctgcccatctgggctgcctgcctcctgttatacctccctctgccccttccaggaagccttcccagacggcatccctccccagcaggctgggtcaggaccctagggcccacctactctctcctgttggtctgcattacaaccagcctgagctcgggaaggcccagcccctcccttggggagccttccctgagtctccggtgtgcagtacaacccactcagcagggcctcggcactcaggcggctggaaggttaaagtgtgagtatcagcagaagcacacgggatgggaacaagaggagatggtgctctcggcagaggagacactaactaaatggccccaaccgctccccgacaacccccgctgccaccccaggctggccacaaggcctcctggctctgaagctgtctggggagagtggccctccagcagccctctgggatcaagcctgttgatgagctcacgcttcctccagcactgaggtccgggtcccacacgctctccccacctgctggcctgggtcacgtccaggtctttcccacacacctgaccccacatgccacatgccaccggtgcatgggtgcaaacagaggcccagatgccaggtgtgcaggctgtcggtcatgggtacacacagacacagccaaacccaggacacatgcaaaacagagagccatgcaggaacccaggcttgcgtgggctgaagctaccatgcacatgccccctcccgggaaggaaattgggctttcgtgtgctcccacctcctgtcccgcacacagcacgcacaagtgccagccaccatctcctggatggtgcagctgagactcagcccctccgtgcctcagtttccccctcctgccccccacacagcacacacaagtgccagccaccgtctcctggatggtgcagctgagactcagcccctctgtgcctcagttttcccctcctgccccgcacacagcacgcacaagtgccagccaccatctcctggatggtgcagctgagactcagcccctccgtgcctcagtttccccctcctgccccgcacacagcacacacaagtgccagccactgtctcctggatggtgcagctgaggcttagcccctccgtgcctcagtttcccacctcctgccctgcacacggcacacacaagtgccagccaccacctcctggatggtgcagctgaggctcagctcctcggtgcctcagtttccccctctgtctccagtgggtgtggggactctggtgccccaggcccctctgtgcctcggtttcttcttctgtctccagtgggtgtggggactctggtgccccaggcaccgtccctcaggctctgagccttgactcctcctgggggcggggaaggagcctgccccgcccccaccctgcctttgcccaaaaggagccccaagcgctggcctgacgtcaggccgtaggaaggcgaggtccgggctgcatgcagagctgagagctgaggactcccatctccagcctgcccgggtgaagcgcggtaagttcccctgtgggctggccccagcctccctctccccagcttccctagataggaggctcctgagctgctccctgcaggggttctcacccccagccaagcaggagtgggaagggcagggcagagaaactgcctccagatccgggctggggagagctcagagcaggtcctgctggacagggagccatttctcagatgagaaaacagagacctgagggagaacatgggcgtgagttgggctggctgcataagggggagctgcgctgctaggtgcccacccaactctggatttcattcattcactcattcatccctccgttcaacactcaccgagcatctgctgggtgcccagagctgggtcttggtttccccacctggcaaggcagcagggtggcccacaggccaagccagggacagagttgggggaccccagaggcacttggcaggctctggggcctcagccaccaccaccccgcagctggggcagggccatggtgagggctttgtgggcatgggctccaagcgccatgctccctcttcagagtgcccgtcctgccatcccacagctcaggccctctgcagtagccttggtgctgtctctaccccttaggggtggggaaactgagtcccagggaaggcttgcttgccagccctcagtgtggacctagaagctggctccagccccgcgaagctcgcactgggactgcgctgtgagaaggcggcaggacagggtcccgagggggcagcgggctgggaactggccagcagccagggtgctggcggggcagacgtggagcagctggcgacctcgcaggacggggaatgcaccccgcaggaggctgggcctgtccacttgccctgtcttcttccttcaacagctggtcatcctgggtcttccctcccctctccccccaggactcatccagtcgctgggctccagggcggtctgctgagtggccgtggcaagtcgctgcccctctctgagccacacggtgtgggcccatcagcaaaggcggggtctgcggctggagagccgggcgtgggggccatgcagtttggaccatttctgagcagctcctggagcccacggggtggcttcattgtcttcttgttaagtggtattagcatctcctctttatagatgaggaaactgaggctcaaggagatcagaggggtattctaaaatcatccactccatcactcagcagtgactcagtgactcagaggggccagccaaggccagggcccctgaggcactccagttcagtgagggaagcacagcgaacaggaaagcagggacatagggaactgcgcgtggcagggcactgcgaaggaagccaggcggtgcaggcgtgcggggctgtgggctctggagggcctccctgaggaggggcgtcagggcccaaagaaccttaagttgatcccctcaccatacgtcccaaagccctccccacgcccccggtgtctcacagagccctgaacacagactctccttcccacctctggcccttcatgctcactgtgcccttcctgctgccgggagcgctcttccctctgattgtcctgaggcccatcccggccgtgaccagccacctcccaccctaccctgagctgtcagctcggaaaggtggggccaggtctgcctgggacccatttgtgcccgcagtgctggggtctaagtcctggtctgacacctccaaactgcacggggctgtgtggcctggggcctctgattccctccacacacagggctgggtgccgcagaaggctgatcccaggcactgggacaaagtgccagcaggcagattgaggcagagctcagcccctcctgcaccccagctgggtgagcccggacacatgacttagcccctctgtattggttccccacaggcacagtggggccagaaacacccacccaggggcatcttgagggaagtcaataagaccctgggaaggatgagcccagcgggtgcccttcagattgtgggatcatagctctccccctggggcaggggcatccagggcactagggcatcagaggggctcagggagagctctgtggaacaatgactgtgggtgcccggagccttcaccaggtggcacagggagagaaacagcattccgggcagaaggaacagcacatgcagagggaagaggctgagaggaccaggctgaggagcttcaggcggaaggaccaggctgaggccaggcaggtgcacatgacagaatgcctgtcccagcagctcctggagaggctgaggttggggaggggtttcaggagctgctgcagctacggctatcccagctagaggtgagcaatgaactcggtgatggggaggaaaggaggggctggtgggtgacacgcaggacctccaactggccatgcccctcccagagacacccagctagaggtgagcaatgaacccaatgatggggaggcagggaggggctggcaggtgacatgcaggacctccaactggctatgcccctcccagagacactggtgtttccgttagagccgcagtctcagcaagagggctcttagctggtggaactgaggcagagtcgggtcagatggggcccaggtgtccttccccacagagctcagtctgtgcccaccagtgacgtctctctctgcactggggtggagggagccctggcctgtgggcgtgggggacagggagaaagacttggcttctggccagggtcacctgggacttgctaggtgacctggggtgagtctgaccccatttggagagctcagcaagcacccacctgcctcttggtggaagaaacggaggctcagacttatcaaaaacagcagatgatattcaaaagcagatgctgtgaaaccaagaataatcataaaaataaacaggcagacagttccccgaatcatggctattttagccctggaaggccatgagggccacgccgtctggggtgcaggctcaagcacacacagacccgtggtcacacatgcggcctcagggcccggagaatccccttgtgcacaaactcccggtccagagatgcctaatccagcccctctgctccccagcccgcactctgctccactccggcctgtgccgggtcctgccagtggacctgggtctgattcccagccccaccagctccatgctgggtaaccgtgaggacaccactcacccctctgggcctccggttcctcatctgtaaaacctgggattgctgtgtggatgcaaagcgcccttagcaggtgctcagagcccctctgtggggaaaaggctgggcccgtcctccacacgtccacagacagcacacagggtcctgagccagacccccaggcaggctcaacagccaccctgggccatctgctgccctggggccggggccactctgctgcctggtctcacatgtggcaggacagaggcagacaggctgctgggcagccaagagagaactcccaggttggtggggtgggtttgagaggagcccagggaagagaggacatagccctccccacccaccggccaaggacggaggccggcatgaccctggtgccccgctggaggcctctgggcaggtgccagcaccccaagcccaggggtctggccttccatggccgggtgcccagcagaaattcaacaagctgtgggtgagggcagggaggcagcagcccccatcagtgctctgggcatggactagtggtgtggccattgggatggatggagcaggaacccccagggaggggacagggtcaaatagcttccatgctcgatgctcgctcccaccccttggaagttcccaggaccgtgagtttcacaaaggctctgagaagtcctgcactgagcacacgtgttggccctggcctctccccacgtgtgagcgggctggtccacacagggccccatccaggtgccaaaaccaggagcctcccgtgctcttatatcgcacgcctcccatgttgggggtgtctgcagtatttctcacttagtccagccaccctgcctgatttcattcattcattcaacaaatatggttcccaaagtcccaggtgagggaactgaggctcccagtgatgaaatgatttgcccgaggcctcgaaggtggcgggtggtagagctggcctgcaaaccaaagaccattgctatcaagagtggtgatggggccgggcgcagtagctcacgcctgtaatcccagtagtttgggaggccaaggtgggcaaaccacttgaggccaggagtttgagactaccttggccaacatggtgaaaccccatctgtaccaaaaatacaaaaattacccaggtgtggcacgggcacctgtaatcccagctactccagaggctgaggcatgagactcacttgaacccaggaagtggaggttgcagtgagccgacatttcgccacagcactccgtctcaaaaaaaaaaaagaaagaaagaaagagtggtgatgggagatagagggtgggaaggaatgtaagtgtggacacaatggtcagagtgattaggacgggcttccgggaggaggtgtcagccttgctcggctgggaggactcatgggtagtgacgatggggctgggggtggaagccaattccagaccagtaccaagacactgggtaggcaggtttcagagggggccaggccaggtggcattcaccctgaatgccaggttgagaaaccaggccacaccttgccagccctgatgaggcttgctcagggcgttcattcagacaagggggaagacgggtgctgctctctgccaggccaatctgggtgctgggctggtggaacagatgggagctcagcccccacccacagccccgcctcaagatgctcagagtccaacagggaagcctgcagcacatagcagcgccgtgggatgaaccctgggattgaggaagcgcagggtgccctgggaggatgcaccagagagaggcagcccagggaggaagaaggcttccttaaggaggcaagtccagggggaagtcctaaaaatgggcatgaataagccgaaagggagagagcaggaacagcttggggttgggcctggagggcgcatggagtgtttaggccccgctagtagtttcgcctgcagaagcatcagtcaggtgcagtgactggagaggcacatccccagccctgcccagcagtccaggcctcaggcccctcccagggagaacccccaacccagcggcagccccgcctaggacggctgttttgtgatgtgatacctacggggagggcatgagggacatcctccttcaccctctgccccctcccctggaggagctcagcgaagccttgaaaggccggggctctgggaggtgtgcccacctggaggggtgggggctctgggggtctgcccacccggaagggtgggccagaaacagaaaagaaagagatgccgcagcacacctgcccctgccccgccacacctgcagcaggtgctctgttcagccaaggcccaagacagccatgcagggcagcgtgtccggccattcccacttcacaggaggagacactgaggctcagagaggacccacccaggtcagagccctccctccaggctggcgggggcagtgagtagtgtgggagctggacctggtctaggctgcacacccaggttggagcagagctcgccccctcgccctctgggtcccccgctggcagcttgtcccatactttcatcacttcctgtgtctgagcccctactctgggctggcacatcaggacaagaacccccaggggagattctattttgcccactctacagatgaggaaactgaggctcagagactgtaaggccacatagtccgttcagagatggagccaggctttggcagggccatccaggccagagccagggctccatggccacactccaggtccctaccctgctgggtctccactcactgactctcagccctggagagcaggccctcgttccctctgttctgtccccaaggaagtacctgtgtgtgggtggggagcagagctggcctgggccagtggaaaagagaaacctcccagccctggcacagcctccaggccctgagccccaacaccatgtcagcacgatcaggacacggtgccagtccctgcccatgagactctggccagttggcccccgccatggagtctgctgtctcagacagacccagggtgcctgccaggaaagagggaggagacaggaccatctcccccacacccaggtttggcttagggaaactaggcttggggacagggccctgcctcccctctccggccggctctgagggtaaaaccatgcctctcccctcagtccaggctaccagggcgaggcagagctgtggaaggcacgagtgaccccattcagcagatgaggacggccagcctactgaccaggcccaggtctcagctgagggagtggcagggctggactcaaacccgggtctctgtgctggtgactgctcatcacccgggccctccggagagcagagtctgtgcctctcccacaggcagagccaggctgtcccaggaggggcggaaccttctcctttccccaggcactcgccagggagccacttccatgggcccctgcagggtctagagtccccgcttgcattcctcctccttctgaacaaagagggtggtgagtgggagccccagagaggccccgtaataatcgaatcgggacatccgtcgctgtgggaggcaggtgggggttgacaatatggagacagagacagccagacgaagctgggagaggagggcagagacagggacagaaggtccgggctgagggcccaggtcgtggctgggatcagggctcagagcgccacaggaatcaacgcccattgtgctattaggattggggtcagtgtgtgaccagggtcagggctcagagtgggacagggatcgaggttcatcacattactgggatcatggctcagtgtgtgaccaagatgagggttcagctttgtttgagatcagggtcagacccttagtgcggggaatcagagcatgctttgctagctccctctcctctccggtctggcctctggggtgtccagcacattctgcccatccccccagctccagagaccgcagagcccccacatccctagccaggaccccagcaccgcagcgttgctggtgagcctgctgggctggccctggggagttttctgggacagcagaattcccaggggccagcatcaccctgggactcactcccacaggaaacgttctgtgttgtttatgatttgtctctgattgggacactaatataggccccgtgcagacaaattggaaaagcaaaaggcacatagaaaggaatcccaaaatacttttttggccatgcagtccctcagtccagctgcaaagccgcctcgaccttttctgagagcgtttcatccacagcaggggagggacgcatctctttcggggggaccttctggggctcctgaagcccacagccctgagacgccaggttcccagcccccatgtgcccagcctcctctcctcccctggctgcctgctgtgcccccaaatcccgtctctggtggcacacctgggctgagggaggacagacctattcatccaacaaatgcacccatcaatgcccgcgtgtcagggcctggagatagagagcttgcttgcagtcggggggagctgggagctgagcctgggcccttgtgtggtgggggtggcaggaggggctgggcacaggcctgggcagcacttgactcctcccagcagcctccagggtagcacgcacccagggctggggtcccagaggcagagggcatgctgggtgacctcatgcaggcactgacctctctgactctgaggaagaaggtggccgccgactggagggacctggccctctgaaagcaagagttcttttgctgccctgagccaggccaggggctgtttgaaggcagggctcattgttccccaggggtgggatggggccacgcactggtcagagggagtggcggggcacagcctgtttacagcaggggccaccaggaggggaaggggtaagtgtcctcccttctccagcaggtgggggaggggcgctgtgcagaagaaacggcccacgagcctccccaccctgctggccccaaagacttctcctttctcctgaaaaagccagaaatgcccttatttggagggtcagcccagctgtagggtgggggtagggccgttaacccttcatttataaatagagggataaatcactgccgagttaaacacgccagggcaggaacataaacagagtgggtggctccggcacagcccctcgcccgccccccaccctggcccccctgcccaggccagacgggagctcggtgtttatttgactcacactctggctccaggcttcagccccaaccagccaccccacaggggcctctgtctccttttctgtagtttggggggatcataggggtgcccgcctctcagggccagtaggagcctggggtgcccagtgagactggtccttggctcccatgcagccccactggacagcctaattccctttgtaaaggtccctcatgaggacccccatccagggcattgacctgatgctggcctaggaggaggggagaacagatgggtggtcccggaggatgggggccatgacggtgggtgtggggacaggggagtgggcagggcagtcagaggtccccaccatgaacaaggctctgtcccagcagaactgggtcatcagccaccaactctgctggcgctgccgtgctgacccgcttgcttagtcaccccagcagcaacgcgatcccagtgacatggattaggaagcaggtagagaggttaagtggcctacccgagcaagcacactagtcagtggcacagctggggctggagccaggccctggaactgcacactggagccccgtggtcttgcccttatcagctctccatcccgaggacagccctgcaccgcacgtgtttccgcctccccctcgtgccaggacggtcgcagaaacctccgtattttgtcgagtctccacgctggcaagtgccagtcctggaatttgaacacgcgtctgactctgaaagcctgtgccttttctgctgctgtccgaggctccctctgggtagagccaagggagcaggcatttgaggccccagccaggcgagggcatggagaagggggatgctgggcgtgcaggggcagacgggccagctgagttctgggcctcagggcagggcttaaggccaggctggcgcctggggtgacctggtctccttgcttccaggcctggggtgtgctggctgccgtcatgccctctgtgtctccagcggggccctcggccggggcagtccccaatgccaccgcagtgacaacagtgcggaccaatgccagcgggctggaggtgcccctgttccacctgtttgcccggctggacgaggagctgcatggcaccttcccaggcctgtggctggcgctgatggcggtgcacggagccatcttcctggcagggctggtgctcaacgggctggcgctgtacgtcttctgctgccgcacccgggccaagacaccctcagtcatctacaccatcaacctggtggtgaccgatctactggtagggctgtccctgcccacgcgcttcgctgtgtactacggcgccaggggctgcctgcgctgtgccttcccgcacgtcctcggttacttcctcaacatgcactgctccatcctcttcctcacctgcatctgcgtggaccgctacctggccatcgtgcggcccgaaggctcccgccgctgccgccagcctgcctgtgccagggccgtgtgcgccttcgtgtggctggccgccggtgccgtcaccctgtcggtgctgggcgtgacaggcagccggccctgctgccgtgtctttgcgctgactgtcctggagttcctgctgcccctgctggtcatcagcgtgtttaccggccgcatcatgtgtgcactgtcgcggccgggtctgctccaccagggtcgccagcgccgcgtgcgggccatgcagctcctgctcacggtgctcatcatctttctcgtctgcttcacgcccttccacgcccgccaagtggccgtggcgctgtggcccgacatgccacaccacacgagcctcgtggtctaccacgtggccgtgaccctcagcagcctcaacagctgcatggaccccatcgtctactgcttcgtcaccagtggcttccaggccaccgtccgaggcctcttcggccagcacggagagcgtgagcccagcagcggtgacgtggtcagcatgcacaggagctccaagggctcaggccgtcatcacatcctcagtgccggccctcacgccctcacccaggccctggctaatgggcccgaggcttagtcagcagggctctgccaggggccgaaggtcaggactcatctgggcatgccagcgtggacacccaccatgccaggggtggcaatcggttccatctcgattgattggtgatggctacccagagcaccgcattgagcgtctaaggccactgtgctgtggttgattagcaatgtctgccactggctccgatgggatgtggtggcctgaatgccggtgatttgctgttcctggggtatagcacgtccactgaaaactcacaggggtagccgggagctgctcctcactttggccagtttgtctccagaaggagttcctcagaaaaaagggcacagtggattccattgattagaaggatgagatgaaaaagaaaaaagaaaaaaggacaaagattatttaggtgctgggaattcccaagagagttaagaaacaacctgaattcccgagagagctaacaacaacaatgctccctccaacacacacacaggaggaaggacaaggacagaaagaaaaggccagggagcattcgtgttgcattaatggaggtgggggggggtgcatgtctctgcaagacccccccacctgaggcctccgtgaattgcacgataaaacggcagacacccacaggccgctctgctgtgagcaagcactgtgatatctaggttgacacttgaacccacaacaacccacaaaggagacgctacttttcatccatttcttggtgctggaggggtcaagtgacacacacaggggccacagctgggaaatggcagggtcagaatgaaaaccagccccacctcctccagtgcccttgcacctccttccacagagagtgcacgatcatcccaaagcccccactctaggaatggcctcagaatggctcacctgctgccccaggtagaggcagtgttcacagccccatcctatggataagaaaaccaagaacaaagtcacgcagcagtgaacccaggcatgccgggttgtggccaccatctccccatgcaaacagccattttcctccccccgggggcagagaggacgtgaccagctgctctggcccagctcactatgagtccccatgccttcactagggagggagcttttctctggctggggcctctgatcatctcctcagagctggactccaggatttcctcccacgtgccttctgccgagcgtccaagctcccagccctttcaggactggtaatggggaagggagcctgtggtgaggaagaggagtgtggggcatccctggcacttccggctctgaggccctgccatcagacctggccatagccactgaagcaggcgagatgggctcaggtcctcaggccaggcctttggctacagagaagtcctacacactcagggtgaccgtggcctgtgtggctgggagcaggagggggaggaggaggaaaaggccggggctccccgattcagctcgaggcagagtctcctgaccccagtttagggtcctggactttatatccccatgttacaaatgaagaaactgaggctcagagggagaaaggggcttgccaaggtcatagagtgagtgcctgagtcatccaaggccagtattgtcctcaccaaccccagctgtggccatgtggagcagctggggtggggggcaccggcccagaggagtcagaggcgtgccccgcaaggtggtggaactgggagtgctgccagggttacttcctccctgggtccggatgcccgagaagcagtgggtatcaccatggccgccagcattcttgatacttaccaggcaccaggcacaattctggaaccttcccccagcccccagctctcgggtgctgctcagagaggggccgtggcttaccagggatgcagggttccacaaggcagaggggcccagcgttcaggaaaggacgtggctgggggacagggctgtgcatgcagaaaaaccccgctgaccacaggtgcagcattcacggcgactttcaggcaagcaggcaccaacagccagcgagccatcattcccagggctgcgagctggcacccacgtggtcacatgcctagagctgaggagtgaggggtcagggctcaggtgtcctgcccagcccaagccatgagcttcttccaggctcatgtggcccagcagtccctgaatggccttgcttacctgggacccctccacccacgctcacaagtcatccagggccagggactctggactccattcctccaggagctgtggatcctcttgctccatcttagggggcgccccaagccccagagactacctgccggctcccactcccgcccctcaagcaagctctgcacgtggcctagagtatgacacccctctgcccttggtcccgcactgtactgtgaagacctctccagcccagggctgcaaggaggcaggggccagcgggaaggagtgctaagatgagggggaatggcctgggcaaaggtaaggccaagcgcccgcctcgctggggccagtgaagggccttccatgcagcttcccagcccctcccctcccctaccagtcttcccggccccttccccgccagtcttccctgcccctcctccaccggtgttacgtgcccctcgggcctttggcctccccatcaatgacccccagcctggctccattcctggttgtcactctaattcacgctaaagagtgaatggctgacacttgaggattgctgtgcttgaagaggcagggcttgcaatttttctggaacaatccctttcttcaggaggaggggtctctaaggcaggtgagccaggtcccctccttgtccccacatctgaaatccaatcattcaacttgggttcctcgggcctcagaggcttctcagactgtaagaggccgggaggggaaggacatcctgtccgaagcggcaagtgcgtccactaccactcatgctggagaggacaggccgcctgtcttctgtggccagggacacaggcttggggcccaccctcagacctctgagaactgcctgccagcccccgatgcagaacccttgataggcaagcctcagtttctccacaccccactcctctttctcctctcctcagccttacagctggagggcagggggctggggaagggggtcaccccaatgccctggactgggccccacagctcccccggctgcttgcttccttctcctgacggccggctccttcccacttcagcctcctctgtgggcaccgaggcccaggagcttcaaaagtcagaccaagactgtccttggtcccacaggggcagaggtgagatctgtgcgtgccccctctccacactcacggggacagggcgtgagatctttgcgccccctccccatgatctccctttccagattttcaaaacgcccaagtgacgtgaaatggtgtgtgtatttatatccgacgtaaacaatctccttcacgagatgtcctcgtctggaattaaagctgtttattctattcttgcccacgactctggtcctgggctggtgggggacatggagctggcggagggtatggagcagggtggcagccctacgcacgccccaactctgtgtcctgcggaccagcagggctccacagggaggcagcggcagtggttttgtggttttgtcatccctgctgggaggcagatttaggggccttgagccctgcccagctctgatgggcaggggatggagggggcacaagtggctgacttgccagcagggtgtgggcacagcagctgggtggggggcatggaccagcagaacaaggcgctccatccctgatcccgaacctgcctacccagggcaaggacgtggaggtgggcgaggcagccagaccacccacagccactgagtcctatcatatcagcagagatatggcctagagggagagggaggggataggacagctggtccaacacaccagggagagggagcactggcctccctgtgggcctactaagtgccactgagtggccccttcactgaacctgggagggtgagatgaccacctccattcctagaggagaaacttaggctttgggggtggtcagggagggggctcaaaccagggcccccaggtgcccagttctcggtctctggtctggcccagcagagctctgggtggggaggcgctgtctgggggctcatcactcccacagtctggcacccgcggcagccggaggcgtctggatgtaaatattagggcctgtttagattaaagctccattaatagcaggaaatgtcgcctgggtgcctgccccagcttcctggaggcctgaaggcatggagcggggtgggggtgcactatctgcgctggagacccccaccgtgtgccctattggagctggacaccccctatctccacacccgcacaccctgcttgccacctggcttagcagttctgactccagcctccctgcctcttcacacacagcccctcctctctccttcagggcctctgcagcccagcgctctgtgctccccacccctcacgggatgagaggggacccacgtggccacatccgcccaccctccagagctgggcccccacccgaaggggtctgtgcacccaattcacagcggagaaaactgaggcttagagacatcatgggaccaacccagcgttcccaggcgccacctcaaaaaggagctggaattcccctcccagccctgcctgactccagggtcaaggccaccccctacatcctgaccccccaccagaaagctgtgggccagggagagggggcagtcaagctcagcgtctgcagaacgtctctggctgtggaggggcgggcccaggtgcaggagggagtggaggggtgagtaggaaaggtgggaggagatagaggggccgaggggaggggctgcggctggagggccaggacaggcctggggaagtggctccgcccatgagaccacactctcctgctcccagtcctgtcccctgccattccctccccctggatggtccctcaccccatctcctcggaccacctgctccatgactcctggcccccgccccactggcccagcagcctgtgcccagccccagccagggccttccgcttgtcaagtcccaccccctcctctgcccctactcttcctggggctgcctcttgaaactgattcctccccacccccaccccaggacaggccacaaggcccagcctcaccctccagactggaccctgccccacctttcctcgggcctcactgagccctcaaggactcagcacggatgaccccttcaccatccctcggctagttctgggcctccaggtgtgtctacctaactctcccctgcagcacctctccagaactcagctggagctgaggccaggccccctgcagagccctggggagtcctgtgctctcgtggctcagctgcaggggtgctcagatcctacccccacgtggccagccccagggagaacagtcacgtgttgggcacaggacggggtcacccaggagggctccaatgaggaagaggtgctcgacgtcattccctcctggtcctctctttgcccacctgggccaggagggacttcttccagatgactcccagctgggcctctcctggagggtgtggtgctgggagcgccaagtgccgcgcagacctggacaggctggcagggccaggggtgtcgcacccccgttttacagatgagctcacctgctgcaaccacacaccctcctgcctagtccagctcggcccctgattcgctgattccaggtcacctctgagcctgggctttgcccctgtaggtgggagcctaacaccaaaccgcaggtgcccctcacacccgcccaagggaggcagcggaggcctggctgctcaggggtcccccgagacctcagccatgtccctgcccctctctgggcctcagtttccccatctgtaatccagagcttagaacaaatggttccctagccctggtgtgcgaggcacccacccagtgcctctgggccctgcccacctcctctgctgccccggccctcagcacagcctctgcctatcacgcctgcatggggacgccctcacaagttgacgccaagggctgacgtgggaaaagctcttgtgtttataagccagccccaggctctgagtctgtccttctcctacagccccccagcttcccagggcaccagcgtgggagtcctggacagagaggggaactcgcccggcaccacaacccagggaggcctcgggacactctgctgagatggagtgggggtggggcatgaacctggggggaggagtgggccaggtgggctgtcacttgtcctgcactggaacatcagggacccgggtgcctccctggcgtgtcacagcatcgaggggcccctgggtgtccagcgtgctgtctgaccacccggtgagagctgcccttcggactaccacttgaccccaagggccagtcgggaaatgccacatcatctatgtgctcactatttcaatgacattatagcatcactgggttttgggaatcctcggtgttttacataatgggagtccacaggcatcttcagccaccaagagttcctgggggaacaggcactgaccatctgaacctggtgtgcctgggtggggctcccaggggactgggagggctggggccaccactctcctggtacctgccctactgtccatgagaggctcatcccctcccaaatgcattgcacattttacaaactattctgcttggaaactcagcaaatgagctacctgtgggggaagggggcagcacgggggcccaacacccatcagacttcacatcggggccagcctgggggctgaaggacatcggatcccctgtgtactgcaggcatccaggcggtaccagtggcctggggtcagggtcctccactcacccccacgggtgcccctcttagtggcctggtgggggtgcagggttgaggtccaggagtctgaatcccccacctcaaccatcctctccagaacaaagctatggaagggttttggggagctcccagaaccctaactcgggagatcacagagaggctgccacagcccaacccagagcaggccctccagaatacagcccaggtaacaggatggcccagccgccaggcccctgtatcacactagcccctcagcaagttacgtgtctttcctaagcctcagtttcctcctctgtcaaggggagattgcggacaccctctgccttaaggcaaggttgcgagaattaagtgagtgtgtgtggatctgtgtgtaggcacatgttatgcatgcctgcgtgtctgtgtgtctacatgtacgcaggcattcatgtgtacatgcaggaatgtgtgtgtgtgtgtgtgtgtgtgtgtgtgtgtgtgtctcagtctactttctgttgctataaccacatgtgcagaacaccacaaactggctaattcctaatgactaggaattaattggctcaacaaattctggaggctgggaagtccaagatggaggggccccatgtggtgaaggcgagacagatagagagacagacagagacagagagtgtgccaaacttgtcctttcccaaggaacccactcccaggatgatgaaccattccctgcttttaccttttgttgctttgggggaaaaagaaccattcctgagataacgtattaatccattcatgagggtggtgcccgcatgactcaaacacctcccagtggcccctcatcccaacactgtcacactggtgatcgagtttctgacatgtgaacctaggggcacccgtgcaaactgcagcagtgtgcatgtgtgagtgtgtgtgtccatgtacctatgtacagtcatgcgtcactcactgacaagacacattctgagaaatgcatcattagaccatttcctcattaggggaccgtcacagactgtccttacacaaacccagatggaatggcctccagcacccctcggctctacaccgtagcctttgctcctaggctgcaaacctgtaccgcgtgttactgtactgagtcctgtgggcgactgtaacacggtgataagtatgtgtgcaactaaacaaatccacacatagaaaaggtaacgcactgtgccacagtgttacgatggctgggacatcactgggcaacagccatttttcagctatttggaatctgacaggaccactgtcatatacgcagcccatcactgactgaaacgatgttatgtggagcatggttgtatatgtgtctgcgtatctgtgtgtatgtacgtgtatatgtatgcgagtctgtgtgtacattgtgtatgtatgtgcatgtgtatgtatgtgtatatgcatgtgagtctgtgtgtgtgtttgtgagtctgtgtatgtattgtatatgtgatgtgtgtatgtgcgtgtgtgtacgtacgtgtgtgtacgtgagtcgctgtgtgtgtctgtgtatgcacgtgtgtgtatgtttgtgtttgtatgtatacgtacatgtgtgtatgtgtgtatgtgagtctgtatatgtgtgtgtacatgtatttacatttgtgagtgtgtgtatgtacctatgtatatgtatatgtgcatgagtctgtgtgtacatgagtctgtgtgtgtgtgtgagtctgtgtgtgtctgtgtgtgtctgtgtgtgtgtctgtgtgtgtatgtgaatctgtgtgtgtctatgtgtatgtgagtctgtatgtgtgtgtatgagtgtgtgtgtatgtgagtctgtgtgtgtatttgagtctgtgtgtgtctgtgtgtatgtgagtctctgtgtatgtgagtctgtgtatatgtgagtctgtatgtgtgtgtgtctgtgtgtatgtaagtctgtgtgtgtctgtgtatgtgagtgtgtgtgtgtatgtgagtctgtgtgtgtatgtatatgtgtgtgtatgtgagtctgtgtgtgtgtgtgagtctgtgtgtgtctgtgtgtgtgtgtctgtgtgtgtatgtgaatctgtgtgtgtctatgtgtatgtgagtctgtatgtgtgtgtatgagtgtgtgtgtatgtgagtctgtgtgtgtatttgagtctgtgtgtgtctgtgagtatgtgagtctgtgtatttgagtgtgtgtgtgtctgtgtgtatgtgagtctctgtgtatgtgagtctgtgtatatgtgagtctgtatgtgtgtgtgtgtctgtgtgtatgtaagtctgtgtgtgtctgtgtatgtgagtctgtgtgtgtgtgtatgtgagtctgtatgtgtgtgtatgtatgtgtatgtgtgtgtgtatgtgagtctgtgtgtgtatgtgagtctgtatgtgtgtgtatgtgagtatgtgtatgtgtgtgtgtatgtgaaccctgtctcttcttttggtgtgtgtgtgtgtgtgtgtgtgtgtgtcctcccatggtgtttggcactcaatcagtgattgaactgagctaatgaaaggagcagggctgtcctctggacagtccccagcacgttcattcattaattcaatcaacagtttatctacccaccctgtgccaggtataactgagggtctcactcccaacaaaacgtctgcctccccatacacacacttacatccatgcaccatgatcacagtggccgacccctccaatggggctcattcccctggggccaaccctattttctctgggctttccctggaacttgcacacacataggggtgggcagagctaagggggcacattctgggccccagcccagcctgggcgagcccctccagctggccccagcccctccactgatccgctgggaatgccggcaggattgaagtgcctggggcatatgaccaccaggtggcgctgctggcctgggagctgctgcagaggcaccaggaccctccgaccttcctctgccgcctgtctctccaggcgtcgtccccagagctgagcaatcctggaagaatgctcagaggatctgtgacttcctgaccggcctgggagaggttctcagactggacctcgttccagactgcccctccctctaggtctctttccccacctaggggagggcttgtgctcaggggtcacagcctcgagagaatgtctgcactcctccttacctgagtggccttgcaggttcctttgccttcccaacttggggacaagtgagggcgtcttcactgtgtgcctgccccatgccagccttgcagatggagtgcagatggagtcgggtacaagtgccctccaccctccaccctccaccctccacgcacaggcaggctagctcctccctcctctgtatacccggacaggaggggttcttataatgccctcctcccaagcagaaggaggctgaggctcagcgaagtgagccctcactctgcccggggcacacagctcggggcagagcccactcctcaccttcgccttctctccaggtcccgaggtggtgtgctgccttgcagagcgaaactgttttccctgttgtagagatgggtggggagcatgcagggagacagaaaatgccctgtctggagtcaccccagcgaagagcagtggggctggggctgggcagctgtgtaggggtcagggggcagctggggagctgcctctccttctggatgacaggctgcacttgcacttgtcgggggagccaagagcccccacggccatccatggtcctcaggttaaaaacctcattcatcacctgtgagcccagagaggtcagagccccccaccccgagtcacacagcctggcagccgagaccgctgtgtgggcaggagtgagaaaccagcctgagggctcagatgtcctgacaggcagtcctgagcattgccaaccagatcactggcacctgccccaaagccggtggcaagggagagagtgcttgggtgtgtgtcactcggcggtctctggccccttgggtcaggcagaggggacaggccccacctgtagggacagagggagacagtgacagtgtccagtagaccctggcccgacagctgggccacgcccctgcctgtgtatccatctgccccactgtggttcagctgagggtggactggcctggcaggtgggcacaaggcccgggccccagattcctggagaggtcggtgggaactcctgtcagggggccccagggagcgggcagtgtggccactgggccctgacaccctctggggagccaaggcagggccaggccaggggtctttccagcccactcccgctcccgggctccgagtcgcctgccagctgtctcacttccttcctgtccactggcccgcaggccacctgctgccaccttctccagcacttgctctgcctcacccataggcctttgctggactgcgggaggccggaaagatggaaacaactccagaaccccagaaccttgattctttttgtttgtttttagttttgaggcagggtcttgctctgtcgcccaggctggagtgcagtggtgcaatcacagctcactgcagccttgacctcctgggctcaagcgacagccaccctcaccccaatgcccacagtagctgggactacaggcacatggaaccatagtcagatctttttttttttttttttttttttttttacttttagtagaaatggggtctcaacatgttgcccaggctggtctccaattcctgggttcaagggatcctcctgcctcagcctcctaaagtgctataattataggcatgagccactgtgcctggctgattctttaaaccaggatttgaaatcctttcttcatatcttgtccctgcaatagctaatagttctagaaccttctatccattcacttccctcttcccctgtggcatgacccccacaagtctctcacagaggaagcctcaggccacagtgcttaccaacgacccctctaaggggacaagttgggggccagcctgagggaaggggctcccactgtgtctgtgtgggagcccttgggagacgatgctggcccagcagggtgggttctgggcctgtgggggaaggtggagatgccacacctgagagccagcccaggggtccgtggggccacaggtgcaggggaaggtggacaggacgagtggtcagatacactgcccacccctagggcctacctgagcccatgctaggtacgtagtggggctgtgtttgcggggctgggaccaaatcccaggtccagcccttgactgttgtgtgaccttggagcaggtgagttcacctctgtaagcctgtttgctccttagtaaaacagccatactcacgctaaattcttgggtggttgagatgaaattgtgggaaagggacaaggcattcaacttagcaccacacacagcccatctatcattcagcaagcatttattgagcacctactataagccttggcatggaatcaggatgaatgagggacaatccctgccctcaaggagcccgcagctgcaatcccgggcagtgagggcctgtcggaaatgtaagctgggctcaactgcctgctagagaggtggggaaggctttccggaggaagtgacatttagctgggttttgaaggatgcgtaggagtttgcatctggaagggcatctgctgcagcaggaactgtcggggcagaagtggagatgcggctgtgtagtggaagcacagaggcacaggggtcacagggcctggccggctggcagaggaacctcaggaaggtcacctcccctctctgggccgcagtttccctgtctctaaatgaggataagcgcgcccgcctcccaaatgggacagtggctgtggcaagcgcggggtgaatgctaatgttccctatttaattttccatgttctgttttgaggccagtcagggttatttctgtccacactcaactatttccaggcccagagtcctcctttcccacagaggacagcgctgggcctgccccagcccactatctactcccaggccgtggtgggaggccaagggcagggggcacctggagaagaaatgcagactcaggatggatcagaggcagggtggggacccagccaccccaggaagcccagggctccaagggccccgtttggtgtgcccaaggccgagcagcccagttccaagccccttttccaggtgaggtgggacggaggctcccatgtagtcaggggaagagagcagaagcatttaccacaccccccaggactgccccgctgctgcccggcctgcccaggcgaggaatctccccatccccacagccacagcctggtgtgccccacccggcctcctccctgttctctcagcttcccggttcccaccatcacccccattctggcccaaggggctgaccctggggtgtgacatcagggaagacaagaggtggggttagggcgctgcctgacctcctacaaaacaagctgccttcctggtagccctgggcagctggcccagggatggcccatgggggccccgccctccagccaggttacctgctgctggccaagaagctggggtgctctgggctgcctccctgtcccttctgcaaagcccctgatccccacaacctctctcccaccctgagagcctgccgggggttccttcctggccatccctgggctcagcctccttgtcgtggggcacaggattgggtggcaggaaagaacagggggggctggggctggggcacaaggggggcagggaagagacacagagtggaaggtggggagggacaggcacagctggagacgacagtgtgtgggggctccgggcaaacacatctcacctccagcccgttctgagcaatccatcagtgtggctgcccctggaacgtgcgggggcaccaaggcggagttgcagaggctgttactgatatgtgtcgtggggtgagtcggggtgggggacgcatatccccactcagaactctgcatcgtagatcccatgcgtcttgacaccttcgtctgctaacatctagaaaccttagcatttgagaaccttcagatccaagggttctgagagcttagaattgtaggatttgtgaattctagaaacaaaggcaagaagatcacccgtagggtgtctcctctgctcatgcagcctggagggacctctcggtgatccccggccgacccctccccagcactcagcccaagaaccagcctcaaccacctcccttcccagctcagcctcacctgctgcccaacctgcaatacctcctcccatctcccatcctcagacagcccatccctcctgcaaggtccagtccgaagtcgtcacctcccccaggaggcccacccgtcctcctcagcccagcctgactctcaggatcaggctcaccctgcggaggctgaagccaccaagtcatagtcccagtcccaaggggaagacaggcctggagcagggagaggtgtgggcaagaacacagcctccgtcccacaaagaggagttcaaacccccgctccagcccaaatggcccgggcagtgccctcactcgtctgcttcagcagcctcacccgactactcacgatggctgcaggtggaaactgcccacgcatctctcagcagctgaaaggatgactccacagtggacgattactcaggtgtaaaaaggagcaaagcactggcacatgcgataatgcggagggacctgaagccaccgtgctaagtgaaagaagccagacacgaaaggccacatggtgctcacacctccagagatgtccagaacaggcaaagccagagacagagcacagacgtgctagccagggctggcttccttggaggctcccaaggagaatctgtttccctgcctttccagcccctgggggcccccctggactccatggctatggcggcgggtgccaaggccctgcagcagggcacgaccaccaggacccattgggaattggcatctgactcccttccaccaccccgggtgcccccacttaggaagagccgactctcagcaactgtgcccagagtggcctggcccatcaaccatgtgccccctcagccttcctgcagccattcagagacagcagtaaacactcctccatcccagtgtgtgggcccaaagctgagatcccagcccaggtctcccagctcacagccctgcccagggccatcctcctgctagacgtcaccacatcaatgagcatctaccccgtgcaaggaagaggccggcgatggggtccaggtgaggggacagccaagcccaccaggcggtggccttccctcacctgcccattctgggctaggtcagctctacctggagcctgagcccaggcccctccagtgccctctgctgactgcagcagactgaccaccctggagaccctcctgcccctgccccgagaccctccatgccaccctgcctccaacctctgtcttctgcccccattgccccttcatggtcctgcaggccgcccatgctctgtaaatccagcccacctgggcaccccgtgagacctcggacccgtcacatcctggtccctcctcttcccccacccccacatccgactggcactccctttgggcagctccatccggtggtgtcctctctgagtcccagggcctgcatcgggtggtgtcctctctgagtcccagggcctggcactcagcaggccctggggacatcaaccaggggcccttgaagctgtgtccctggacacagtttccctgccccaagccctggcacattcggcccaggcttggcaaaaactccttgtcctccaaggactcggctgcaccagccactcaaataaattgatgttcccatctctgctgactcatggatgagaacatcggggctcctgccaatggccacacacacccccagccccaccagggaatagccctgcaccctgcagggacaatgtcatgagcctgagaagccaccagcttcccctactccgtgagcaccaaactccagcctgcttgagctgttgggggccccctgccttggcactgttcctaatagagcctgggatcttgtttgagccctacaaggaagcaaggaccccaggcatcatcttacaaacaaggaaactgaggcttggggaggggaggagcttgtgggtccaagttccctgccggctgtaacactgtaggagtcagaacctggccaatgcctggagggggcttccttggccagggctgagcctcaggctgcccccaccccatctctcccccactcccattgcatatggaaaccagaaaatcaatcctaagacccccagccaaacgaacggaccctcgtcttggctaaggacattccaaagtgaacctgaaaagcgagttcaggccacggtgggaagcgggagacggacataccttgttatcccccctcccttttggaatgactggcagaacagtctttcagtctgataataaacatctcccatccattctctctgcagtctgctgcctggaggcttcatctgcatgatgaaacctcggtctgcacaacccattatcttaacccagacattcctatctaccgacaataactctttcaaccaacggccaatcagaaaatcttcgaatccacctatgacctggaagcatccccgcttccggtggttccgcctttctaggcgtaaccaatgtacagcttatgtgtattgattgatgccttgtgtccccctaaaatgtatgaaacctagctgtggcccgaccaccttgaacacatggtctgagggtctcctggggctgtcatgggcccccggccattcatctttggctcagaataaatgtctcaaacactttacggagtttgactttttgttgatatatacgtccagggaggcctcactgcagacttactgggccgcaggggcctcaaggaccaatatggcccctcctcttggaacagacggccccaagccaagaggacttggggaccctgtggcccaaacgggtcatttcacagaatgggagacggaggcccacacggggaatggaggagagcgaggtggagcaaggcccttcccagccctgggcggccccttgacccttttgttccccctcgctgccaggcctgtgactgggtgggcctgggtctgcagccctacggggactggagggacagctgagtgagcagaaggtgccttgtggccaaggcacagaggcgtcagggcccagctgtgttcagcaggaagaaggtctgtgagtggaatatgggggtgcagcggggtggggggcggccagcctgcagctcagatgctgcgctggggctccggccgtgaccacgctcagcctctgtgtcctccccggtaaagtgggaggaatcgccttccacacaggactcggggctgggtgagggctgggcggccaccaccacctgccctggggcagcaggagctgcaaagccaggctcaaggcctgggggaaggaacccggcgctgggtgcccagagtccagatgagatgggtttggggggaaggaacccggtgctgggcgcccagggcccacatgagttgggtgtcggaggaaggcaaccccacccaggccaccccagccagggctcagggactttgcccacatgttaccctctggatctttcggaacattctgctgaataaaaactggatttaaaaaagaggccaggcacggtggctcatgcttgtaatcctagcactttgggaggccaaggtgggcagatcacttgaggtcaggagttcaagaccagcctgaccaacatggtgaaaacatgtctttactaaaaatacaaaaattagccaggtgtggtggcacatgcgtgtaattccagctacttgggaggctgaggcaggagaatcacttgaaatctggaggcagaggttgcagtgagctgagattgcgccactgcactccagcttgggcaacagagtgagactccatctcaaaaaataatgaaaaataaaaaaggtatattctatgaaactctatttggggtgtgatctcgtttttaacaagtatttaagaagtaggctggtgcaaggtgtttctaaatgcttcacagtgttatctctagcaaacatttcatctgacggtcttttgaatgaggagctcctgaacgttcggcagaggaggtggaacagaagagagagggcaggcaggggcgtctcccttcttatcaaggtatgactaagggcacaaccttatttccaaacagaacagtggacaaaccgggaaagggagagtctggagagatgaagcgatactattagtgcggctgacatgtcaatcacggggctggcaccgttcacagctctgaggctgctggatctttcctgcctctcacctctgctctgctcaggcaagcctagccaggcagggactggagttgggggctgttttccagttcacagaggaagtcacaaggccctaggacactcagggccttgggaaagccagccaaggaccagaacagatgtttcggcctgacagcacctactcttgggttaagcatcaccctcggtttgaaaaatagaagtgaggccaggagtggctcacacctgtaaccccagcactttgggaagccaaggcgggcagatcacttgaggtcaggagttcaagaccagcctggccaacatagtgaaaccctgtctctactaaaaatacaaaaattagccgggcgtggtggccggcacctgtaatcccagctatttgggaggctgaggctggagaattgcttgaacccaggaggcagaggttgcagtgggctgagattgcaccactgcactccagcctgggcgacagagcaagaccctgtctcgataaataaataaataaaattttaaaaataataaaaaaaaaacaggctaggcacggtggctcatgcctgtaattctagcactttgggaggccacggtgggcggatcactcaaggtcaggagttcaaaaccagcctggccaacatggtgaaaccctgtctctactaaaaatacaaaaaattagctgggcgtggaggcgcacacctgtagtcccagctactcaggaggctgaggcaggagaatctcttgaacctgggaggtggaggttgcagtgagctgagatcgtgccactgcactccagcctgggtgacacagcgagatcccatcttaaataataataacaataataaaacagaagtgggtagggcacggtggttgacacatgtaatcccagtgctttgggaggctgaggcaggcagatcacttgagcccaggagttcaagattagcctgagaaacatagtgagaccccgtctctacaaaaataagtaaataaattagccaggcatagtggtgcccacccatagacccagctactcaggggcctgaggcgggacgattgcttgagcctaggagttcaagaccaacctgggcaacataggagactttgtctctataaataatttttaaaaattagccaggcctagtggtacacccctgtagtaccagctactcagcaggctgaggcgggaggattgctggagcccaggatgttgaggcagcagtgagctgtgatcatgccaccgcactccagcctgggcaacagagcaagatcctgtctctaaaaagaaaaaaaaagaagtattcgtaggaggatcacagaagacccccaacaccctggtgatgtcaccctgaagtccaggagagccgaggctgaagtctcgaggggaaggacccggcctcgattgggccgcagcctcggcgctggagccaggtctaagacactgctctctatcacgctgggttccccctgcggtgctgcacggcgtgggctgggcaccccctctgggatcagtttgctccctgcaggatgacagggtgggcagggacatgtatgggactcaccacccacagcagggacccaggtccttccccgtctggctggggtcagcctgggaggggcagggttccgcctgcctgatgcattgcctcctgctcaccacccccaagcaacactccggtcacttcttacttccataccaggtcttcgcacttgctattccctctgtttcccatgcctttcctcaggagagctcctatgcctcccacacacagctgggccgccgtgtggtctgggaagctgtctctgagcagaggcagccactgtgccccaagccccgtgggccctcgtcctcacctccattcagctgtggccctgctggatcgtcaccatccaagttgatactctctcccagggccccgtgagccccatcagtgcagggagtccatctgctctctcccgactccctgctgcacctggtccagggttccccacagaggagctactccatgaaggctcagggaccaaatgtggaagtcccaaacatgggctccagggaggaggagagacaggcagggccatgcggtcagatagggacagtgaggaaaccattgacacgttgatctgtgtcacccacataggaaccctggggagatgccagtctcttcttcccaagctatgggaaggggaaactgaggctcagagacacaagaaacctgctgggtttcaggagtctaacccaccaaggaccccaggatgcctcacaccctccccaaccccacttcccagcaccaggttgaagacaaactggactcacaccctggtcaaggactaccaccacccgccgctgcccacgtgcagcctccggtcttcctgcctggaagcgggcatgagtgtgcatgtgtgcatgtccacacaggcatctgctgcacacccaccggcttcctgatcccctaaacaatctgtcagctgtgactgcccatgtcctggcccaggtgcgtgcagaagggtgggattagggagggagccccgagggtctgcaggggaggccgggtccgggtcagggacacaaccaacgtggctgatggggtggagacggctcaggctttgagcaaggacttggaatgtaatcctgtgtccagatccttgtcaacaggaggcttaaaacatgggtgaaaggatggcactcaagaaagactgacctgcccctccagggcccaggtagggcacacctgtggggtcaaagctctggcttctggtccagcaagatccagctgaagatggtcactaagaggcctaacttcagagagcaccctgagctcccttacctcctgagccctgaccctggtcactcctgatacacattgagccctgacctcaatcacaatctgagccctggccctggtcactcctgatacacgttgagccctggcctcaatcacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacattgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggcctcaacacaatctgagccctggccctggtcactcctgatacacgttgagccctggccctacccacagtctcaaccaggggcctttattgggcagtgccagtgctcaaccagtccttgagttgggattgcagctccatgacctcctggccccagctccaacacctgaggatgtcagagctgcgtcccctgcctgtgagctgccccgtctctggaccgcgaacctgcaggtcagtaggagtcctcagggctggcccccgtgctccgcacggagctgggtaccaggtactgggtggagagctgcatcacgtccgctccccccgggcacccagcaggaggctggaacaagggactggagctgagggcggcgatttctctccagaatatttcccgtgctcctactgtttaccaggatctgaaagactcacaggcccgtgggttcccctctctcccaggctgcggtctgcagaggaggtgccagctgtgtggggtgctgggcattcgagcagtctcgggtggccggaggtgtcagccgggcagagtggacaagagccatacagacagaagtgcgggggcccctgggagaccccaacagtccacgggaggttggggcatccaggtggcagcaggagggtgtggaggacccaaggcctggaggacagagaggggatggcagcaggctctgggagagcagtggggctgggacagagagggacgaggggatgtgcatttgccggggtcttggcctctggttgtgaagcctgtggtcgggtggggctgggggtaagggcctgagctgagccccagggctctggctaggaggctgggaaagcggtggaggtgcttgtgcacacgggtgtgcatacacacacacacacacacactgtgtttgcaccattggctcctgggcagatgcttttccccactaccatcgtaacttccgttcccctccaccctgccaggacatcttttcccagacttcccacccccatgcccttgccccactttctccccatctaaatcttcccaaactgccagccctcctcctccaggaagtccttcctgtctactcctgcccctgggctccccattttggcagaggctggtatgcagtgactgtccctcccctcctcagcatccatccagcacccaccgcagccagacctgtcctggatcctgagggctggggcacctgacatgcagacattccaaagacaggtggcatcctactgcacgtgcatttcctcatctagccctcacactctgagtgtggacactgaaacagtcctgttatgcaatgaggaaactgaggcaggaggctaagacacttaccctcagtcacagaaggaacttctgtgtctgaaaaagaccaaagtccccccctgccccgccaggtctctataaaacatctttgggaaagggtttggctgcctctgtcgtgggattggggctgttcacggcctgcctgcggtctcactcacctgagtcctctgtgggtccctgcacacaaccccaggctttcctccagcccctcctctcacccctcccctccagctcccctcggctgcttcctcctcctcttccctcccacactccacactcctgtccatcctcggtgcaaagacatgaacttgcttcccacggaccctgatcccatcccctccgggccccaccttgacttctctagatcttttcctaaatgaattccagggaaggattgggagctggtctcatggtgatgggctttgcttcctttgcccagtgctatcacatttcatctttgcagtgacctggcttcatccaaagtaccaggcccagcccctccagcctcacctccctccaccagccgcccctttctctggctccagcccctccctcccgcctccaggcctgccccaggtacacgctctccacccatctcctccttcacctgctcatcccctgccctccacaggtccactgagacgctgcttgttccggcagccatcctgacctgctcagtctccctgatgatcctttgcaggggccgttccctctgcctgcaacaccctgtcccaccccccttctccggaggcctggctgtttgtgcatcagcaggggagatgatccagatgttccagatggtccagaaatgccattcttctgggctagaaaagagaactgggtaggagtctcttctgtggggccaaaccaggtgccaagcccatgagtccaaggatggcatctgctcagaggaggggatttttctagttctcaggaagggctgtaaacctagaggcgggtgctggcacagtcgccccgatgcccaggggcacacttcagccctcccggcacacccttccctgctctgtgccccccttactagagatcagtgtaaatactagcccaattatttattgtcaaactaaatagacaggctccagactccggcaggatcttcccattgaattctcaagaacatatttttgaattatatcttagtatcccatttgataagaggacactgaggctcagagaggtgaagtaacttgctcaagggcacacagcccattgtgactgagcagagctcgaatccagaaatgcggaagcccaagggcagcctccctcccgttctgtcagccgcctggtttcatccagcatgcttacagggacctgctgcccccacctgggttaggggtgggctctaaagatgatcagggtgctcctggccccatcatcacataggcagggctccatcctgcttctgccacaagttgggtgaccttaggcaacctacctaacctctctgagctgctgcttccttttctgcaaatgggttactgggatttatcctgcataaacaagacatgtaaaaaaaaaaatcaaaaggctcaggacaaagcctgctgcacagaacaccctcagtaagtgtcagcttcaggcaacagctcatgactgtgtgcttaacgctggaaaatcaaggagtgttataggaccaaagaaatgaggccccactggtgaggtttcaggcacagtgacagcattcaggggggtacaggaagccccacaaaggccctgaggcccagggcccttcccggcagcaggtcaccaggaagcaggtgaaggggttatgggccctgaggatagatgacctgttgctgcccattcttgtgggggtaaagcgctcccctccccccagggagtttatggtgagctcccctttctgcttggtcctggcctgagcatctccctggcatggtggtaccactgctctgtgccctgacgcctctgcccagacctcggctgcagggcccatgttgcagagaattactcccaattccatagacggtcctgaggccaagaacagaagcaggtgctggcccagcacccacctcttgtctgcatcctttcccagacccccttccttcctccacacaccccggtcatgcccaccccggggtccttggccgcacagccctcagtgttaacccaggacctaggccctgaggactgagctcatggtctctgcagaggtcccagcaggcaggcaggctggacactattcccggtgacagctcagaggtcaagcaggtacccccggccacacgggcacaggagtgaagtcctgcaggctccccctcccctaagcttccggccagtgcccccaccccagctttggctgggcctcgaaggcttggcggagcccctgcgagatgctgctcccgcggaggacaggaggagggctgtcccattgcggtgggttcactcccctgccactttattttcccagaaaggcaaaagacaccttgggataggacagtgggatggagtctgatgtatttgaaattggaagcaaaaaacccagctcccaggggctgggagagaggccgagggcagtgggaaggtggggcagggacacaccaggacgcaggagtctgctggatcatagccaagtgcgtggggcccactcaaccaaggaagagcagggggacccaaattaggaactcccttgggaggggagcaagcactggagaaagcccagcctgccctgctgccctccgcatccctgcaggctcctgcccggctgccctccacgtccccgcagcctcctgcctggctgccctccgtgtccccgcaggctcctgcccggctgccctccgtgtccccgcaggcttctgcacctctagctcacaccacaggctgcccaggtggggacctgaactcggctcttctcacccacaacctcctgcaccagggccagcaaatgctgcccctcctgctgttccccagcttaattcccagctgaaaacagagcaaaggcattggcaagaccaaagccacttgtttcccaaggacctggattctgaagcaggtgcccaggtgtacggccacactggacaccctcttgatcctccctggagctgagctaaggccaagggctggccccagccctggctgcctagtaactatgcccagaggcccagcacagaaggcgtagcctgcagaggcgctgggcagaaggacggagccctgaaagtgtgcagaggacacactgcctgcgggcaagcgaggctgtgggactaagtgagcagtgcaaggtgcaccgcctgccggcagccctgggcagggacccccatccatctgctatgtgctcccccaaggccaaccaggtgtctctgctggagacagtcacagtttgtgatctgtttaactgattagtgtctgctacagactgccagctccaggagggcagggttctgtcctgtcccttccagctggacccccacgtcctagcatagtgcctgacgtatcacatgagctcggcccatatttgtgagaagaagaggaagagggaaggagaggcaggcaccccagggccgacacggagggcaggttggagggtctgggaaacttattcagaagatgggcctggagcatgagtgagttagcctccacagcagctcagggtttgagtcctgagagcagagttcagcgcaggtgagaaaaggccacatcccaggaatgaggagctgggcctgacactttcctacgtggccacggacggctctcctttagggaccacgtgcattcgctgccatctctctctggccctagaagggacgaacaccccgatacctccattttcacagaggagcagcgggaggcccagaggtgaaggtcctcaccaggcgtgcagctagggtctgttcctaaacctgtcctgtgctgccccaggtgcggacaggggctgaggctgaagcagaagccggcctgcttgcctgctctgtgttccctgagaaccctggctgtctagtgggggcaaccctggcatgcccagagaccccacgctgtggtgggggagcccctcacaggcccaggcgcaggtgcatgtcctccctgccccagaggccctcgcctcctgccgctgctgggggccgccctggctgagcgcccaccaaagtgtgaagtgcttcccgagggagtccatggggaagccccagccccgcctgctgtggctgcatcaaggaggcggccttccttccgggcccatcgcctgggcctctggggtcaggcctcgggtcaccctccggctgggacaggaagcctgacatgagtctggagttgggggtagggcagggccgggagccagcccagcgggatggggatgccggctgtctgggcagacaccggcggggtcagggaggaggctggggtagggtagctgccctgtgacctgcccccctgggatgccgcagagcccaggcccgctgcttccctccggtgcaagctgggatgggctggcagctgaatggagggccaggaaccccaccacagctccaggccaggcaccatcattcctgccctggaaaagggcctccttccagcctctctgactctactccggccaccacagcccgatgtccacgtatgtgtcatccaagactgcggcctgagtctcatccaagatgtcatacaagactgcagcctgtcttctgagtacatgaggtgcagccagtccgaattgagttgtacggtaagcgtggaatatgtccccacctagtatgagacagactgtgaaatatctcattcataatttgttatatgaatgacacgtttaaataatatattggatatattaggttccataaaatatattactaaaataatttgcatcaaattctttttccgttttcctaacgtggctgatagaaaattagaaattattcacgaggctggcatgagatttctagtggagagtgctgtctctgtgccgacagagggagtgtctccaatctaattcacaccagtcccttccttgcttaaataaagcccatcaggtcaggggaaagtctcccatgtccggtgtggacttctcccaggactcagtctcacctctgcccaccaaccccactttccagctgccccgtggtgccacatcttccagctgcccccgtggtgccacatcttccagctgcccctgtggtgccactactgggcctctgcaagctgctccttctctaggagtgcccttccctaaccctgtttcctcctttgtctagggatgtcttctgggctttcacagatgcctggagtgtcaccctttcttcagtgctcccaagcccacctcccctgtccacccccagcagcccctgcctcagccccgctggcttgggctccaagaggcggggcaccgtgccggggtcaggggattgagtaacttgcctcggagcatcagtttgctcatctgtgaaacaggtgccccattcacgggacccacatcccaggcagtcactcagctcaagtgaggtcatctagacagccccctcagggctgccgcacagaagggaatctttggctggaggattaaatgtccaggtcgccaagctggccaccctcctgaacagagctggtgaatcttgaaagaaaaagaaaaattgtttccggagcagcagccccacactgggcccaaaggtgatcgataagcaggtctggcccggcgcctcttagtgctgagagggctccttcacttagggcagggctggctttcagaccaaagctggccagccacctgtttctgtaggactgcaagctaaaatggtttttacatttttaaatggttgaaaagaaaactaaagaaggggccaggtgcagtggctcacacctgtaatcccagtagtttgggagactgaggcaggcagatcacctgaagtcaggagttcaagaccagcctggccaacatggtgaaaccccgtctctactaaaaatacaaaaattagctgggcgtggtgatgtgagcctgtaatcccagctaccaaggaggctgaggtgggaggattgcttgaacctgagaagtggaggctgcagtgagccaagatggtgccactgcatcccagcctgggtgacagagcgagaccctgtctcaaaagacaaacaaacaaaacaaaaaccaaagaacaagaatattacatgaagttctgctttcagtgtccacgaatcaagtttcctgggaactcagccacacccactcctttacatctgctgtaaggctgcgtgcaaactgcagctgcagaagtgagtcttacaacacagacctcacagcccgcaaaggagaaaagatttactccctgggcccttcccgaaagagttggccaacccctgccttaggtaatcctccaaccccttgggtgggtgctattggccaagggggaaaccgaagcacaggggggctaagtgtgtcccccgagggccccggccttcagctgtgctcctacccatcatgatgcctggtgcccgcccccatccccaggacccagaggtcaactacaagtcctgcttttcccgcccacctcacacccggtcttggtgttgtcttgttttgttggctgtgtgccgtgtttaggaatcactcacactcaccggaggccctcgtcttctgggcgtcgctccgtgcctcgcacacatctaaacaaccttaacaaccccctgtcacctgccggggctgccagaacaaagttccactcgctgggcggctgaaacaacaggcatttattgcctcacagctccggaggccagaagtctgaaatcaaggtgtcagcaggctgggttcttccgagggccagagggaagggtccgttccaggcctgcctccttggcttgcagagggccatcctctccttcatgtggcacatctgtctccaaatctccctttttccaaggacacagtcacattggattagggccactccaacgaccttattcaacttgattacctctgtggagactccctccaaataaggtcacattctaaggacttcagtttgaatttggggagtcacagttcaacccacaacaccccaagaaagaaactctccaccccattttacagatgaagagggctgggacccctgcttcaagtgggctgggggctgtagccctccctggagaaggaggctccgggagaaggtggctcccagcctggtggggtgaatcaagtttaccagggcagttgttgcagctacatttcaaaatctggcccttgcaacagcctcctcctcctctgcctcctcctcctctgcctcctcctcgactaattgacctcaggcatccacaggggtatcgatgtctcttctcccggtcccaccccacctggggagcagccctggcacctccagccctgccgccccacccccggtgggcatattctcagctcagcctgctgctgtctagccgtgtgccccagcaggcgtctctctgagcccacctgtgaaatgggtgtgatgaggctcgagtgagttcgtaccgtagcaggaaaccccgaaggaagccctgagccctggaaggagctttgcgggaagcaagctgccggagaccccaccataggcagtcacagccatctgctgagctccggggtgaaagctggcaagctggggaaatctctttagtgcttagggcactcctgcagggctggactcgcctaacggcggggtaggcagagtaggactggacctcaggctgccaggctggaccaaagcttcccctcctccgcccctccttgtccccccggcccctcgccctccctggcctccaagtccccaccgtctccagtaaggctgtccagacgtctgtgtcttgagctggtcccagcgtctttgttcctgctctggaatagggatggctgagaaagcatttgggaggggcgctgcgttttagtttagattggagggcatgggagctgggcaaggccgggcggcatctgactgaaggaacagtgtgtgcgaagaggccagagtatggatgacctttgaccccaggccctctctgggtccttgcccccgccacccccacccccgccttctgtggctgcagccctcgagggggctggcagccttagagggtctccaggccttgctgtttccgcagcgctgctccttcagccgggaacgcctttccatcttttccgtctgcagagaccctgcccgccccttacctcctggccaggagtccagcccccgtgtgcccttcacgtccctgggcctcagcttcttcattcacaaagtgggctgatcctgtccttgccgcccctcgtggtgggggttggttgtagggtcggcagagcccctgggagtacaatcctctgtgaaccgcaggtcccatgatgtgctatgtgtgtcggggccacggcaggtggggggcctcagaccccagcatggcaggcaccacgtggcagcttgctcagcagccccagggcctccgcatcccccggggggtcgcgtagcagcagccacaccacggggcgctgctggggtcaatgccgaaggccggtcgggctcaggaccgaggccggctgttgtctcttggtttttcttcactcttctgggttcgacattgagggactgccacgtgctgatgcgagagccccctctcgcccccagagctcggagtcagagctggggctgtgcttcccggggtgtcatgctaggtgacccagactgaacgcttctagttccccagcagcttcagggagcctgagaagcttccggaaggagctcactctcaggggtgctatggccttggggctgaagagcttgtgtctcattgctgccgtctcatcgctgccccctttatgcagggcctatcaccccctcctgcaaggcctgtggtcccgtcgggctgcattccctgtcatgggtgaggagactgaggctcgaggcgaaggctcctcccacccactgtgggcagagtcctggaaggagcacagtgttcttgaaggagcctccagggatgagcagagaccttattcaggtgaccccaggattatggcagatgagtgtcctggagccacctgaatgggggatcaagaccccccagccccaccaagtcagcacctcctatagcaggctggccttcctggagcctccatgtggcaccacttcacccagggccacccattagtcccctgttccaagggcccatgaggtgggtactgctggtgttcccactatacaggtgaggagactgaagtagagcccagtgcttcccagtggccaagattggagccaggattccagcccagccctggggcttctgagctgaggcccaggcccctccaccacaccccactcatggcagcgaggggagggagggtccccagactcctcgacaggagagatacgtgaggcccagaggagcgcaaggccttccagagggctccaagcatggcgaggacagactacaccctggacctgcacagcttctggtggctttaccctggggagcccacagcccaggcacgagacttctggtcttatgtctgctgcaggccggtcagaaagactctgtgccttggaaggccctgggtgggcggagcagccatgtttaaggtgggtgggttttgttcctcgctggcctgccacagaccaggctctgggctgggcaccaggacgggatggacagccttagtccctgcagaagtcaccatggcgtcatcacggaggccactgggaggtgggagctgcgcatcagggtcctcccctgagaggcgtctgtccacctgatcggtgctgtgcgtgcaggcggacactcaggagcctgcacacaggactcgcctggtcagcgaggcccacatttccaaacccaatgggcccacaggacagtggcaaagagggtgtggctggcattccttgcagaaaggaggggactcctcgaggggcacctggagacacatcccagaacagccgctggaccgagagccaacagggcgtctggcacaggcagatggagcatcagccactaacaggaggacaggcggggtggccttggctctcaaggacccccactggggcccaggccagggcagcaggaagaaggggctttggtccagcgcctggccagttcctctttctctgaagctgttcaaacccttaggcccagggcagactccctcaggaagacgtgagtgacagacagaaacatgtgtcagacaaaaggggcaggggacaaaatgaaaagcaagacaccctggggctggggcatgggacactgagggactgtgtgtgtgagcaaaggacaggaggggtgtgtgtgtgcctgtgcagtggggcacacccagcggggcaggatccgtgggcacacatagaccagcgggacagtggcaaaaggggagtatgggacagccgccggcatgtgcatgtggatgtgtacatgtatgtgcatgcacacgtgtgtgagcctgttcacctgcagtctgaggcagaatgtgggcatgcctgtgcactctcaaatccccatctggtgccccggtggcccccactcaatgggctacaaatctgtctcattggcctcagagaagcgaatgctcacaacaacctataccagtgccatgtgctatacacatggggaaactgagacacagagcagggaagcaggttgtctgatgtcatagcttgcagagagtggaggggactccaacacctggatccaattgtgcctgtgccctttgaccccaccccaacttggggccagggtagccaggatgcagcctccaggtgggcctggggttcattcatccatgaagccagcccctcatggccctggaacaagggggctgagctgtggtgtgtgtcacctgctgggccagcattcagagcagaatccatgaccctcccgggcctctgtgaggggaggtcacggccgaatgttgtagatgtgggaagttggcctcaaccctccatgtgatctcccccagtcacagaccgggctccctggacatgcctgcctcccacggtggctgtgcacctgccctcaccctcgaagctggtggggctgaggctttgcctggagacccaggagggtcaagcccaggtcctcaaacccatgttctctggagactaaggagggtatcccaaaggcccagaccccccacggctaggggcccccagcccagctgcgaccgcagaagtccctgctctgggaaagagcaggtggggagggcgtagcctgagggtgctccaggtgtggggtgccaacagggtcaaaccaacctggcaggttgagcaagaactgggttagtctcgttcatttctgtaccccacccctgcaggatgagagtgaccttattaccggccttgaggacagcctggggcaatggacagaggggccagggctctgccttcccctaacgagtgtccaggccactgggccacgcccaggcccatttatgcatcggtaaagggtgatcagaatatggccctaaaattgcaggtggcctcaaatgagcaagggatgaaaagtgtttagcatggagaatgctccatagatgtcagctgtcattggtcatcgaggctcaaatggcatcatggttgtgagagcaatggggtcatacctgtgtcaggaacctgaacaggagttgagtggggagcagggggtgaggggccccacaaatgcctggtcacctctgaactcagagatggtatactcccacatccagccctttgaccaacacaaggctccagtctttttattttgtattttattttatgtatatttatatttttatttatctattattattatattttgagacagagtctcactctgttgcctaggatagagtataatggcacgatctctgctcactgcaacctctgcctcccgagttcaagtgactctcctgcctcagcctcccaagtagctggaattacaggcacccacctccatgcctggctaattgttgtacttttaatagagatggggtttcaccatgttggccaggctggtttcgaactcctgacctcaggtgatccacctgccttggcctcccaaagtgctgggattacaggtgtgagccactgcgcccaggcattttttgtatatttttattttatttttaattttagttatttatttacttatttttgaggtcgagtgttgccatgttgcccaggctggagtgcagtggtgcgatcttgactcactgcacgctctgcctcccaggttcacgccattctcctgcctcagcctcccgagtagctgggactacaggcacccaccaccatgcctggctaattttttgtatttttagtaaagatggggtttcaccatgttagacaggatggtctcgaactcctgacctcgtgatccacctgcctcggcctcccaaagtgctgggattacaggcgtgagccacagcacccagcccttaggtatatttttaaatttttagtacagacaggggtctcactttgttgcccaggttggtcttgaatgccaggactcaagcgatcctctcacctcagcctcccagtgtgctgggattacaggcataagccaccgcgcccggccttactttacttctaattcgagtcctcttgctggggaagaggctccactattaatgaccctgaccgctcttgggatcagcagtctggactctatggctggatgactttgatgtgtcacttaactgctccaggcctcagtttcctcatctgagcagagggaataatgatagcacctggtccaatgaagcaggctcttagagggttggatgagttgccgtgagaggtgcaggcccttcaaccccacctgcgccctggccgctcctgccctgtcagcaggctcaggtctcctcctcctcccagccagcccctgcaccccagcccttcctgctttggggcctcagagttctcccggggaggcagccccctgcccctccaacagcccgctctctccccagccctgtctctggggatgagttgcagagggaaggggtgggaaggagtgagaagaggagtcagttttggaagaattctcagatggagaggcctcaaaggagctggtcgcctggtccaggcctcggggtgcaggagtgtcaagaaggaaaagatgattctggaagctctgtgaagaggtacatggagagagggccaggctggacaccaaagccaaggtctcggggaggtgggagccaaggccatgcagctctgtccttccaggcgcccacccacccagtccctgcacctgcacacccctgcacagatggcagagcacagggcctcgaggtcccccaggcaaagccttcaagcgagatgtgggcagatggggcctcgaggctgcaggggtttggccattccatcaagctcccagaggatggcacccacctggggactcagccaccaaggtccccacacaccccaacgtgccccgtgttggcttttgtctttccagggcactacccaccctcacctgctctgctgccctggcctccacccacccttccgcacccgtccccacccttccacccgccatccttgtctgcctcacgcaggttcattcctttccattgtcttccagactctggtccacccaaggtgggtggcctccagagcagggagtgcccaccggctgctagagcaactactgtcacctggcaggaactgtcacctggggccccctcagagcccatgaagacccactgtccgataactgagccctcttcgcgcacaggtgactccagctcccaacacttgccaagcactcatcttggcaaccagcctttgtgcctttgctcaggtggtacctgctgcctggaatgccctcctgcccccttcttcaagtgacccagcctgcaaaacctcctccagagagccttactgagtacctggggaagaatgcctccctggcccttcctgagcctctaagttatcttggtgtgttgtacaattgagacccaactgggctgcctgggagatgggaggtcattcagggctgggactgtggctaagtggcccttgagtctgtagcacctaggacaggtcctggcacagagaagatggttctcaaatgaaagagaaagaatgatgaatggggctactggttcagtgagaagagaccaggacaccctgagtccactttagggctgtgactgtcacatggccctcatgttgagtcctggcctcagtcaaagactgagtcctgatcccactcgttactaatcctcataactgactgtcctgatccacactgaactctctagtcacattctgaaacctgatcctagtcacaggctgcactttaaccctggtcacacactgagccctgatcctggtcacacactgaaccctgatcctggtcacacactgagccctgaccctggtcacacactgaaccctgatcctgatcacacactgagccctgaccatggtcacactctgagccctgatcctggtcacagatggagccctgaccctggtcacatgctgagctctgaccctggtcacatgctgagtcctgaccctggtcacagcatgtgacctggtcacactctaatccctgatcctggtcacacacagagcgctgatcctgtggttcacattgagccctgaccctggtcacacactgagccctgatcctggtcaaactctgagccctgaccctggtcacactctgacccctgaccctggtcacactctgacccctgaccctggtcacactctgagccctgatcctcgtagcacactgagtcctgatcctggtcatactctgagccctgaccctggtcacacgctgagctctgaccctggtcacatgctgagccctgaccctggtcacactctaatccctgatcctggtcacacacagagccctgatcctggtcatactctgagccctgaccctggtcacattctgagccctgatcctggtcacacactgaaccctgaccctggtcacattctgagccctggccctggtcacacactgaaccctgatcctggtcatacattgagtcctgatcctggtcacatgctgagttctgaccctggtcacattctgagccctgattctggtcacactctgagccctgatcctggtcacattctgagccctgattctagtcacactctgagccctgatcctggtcacacactgagccctagccctggtcacacactgaaccctgatcctggtcatactttgagtcctgatcgtggtcacacactgagttccgaccctggtcacattttgagccctgatcctagtcacacacagagccctgatcctggtcacagactgagccctgaccttgcttggacattaatccctgaccctggttatatgttaaaccatgatccttccctcgacttagcactggctctcattttacccactaagccctgatcctattcgcttcccggctgagcctgaccctgttgactgaatcgtgacccctttgctatctgctgtgcccctccctcactaggtagcctggaaaagtgctcccagctcagctccacccaaatcagaggtgggcctgggaagtggctgctcaggctgtggttaaggagggtggagcctcccctcccactcatgggttgccgggcagtctgctgcctccacccttctccactggcccagggtggcatcagcacagccacccccacctcccagcgtgctgtcgaggggctgaccccgggcactcagcccaaatactcagagctccttggagccggagagcccagtaaacaccctggaaaacaggcctcctggcaccactgcctcgggaaatggggtcagccctctctgcagcctgcgttcctggctccggacctcaggcaccccgggcaacttctattgggctctcccaccacagggccagacagtagcaaccctgccatgggcagctgtctaacaggctgccacccttgacccaggatgccctgccgcacccagtcactgtggccccagttgcctctggctttagcattgctctctcccacctccctttttctttctattttcttttgagtcagggtttcactcccatggctcaggctggagtgtagtggtgcagtctcatctcactgcagcctcaacttcccaggctcaggtgattctcccacctcagcctccctagtagctgggactacaagcgcaccactatgcccagctaattttttgtatttttagtagggacagggtttcaccatgttggcttgtcttgaactttcaggctcaagtgatttgcccacctcggcttgccaaagtggtgggattaccactggctcactgcagcctcaaactctcgagctcaagtgatcttccctcctcactttctggagtagctgggactataggtgggtgccaccatgcctggcaaattttaaaaattttctgtagagacagggtctcactatgttgcccaggcttcagttgatcttcccaccttgccctcccaagtgttgagattacaggcatgagccaccatgcccagccaaaaccactatttgttaagcgcctgtggggtattgtgtacccacgcctagaccagtgcccagcatgaatggggccccattgaggctttgctgagccaacgagggctggcttcactcccacattttccctggcttcttctcactagagccttggcagtgaggtactagcaccccacttcacaggcgagaaaactgaggcttcaggaggcttatgcaagcttttacagccgcatcctactcccagccctccagtgattccgccctgcagcttcagtgtttaccaagaatccggccacggctcctccactgccaacaccctgcctgcagccatcagctccctgaattgtcaagaagcttcccacgtcctgtgccctccagccaccctcagcagcagcctgagcctttttaaaacatcgagatccctgagtccctcctctgctcagaccctcctggggttcccgtaccccactcgggggggctttgctggccacctgctatccatagcaacaccctccttgctctgccctctttgtgtatttagtaccacctggtcttccactatgtatttattgctatgtccttggatgtaacgcccttgagagcagggactttatccgttctgcttcacactccacgggaccctgaccacctgtgcttcttccagaacgggaggatgcatgaatgaatgcatgcgtgcatgaacgcaggagtgtgtgagcccgtgggtgaacaggaaagcatcagaaccaggatgcgcctcatttccactagtttctccagggtgtgccgtttcctacagggcctcctcctaggggagggcacattcctgcacccacctgtaccctagacaagatgcagctgggagccaggccagtcacgctctctcattcactcctttctcgtccgttcctttgcaagttgtgaactgtgtaccagggacccagggacggacagggtgggctagagcccacccacatagtgctcacagttgagggcagagggtcgaaggcagctggtgctggaagggggctggctggcagggccaggagaactgcagcaaggtggctgagggcagccctactgtgcctgatcgtggggtagggggtgtctaactcccactgagagatgaagctaactcctctgcccgttccctctcttccttcaggcccttcctcaaagtccccttcaagggggactctgcctgcccccttccccgcatttccacagcagctatcgctggccggcttactgcatgtcacttgcttccttgctccttggctgtctctcagctgggatgcagattccaggaggtgtggcctccctagcatctatgtcagagtgcctggagcagagcaggtgctcagtcaatgtttagtgaatgagtgaatgaacgaatgaatgattagaaatcacataggccaggctttggcacccaggtaggtctcagtgagtattaactactggtgcagtgacaccccaggtgagctctggtcctgccctcaccttttaggcccccatctgtaaggggagaccagaactgactccacagggctgctcagaggctccaatgagactgtggacaggacaagcacgttgtaaagtataggcggttctttaaatgatgattcaggacttaaagcctaggtgggccttatttttgctatgtgctgggggaggcaggaattattgagagctggggtggtctgggagggtttcctggaggaggacacatgggacaggcagacccaagggaaatggtgggcactaccggcaggatgagcagtgtaagcaaacgcaggaaaagggagagccaacccagagggcttaggaggctgctgactaagcaggggcaggggtgggagtccagagacgaagctgggctgaggaccacggcctggaggggatgtctgggagggaggcttaccctgggttccgccctgccctggtgccatcagcaggtggggcctgccgcaggggtcctgggtggggtgaccccagacatcacctgcctttacccttcactgtgagaagccgtgccagatgctccaccctgctggccgccctgggtggctgcctccctgcttcctttccaggtcaccctggtcatttggttcatggctatggctccagtgccagcccctgtactgggccctgcccctcctccccatcctgacaggtgggctagagatgccagcagatgcagcaaccactccacactctgacagtctaggagcccctggcaggccctgtgaccttgtggaagggggcacgaggactcagagccagatggcctgggttcaaaccctggcacagtcactgactcgatacgtgaccctaggccagctacctcccctctctgtgcctcagtttcctcttctagcagatggggaatctaatggcacccagcgcagggctgctgtcaacacgagattactttgatcaggcgggggcccagctggctttggagccctgtggtaactgatccgcatcattatctgggccctgaccagcccagctgaacaagcactagccagccactgccccactaggctctagatccaatttctcagccccaccccatatgccccacacacgggcctcaaggagctctttaagacccccatctggccgctcgaagacgtccccaggaaagaggtcaagtgctgaggccctcaaacctggacaaagtcggtgtctgatcgtgttgacttattttacaggtttcattgtgggatataagacagctacagagaaaggcatcgcagagctgcaagcgtgcacatcctgctgccgggcgggcgtggagcctgtcccagcccctcacccctctcgtgcttctgaaacccggcctttgcccagggcgggcccatgtggggaaggcccttcagtgaaaacctgcctcagtctcttctggggaatcttcaggttctgcccaggcctggagggccagcgtcgtgctgacggccacagccagtcctgggcagctgccctttcctggcactgtggtcactgatgagctcttcctagtcaatgacctccgctgggccctgcactgtcatttcctcacataatcctctcatacagtcctttgtgctagagaaacaaagattctgtccacctcactgatgaggaaactgaggctcagggaggggatggggctcacccaggacacagaagcagtggaatggcctggattgcattgaacttccaatgagacacaccagtatggggagccgtgtggccccaggtgtccatgtgacctggggtatgaccccgagtggctaaatcactccatcgtcaggtagctgtgtgactcctagcgattgtgaccgtgggcaatcgcatggttcaggtagccatgagaccccaagaagctcacgatcataggatgccacatggccccttggtggccatatgacaccgggcagccatatgaccccaggaagagaagccgtgggaccccagaagcccattgctctggagccaattcaggtacctggaggttccgacctggattcgtgtcccggccctggggctgctctgaaagcccttggctgcccaggacactgggcaggcacatggtctttagggtctcgggtcccctcctgggcaattgagatccaagacctgcgggttgtggacctactcacctgcatcccagggctttggcccctaccctctgtggagctcacaccctcttcattttgccttggggctcacagagattaggtattttctccaaggtcacacagtaagctagaactctgctcctgcgctcttagcctcacctaagcagaggctgctcctggggaaggggcggagcaggcggaaggacgctggcagggtgagtagacacagcctgaacatcagcgccctaagcacgagagccaagcggggcagtgtcttaggaacacctggtgatacatgagcgtgctaattgacatattggggttttgtgaacgagtttgtttaaaaacgtgtttgttgctttgaaaagataaaagatttgtgaaggagcacaggaggtgtcactaagggactgtctggctgggacactgcttcagctcatcccctctctttcctccctcttcagggcccacctacttgccgcccccaccccaccgctgtgtaggctgtggtctctggagagaatcctgtgcctccattctctaaggaagctgggcaggggttgagggcagctggagcacagcaggcccttggttaaaggcgggttgttgtttgaatcatagtaaaattggagccagttcagggagggcttccatatgtaccacctccctccctttcctttcaaactgggatcaatggttgttgctctcggacacttcctcatggcaggagagcaccagggacactcccagaagagaaaatggcagatgcaaaggtctggggatgggctcaaaagggtggcacggacagtcacctggtgtgacagaggagagagccaggggaggggggacctgccaggcctgccaggaatgtggagctcctggcgcccgcgggctctactggcacccgcgggctctactggcacccgcatgcctcaccagccctctagcctccacctccgtgggggcttcctgcccggaagccctcctgcttttcctaggaagagaggctgctcaggcaagtcacgctacctctgagccttggtttgttcgtctgtgcaatggaaaggctgacagagggccagggaagctgagggcaggggctggagaagtctgagtggccttcattccttctccttctctcctgatttacctgttgtgcggagcaccttctacctctctcccatggcccagtgtgttctccacaaggtccaaagagggcagtcttgtcttttcaaccaaggtaggagctgtccataccaggtcaccagctggcctctggctcagagcaggtcacagcctgtttgtgggatgtggacgttttgcaccaaacaggctctttcctcttcatttacgaggcacagaggagaggaagggaatgatgcccagcaatagtaagatgggtgtgttcacggacgtcattcattcattcattcattcaatcagtcagcctgttcacctaacacctaaccagatatgacccaggtataaatcccggctctatcgcctaccagctgtgcggctacaggtaccaacaacctgtgtcgcagcttcctcctctgcaggatgacacccatctcacaggaaggtgtgcacacatgagcgctggggatgagaggggcctggccctgctccaaggcatccccaggtgaggcacggagaagacaaggttggaacctaagcagtgatggaggcaccacgccctggactcgtcccagcatcggggaggttgtcatgctcacaaagatgcaggatttgccacagcatttgtggggcccttcttaaaagctgtgaagcatttaaagatggcaacagcagagcgctaagccaagcgtggagctattctgagcactgggtatgtgtgactacacaggtcacacacccatgacagctaagggcccaggcacgcctgcttcagagccaggccagagtccgtgtctttctgacccctgggcaagagggcttccccgtatcaagctctctcctcacaggactggggagccagccatttaaggagggggtggagtggggcaaagatgtgtgggggccctgaggattccattccccggcttccatgggcagctggacaatggggccacaggccactgacacatatcacccttcttggtggtggcaggtaatataaggccctggccgggtaggctgggaaggagtgctgcagggtggccctgccactgccctcttgcataggcatgcacacgcacacatgcacacgcacacacacacacatgcacacacgcacatgcaaacatgcacacacatgcacacacgtatgcacacacacatatgcacacacgcatgcacacacacttgttgaggtgcttgcacaatggggatatattttttcttaactttactctggtctctgtgtttaactccaggttatagaagtaaattagttgggtttccacatctcaggcttagaaactgccttctaagtttcattcacaagaaacttcatgcctacacttacattctttttttttttttttgagacagggtcttgctctgtcatccaggctggagcacagtggtgcaatcatagctcactgtagctttgaactcccaggctcaagtgatcctcctgcctcagccttctgagggctgagattacaggcatgtgccaccacacccagctaatttttgaattctttgtagagatggggcctagctatgttgctaggctggtgcctatacttctatacttgcattcagttactcttttagaggcttttttttttttttttttgagatggggtctcattctattgcccaggctggagcgcagtggtgcgatctcagcttactgcaacctctgcctgccaggttcaagtgattctcccgcctcagcctcccaagtagctgggcccacagatgcacactgccccaatcagctaatttttgtatttttaatagagatggggtttcgccatgttacccaggctggtctagaactcttgagctcaagcaatccacccacctcggcctcccaaggtgctgggattacaggcatgagccaccaccatgcccagccccaagaaatacttatggagcacctactacaaggctgatcctagactgggctccatggctaccatggctggtacataccccacaatgcactccttaagaagagagatgggatcatgttcccagctccagtactaggacccagcaaagcgtgtggcacatagtaggcacacactcagtagttggttactgcatgaatgacaatgaagacaattcaatcaataccagcaatttgtgaataaacaaagtctttacctgttctgtcctcttgattgtattgtcattttaaaaagcatcattttgctattttgtttaagcttcaggacaacttgtgaactaggtactattagaatgctcacttatagaagaggactcagggaggttaagtaggcgcccaggctcacacagttggctcacagcacacctggaattgccgctgcctctatcctttggccattgaaagaaaaatcaccagggaagcagatgtacagtttgagcactcatgatgtgtctgatgctgctttggactgtctacagaccattgatgtacttactaaccctctgttgagatactgcatacacatggaaaaacacacacgtctttttttttttttaatagagatagggtcttaccatgttgctcaggctggtctcaaactcctgggctcaagcaatccacccgctttggccttccaaagtgttagaattacaggcgtgaatcaccgtgccccacaggcacatgcatcttgactgcacagctggaaaagtcatcataaactgagcacactgtaaccagcactcagaccaagacacagaacacagccagcccccagacacgtcctctgtgccctgcttcctggctctggcacccctccctccaagggtaaccactatcctgactgctacccccatatacaccttctaccactttatccacatggaaacaaatatggctttttatcctctggcttcttttcctcaacatcatttgtgagagtcatccatgttgttgtgtgtagttgattattcactgtcattgctgtcattccactgtgtgaatatatcacaatttatgtatccatttaacggctgatgagcatttcagtagtttccagtttggggcaattataaacactgctgctatcaacagaaacacaatgttaggtgtgtatctaggagcagaattgctgggtaatcaaggcctttcaaaaagattttgaaagttgtaccactttgcatgtccaccaacagtgtctggcagttccagttgctccatttccttgtcaacacttgatatggtcagattttcccatttccgatgctcttggaggctctgctctgcacttcacttctaaattcctttagcaacaggtgagatggatcttacgatttctattttacagatgaggacgccaaggttctgagaaatgaagtaattcctccaaagcaacttaaaccctggcaagggtgcagggctgcgacgttaacagggttggcctcagcccatcacatctgtctgttaaagccgcctccccagaccttgtcttgatggggtttcccagcagtcctgccctagggattgtggcccttctacacgtggggagagacggatcagtgtccctggccagggccaagcctgagagggaggcccagcctccaggaagctccgggtcgggtcttcgtcctgccccgctctccaggttggagaggggacccgcagagcgcggggcgttgggggagttggggacgggggcgtggtccgggaccaggtaggaggtcttcggagggtggcagggaggggaaaacaggagagttttctcctgcagcggaggaggggctgcagcacctggatggggcccatgtcgccgcgccacgggcaggggcggagggggcgggagggtgcttgccaaggggctgggctgccgggggccggggcctcgtggctagccggacccctctgcgacagagtggcgagaggagcggggagagaaggtggggacaggcgggggccacctcctgcggctgcagagagggatggggtggattgcgggccagcgctttaggggagagagggcggacgctcggtgcggaggggccggggccggggccggggccgggggcgtagcgggaggagggcgggggcggggctggattatggctgggggcggggccatggcgagacgggggcgggagccacggtgcgcgcgggggcggggcaggggcgcggcgggggcggggcggccgttcgggggcggggtgggcggcagcggaggccaatgagcgcgcgcggcgcagaccccgccccccgaatccccgtcccgcggcggcgggtgctgcatagtcatgaggcgcaggggccggcgctgcgtcagcggaagcggcgcggagcggctgtttccgacccgataaagcggcgttgtctccgcgcgccggccgcagcctcgcagcgctctctccgcgcccgcgtcgctgactgaccgcccggccggccggccgagggagcagcccccgcccggacccgcagccgcctcccgaccccggtgcgcccggggctccgcgcccccgtagcccctgcccggcccggcccggccgccccgccgcccccgcggccccggccggaggagacaggtgagtggcctgccgcccgcagccgcctgccccgccgccccctgcacctcgcacctgggcgccgggcacctgcagcctccccacccccacctcccgcacagcctcggcctccaggtcgggtccgcgccgcagccccagccccg

SEQ ID NO: 38023 - DNA, 2490 bp, Homo sapiens
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaaaacgagaactcttatattggctttttaaggaagcagtcttaacaaaggctcttttcagagccacccatgtattccttaaaagggctcacattttctgtgtaaatagctattttgcagttttctttaataatttttccatttataagtgggtgttcttaacactgaatcgtgaaactaaccgtccattttaaagatgccataaaaatacataagcaaattggcggggcgcggttccttacgcctgtaatcccaggactttggaaggccaaggtgggcggatcacagggtcaggagttccaggacagcctgaccaacatggtgtgaagccccgtctttactaaaaataaaaaaatttgtcgggcgtggtggcgcgcgcctgtaatttcagctatttaagaggttgaggcaggagaaaatgttgaaccccggaggcggaggttgcagtgagtcgagatcgcgccactgcactccagtttcggcgacagagcgagactgtctcaaaacaaacaaaaacccaaaaaagcaaactaattaaaatgcaaagagactttatgtcacatgtaatttaaatcgatcaatgcagcggctcgttaggattgcaaagctgttaaaaggcctgagacatacaggagagaagttaatgtttgtcagtgtttacatttacataaaaatatagttagtgacttaaagcaacagaaccagaacaaatgttttattgtcttttgtatgcatcttaatgatacgaaataacctgtaatttgtaagtattttttgggtttgtttttgcaagccactttcaactctactgagctaaccctaattaattatcaataggaatacaaacctacatcccctggagccagacggcccttaggtggagcttcttagcacagtgttcagcatgactaaaagggcacactggtctttttgtgccatttataaatttggcttttttttttttttttttttacagcagattacacaaataccagttgaacttgtaaaagataagagtgctttcatatgaggatgacatattgtggtgaaattaaatgtgttcatgtagcttaacatcaggtttcatattgttacttatgagttaatagtcatggtgcatttggaacaaattattgaaaatatctccaagtttaaatagacaaatcaagatatgaaattaacctttctaaacttaagagggtaaaaagaaatcacttggccaatcacaactagcgcgcgtctttttaaaacgttgatcaaagccagtttcagcgccaacatttaaaaaaaaattaagacacgtcatcctagtagctagacacaattttgccaaggaaaaccaaagtacgttttaaataaaagctagaaacatggcacagaggggaaagggttgaaaacaccagcagttaaagatggacggaggaaagttttaatatttggtctacatgcaggagatgttctgtcagggagtgggcgtctccaccaatcgagctgcaggggaaaggctgccttgtccaatcagaacaggggtgtctttatatatacgggtacgaaaggctagactttcgttttttcgtcatttagcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgtt

SEQ ID NO: 38024 - DNA, 42002 bp, Homo sapiens
gggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcgtgagtttgcacccctcggggtagcaggcgggagggcaccccgaaagggaagagaggctaagcgagaatcggggaggttgggcagagtgggcccggtgagaccttgcctcggtgtcagcagtccgggccccggggaccctggatgtgctcgaagcggtagagcttggcttcccggcccccaggcgggaagagtaaagaatgagggttgtggtgccttcgtcggctagctccctaacagccgagaaccgccgacgccgtcctttgaccctgcagtgtggtgacactccacggatccacggggttattttgcaggtcgtgtcctgccaaggcagattcagtaggacggaataagcgaatgggatgcagacctttcccccgtcttactgcttctaagatgaatagcgttatgtggactagcctggggtggtgacccgcccaccagttctttctttagcccagcatttaccgataataaccaaaggccctttctggatcttagtttacaaaagttatgttgattcttctgatctctaggaaaatcaggccagaggctggtggacagaaggcactgccagataaatcactacatagatcagaaagctttctcctttttaaagggatgtgttcaagtgcccacgtacctcactgggagcaaatctgaaatgtgatgaggaaatggtgtttcccgtaatgttaccggtaggaggcccttgagtgtaggttgtcgaggttcttggcattttgaacaaataattggacaaaacgcacaaaataacaaaggaatgaaacacaaacgaagcagcgaaagcaggaatttattaaagcgagaaagcaccccacagggtgtgagtgggccggagcaaggggctcaagagcccacttacaaagttttctggattttaagtgctccttttatggttcctatgggttaccccttatctggatgaaggatttggtctgtggctaaaggccgaggtgaattggcgtcctgtgcagatgaacggatggtccctgcttggcctgcggccagtctaaggcactctccctttccatgtgagacgtggtggatggggagggttgcagggatagtagcctttgatcctttgccactcgggcgtgggcagatgggttttttccttttggtttagctttaggaagttggccttaattggccttaggttccctgcccccaaacccagggggttccttttgggaattcagctttgggaagtcagcacgaattggccttagattccttgcccccagaccttggtgttttctcttttagaaagttaacgtaagttgacctcagattccctgcccccaaaccttggtgtttttccttgattcagcatgaattgcccttaagttccctgcctccagaccctattctcctgcctcagtaataaatatccgggtctctaataagagttaggtattagaaaaaaataatctttgtaatgtggaaatcagtaatcagttatggaaccagtagagatgttttgggctattttatgagaatatttactcataccacttggtataggttgttccaggctgtaaaattcaatgctgggtctgtgaatttatctgtttggcataatgcttctcttcacagtagctactcagtgtgtaaccaactaaataaaacagctataaattctttatgcaacatgtggtctgaaaaagtttgaggctttcctcatttgtgtcagattttccctgtcctgtattcagaaattgagtccataatctcagctcataaggtgcttgataattctaatataacaactaaaactgtcaaatgaagtctcttattctgagaaataataagtctttgtgactgtcataaaacaggaaacaatttttgtttgtttttagagacatagtctccctgtgttgcccaggcttgtcttgaacttctgggctcaatggatcctcccttcctcctaagtagctgggattgcaggtgcatgcctgagaaataataattcttgccgctaatttagtccttctgtatgttattttaagtaagtatttagtctgttcctttagtaattcttctataagtcatggaagacagctactgttggtaactgctggaatgatgtgcagactgagaatatgaaaacagaaactctgacactgaaagtgattggtcacataggcaaatgttgatttattttccaaaaaggaacctggaagagtgaggagttattttctagagttaacctgaagcagtggccgagtgccatgcacacgtgtaatctcagcactttgggaggccaaggcaagaggatcacttgaggccaggaatcgagaccaggctggccaacatggcaaaaccccatctctactaaaaatacaaaaattatctgggcatggtggcacgtgcctgtaatcccagctagggaggctgaggcacaagaatcacttgaacccgggaggcagaggttgcagtgagccgagattgtgccactgtgctccagcctaggtgacacagcaagactctctctcaaaaaaaaaaaaaaaaaaagtagaaatttaaaaaagaaatgtaggaggcttcagtttgattcatcttaccatactttatggagttatcaatacctcttttttgtaagactgtaaaaatcctttgcctaatttccagctaaaagagagttgaggaggtcagaatgaccttgttctactgcagaaagcataattatttttatttagatatgatctaggaaaattgagttgctaaggaaactaaaatgccacctataagccatttttcaagctgcccatcctgatgttaatcttcaggatgccaagaccccaagagagctcgctagtttaactgtcttgttaaacagccataaagaacaaattataatccaatacatgctttagttgtgagccaaagaagatagaggattgcagcacttgtggtattttaaagaacaacattgaagaattaagtaattaagagtgtgggctttgaagtctgatttaaatctaggctctatggctggctagcttatccctgaacatggtacttaattactctctacagtttcctcacgtgtaaaaagtgaataatactagtatttacctccaccactattgtgaagattaaattaaaatgcctgtaaagtgcttagaagatgttccctccataataaacatttaaagagtgcttactttttgagggcatgagctgtatttgttggtgagcattttgtaaactggaattactctaaaaaaacccacaaaatctaataatggattagaaaagttaacattaaaaatgggtaatacagttgatcaaagtcaaaactattattagcctggcatggtggcataagcctgtagtcccgcatacttgtgaagctgaggtgggaggatcacttgagcccaggagcttgaggctttagtgagccaggattgcaccactgtactctagcctgggcgaaaaagtgaaaccccatctcaaaacaacaacaaaactagtgatatttatttgattagctaaaagcatcaaatagacacttaatgacttcatttttttgagacatagtctcactctttttgttcaagctggagtgcagtggcacaatctcagctcactgcagcccctgcctcctgggttcaagcgattctcctgcctcaacctcctgagtagctgggattacaggcacgtactagcgtgcctggccaatttttgtatttttagtagagatggggttttaccatgttggccaggctggtcaggaactcctgacctcaagggatctgcctgccttggtatcccaaagtgctgggattacaggcatgagccaccatgcccgaccgacctcaatagcattttgctaatttaagttaatcttcatcttttattttgtttcatgttggagacagagaggagcattgaagaattttgaagttgaggcatgtaaagttaaaactaatttatggtatgcccgtaatttcctgggcattgatacaactgctgctgttaatcatcccatctgctctcttttacagcccaagaggctttgttagttcagtaattaaaatgtggtttaatttatacttgaaagagcaggcttacacatgcatctcagaatctgtaaaccagttacttaaatgggagagaattggccaggcgcagtggctcatgcttgtaatcccagcattttgacaggccgaggcgggcgtatcacaagggcaggagttctagaccagcctggccaacatggtgaaaccctgtttctactaaaaacacaaaaattagccgggcgtggtggcacacacctgtaatcccagctgctgtggaggctgaggcaagagaatcacttggcttgaacctgggagttggaggttgcagtgagccgagatcgtgccagggcccaccagcctgggtaacagagcaaaactccatctcaaaaaaaaaaaaaaaaaaaaaagagactcaaaaaaattactgaaataaatttgaagtcattgctttaaaactacaaatagtttagagagttatgtaagttatgtattaacatttaggcaggaaaggacatggtcttttcagaaactactcctaaatctgtgatcactataacatcttgcgagagaaggcaaaagctttttatttgtttgttgataaataaatacaaggtttctgtctgtctcccaggctagagggcagtggcaccatcatggctcactgcagcctctacctcttgagctaagtgatcctctcacctcagcctcctgcgtagcatgtgccaccatgcccagctaatttttcatttatttatttttttgtagagatgggggtctccctgtgttgcccagactggtctcttaactactgggctcaagtgatcctcccaccttggcctcccaaagtgctagaattatatgcgtgagtcaccacgcttggcccaaaaacaatctttttgaaaaaactggggtaaaattcacatgacaaaatttgccatcttaatcatttttaagtgtatagtttagtagcactaagtatattcacattgttgtgtaacagagatccaaaacttcctcattttgcaaatctgaaactctgtacttattaaacagcttccacagtccctggtaatcaatcaccattctaactttgtttctgtcaatttgtctatttttgatacctcatataagttggagtcaaatagtatttgttttgtgactggcttattttacttagcacagtgtcctcaaggttcatccatgttataacatgtgacaagattttcttcttttttaaggctgaataatattgcattgaatgtatatagcacattttatttatctgccagtggacatttgggtttgctttctcctcttggcaattgtaaatagtgctgatgtcaacatgagtgtgcaaacatctcctcaaaatcctgcttttaattcttttggatatatatccagaagtaggattcctggatcttgtggtagttctattttcaattgtttgaagaacctccatactgctttccatggtagttgcaccattttatggtctcacctcagctttttaaaacctgtttaattttgaatcctaaccaacctctggtaacagataccaaattacagctagataggaggactgagctctcttattctgcagccctgtagagtgaatgtggttaactgtatttattgtatattttcaaaaagctttctgaaagagaggattttgaatgtttacagcacaaagaaatgataaatgtttgagatgctggatatactaattatcctgatttgatcattgcacattgtatgcatatattgaaatatcactcagaatcccataaacatgtacaattgtcaactaaacataaaaagaaaaaaaattaaagaataatgcttgttaaagattttttgtagataccaagttttttaaaaagtttccttctattgctgttttgataaaaattttaaaatatctattgaattttattattttttgacatcccttggtcatggggtttctgtcttaaatctgttatatggtgagctgctttactggagtggactcaacgtggttattgtatattgtcttttttgtattttttattgatatagttgtacatatttttaggatacacatggtattttgatatctgtatacaaagtgtgatgaccaaatcaaggaatttgggatattcatcacctcaaacatttatctttttgttgagaacattagaattcttctagctcttttggaacatacgataaattattgctaactgtaatcttcctgctgtcaaatactagaacttattccttctaattgtatttttgtacccattaaccaacttctcctcatcctgccctgccttcccttctcagcttctgggaatcaccattgtaccctctacctccatgagatccatgtttttgactcccacagatgagtgagaacacttgacatttgtctttctgtgcctgacttctttcacttaacgtaatgacctccagttccatccatgttgctctaaataacaggagttcattcttttttatgcctgaataatagtccattttgtatatataccacgccttctttttttttttttttttttttttttgacacagggtcttgctctgtctcccaggctggagtgcagtggtgcaatcatggcccacttcccttgacctcctgtgctctggtgatcctcccatcatagcctcccaagtagctggggctacaggtgcatgccaccatgcccagctaatttttgtatttttagtagagacggggttttgccacgttgcctaggctggtctcaaactcctgggctcaagtgatgtgccctccttggcctcccgaagtgttgggattacaggtgtgagccaccatgcctggcctataccacatattctttatccattcatccattcatggacacttaggttgattccatatcttgactgttgtgaatagtgtgctggaataaacatgggcatgcagaagaaatatatatgctttgatatatttgctttcttttggatacatacctagtagtggggttgctggatgctatggtagttacatttttagttcttttagtaatctccatactgttttccataatggctgtgctacttcacattcccacccacagtgtatgagtgttcccctttctccatatccttgccagcatttgttgttttttgtatttttaataatgtctttttttatacattgctgggtttggattgctattatatattcttttacatctacgttcataagataaacctgtagtttctttctcatgaaaattgtatggtttggggaattaagattatatggtaatttcttctattctttcgagaatgtttatactattggaatgatctgtttcttaaaaattggtggtacctataaaactgttcaggcttggtatttttgtttatgctttatggaaagattgttaactataaacagtttatttctctgagtggttatagagtttggtagttttattaaaaagccataagaaaaatgatggttaatctggctaatactttaattctctgttctgtgaaacatgcatggtggttgttcccaaagatataacacatcctcattaagtttcttgatattagcccttctctgatcttaatcagacttctgaaagtgaatctttataacagtatctttaaacaaaggtgtatcacttagtttgtttagttactagtttagtcatttatagctaatattggtaaaaattctagtgtgtagtgttttctacagggatattgcctcaaacacttgtttttggagttaacatacatcaagtggtcacatctggtcaaatgatcagaagttgaaattctaccttgtggtaaatatattcttgaaaaaagtgataggtatatgcaaagactcattttagtgctcagctcaaatagtaaagttttacttcgcataagtttagatttccctgaaatacataaactcattaatttcttgatcattgtattgtactagcaattaacttagctttcagaattatggaggaaaagctaataaaagtaattatagaacaccagttttggagtaaagggttttttttttttttttttgggacggagtctcgctgtgtcgccccagctggagtgcagtggcgcgattttggctcactgcaagctctgcctcccgggttcatgccattctcctgcctcagcctcccgagtagctgggactacaggcgcccgccaccacgcccggctaatttttttgtatttctagtagagacagggtttcaccgtgttagccaggatggtctcaatctcctgaccttgtgatccaccctccccagcctcccaaagtgctgggattacaggcgtgagccactgcgcccggcccagggagaagacttttaaagatggctaataggccgggcactgtggctcatgtctgtgatcccagcactttgggaggccaaggcaggtagatcacctgaggttgggagttcaagaccagcctggccaacatagtgaaaccccatctctactaaaaatacaaaatttagctgggtgtgacaacgcatgtctgtaatcccagctacttgggacgctgagacaggagaatcacttgaacccgggaggcagaggttgcagtgagctgagattgcgccactgcactccagcctgggcgacagagcaagacttgatcttaaaaaaaaaaaaaaaaaaagatggctaataataacctgacttaaaatttatttaaaagtagggtttggggccgggcacggtggctcacgcctgtaatcccagcactttgggaggctgaggtgggtggatcacctgaggtcaggagttcgagaccagcctggctaacatggcgaacccctgtctctactaaaaatacaaaaattagccaggcgtggtggtgcgtgcctgtaatcccagctactcaggaggctgaggcatgagaatcgcttgaacccgcgaagtggaggttgcaccactgcactccagcctgggggatacagcgagactctgtctcaaaaaaaaaaaaaaattaggggcttatgagagaaacaataaaggttgccgtcagacttctggtttctgtaagggttgccaacccattgtttacttaggtggtaaggccactctgacaacttggccatttgtagttcattagtttggactggagaaaagaaaaaaaaatctgatatctcttccttggtcctcaagcttctcagcactcaagtaacttttgacataaataaatcatgagtagttgatagttactagagcaagtagccgtaagtatctcatctccaggaaaagctgttgctcaactttttctggcttattcttttgcttcgtcacgtggacagctggagcttcattctgctttcagagcagatttgaactgggtttgctttttcaatttagaaggtaatccacccattaatactgtgattcttctgcggttttctgggccctttctaagttttgttaggttgagacccaaaaagtttagttgggaaattaaaccagagaattcagtagaatgtctgaggctaaatctggggtctcatgaggtctctaatggccttgcacatgattttccttaactagctcagtggtcagcttcatgctattttccccatccttccagctctcccttttccattttcattagtccctctactctgtatctcagaagttctttaccttttttgtgctgtgggccaattggcaggccctgtaaagcctgtggacacatccccagaataatgtttttaaatgtatgaaataaaatacattaaaatatgaaggaaaccaattatattgaaattcagttttaataaattaaaatgattttacattaataacatacttaaatagagatgagcataaatgagactttgagatctataaaaaccataatctcatataaaaatatctaatatcagttacaatctcaggtacttctattatggtttgttgcttatctttatgattaatgtatatgccaaatttcagttcaaggttaatgaaaatgaaattataataattttattcccatccaagttcatagattaccccctgaagtatgtggctaatggaccccaagataagaacccctagtttaactccttaagctatggagttaaactctagtttgtagagttaggtacaccctattctgaaatccagtggacattgaatgtccattctcccaagcacaaatacttttagtgcatctgtgccagttttgaaacgtggtgggagaggagtcactgtctgctgtaggctgaataatgccccccttccttttcccaaagaagtccacatcttaatcctgcaaccagtgagtatgttaggttatgtggcaagggggagttaaggttgaagatggaattaagattgctaatcagctgaccttaagatatggaagttatcctggattatctggctgggacagtgtaatcacaaggatccttaaaaatgtaagacaggctatgaaagacgatatggaagagacgcaaagagatgaaatgttactggctttgaagatggaagaagtgggccgtgaggcaaagaaccctagaagccagaaagggcaaggaaacagattctttcctagaacctccagaaaggaacacagccctactgacaccttgattttagcccagcaaaacccattggactttttcagaactgtaagataatttgcattgtttaaactgttaaatttgtgatgatttgttgcagcagcaataaaaactaataggctgtcccacctcactcatttctccctagaagtaaaggtggcaaaaccaacagtatttcatgctaagttcttccagggtagtttttaaagactccatggaggcccatttatgatctgggtatagctcctgggatagatttactcctaattgtccttgtcctgttacattagtgtgatcacacaactccttagctctatcttgccttactatgaaatatactaattttccctcaaaaaatgagttatctcatcctccaagagccatgttaccttaccatttaatttggatttgacctctaaatacagttaagttttaacagtacctacgtttttgagatcctttgactgtaatgtaagggttctgtgtggagcaaagagcagttaagcaacatgaggaagaatcacaactggacaacctaaaggtaagttgcctagaatcacagcagtgcttaaagtagtgaatggcttcgtcagctctgaggggcagcaagcctgtttctgtccttctctgagctaagaaaattgtgctagtggcctggaatggcttgaggctggtaattgtggagaaatacctgctcttaacaaaagtgctctctctttctggcacacctttctagtacctctctgcaaattagtattggtctgtctgtatgctcttttaattataaacagaaacagttgaactcttaaacaggctgatcagtagaaccactggctagaattaacagccaaagggagtaagcaagtgttggatatcccagctaggattttagctgcgaaaaggaaaaaaaaaaaagcaagggcgattctttggcattatttactgtgtcacaaacagtattttcatcacagagaatagtttcttgcctagaaatttagcccctttcacacaggtgaatagttatgtgacttactgactgctaaggagttttttaaaaatatgggttattggccgggcgcagtggctcacgcctgtaatcccagcactttgggaagccgaggtgggtagatcaggaggtcaggagatcaagaccatcctggctaacacagtgaaaccctgtctctactaaaaatacaaaaaattagcccggcgtagtggtgggcgcctgtagtcccagctacttgggaggctgaggcaggagaacggcatgaacctgggaggcggagcttacagtgagccaagattgcgccactgcactccagcctgggcgacagagtgagactctgtctcaaaaaaaaaaaaaaggttataaagcaatgcttatttttagtattggttttgccattgaatgtaatcagtacgttctttataaagtactgtgggtacttcccccacagtaaattctttataaaattttaactgttgatttaaaattagctttctatactttaataatactaataaaaatcagccttaatcttagacatagcatatgaagtgtgttataatgtccaggtggctttgtattttgataacgtgctattattatggactcaaatctcgtggaagacttgttttcttttaactgcaccatgtgaatatacgataccatgaacgtgagtccatttcttctttaaaagtggttctgctcagtttttttaaaaatctgattttaaataaaacttgataatgttattatgcctcaaaggccaactgtgtacaaggtactcttcagccttaaaaaacttaatttttccagtgctggaaataaatttgataaggacaaaaataaaatatcaaaagagttgggcacagtggctcacacctgtaatcccagcactttgggaggctgaggtggacagatcaccttaggtcaggagttcgagaccagcctggccaacatgatgaaacgccgtctccactaataatacaaaaatgagccaggcgtggtggtgggcgcccataatcccagctactcaggaggctgaggaaggagaattgcttgaacctcagaggtagaggttgcagtgagccgagatcgcgccattgcattccaggctaggtgacagagtgagattccatctcaaaaaaaaaaaaaaccaaaagagagaaagttggggaggggtactgtacaatatgcgagagaaagggttaacatacttctgtgtaagaaaaatgcagacctagggtaggcgcagtggctcatgtctgtaatcccagcactttgggaggccatggtgggcagatcgcttgaggttaggagtttcaggccagcctggccgacatggtgaaaccccgtctctactaaaaatgcaaaaaagttagttgggtgtggtggcacgcgcctgtagtcccagctacttgggaggctgaggcacgagattgcttgaacccgggtaacagaggttgcagtgagccaagaccacgccactgcacaattaaagaaaaaaaaagaaaaagaaaaatgcacacctaagtaatgccaacttagcatagaaaaataggtgaagaacataaagacaagtcacagattcaaatgaccagcaaatgaatggaaagaaattttcactactcaacctagtgaagatttttgttttgttttgttttgttttgttttgtttttttgagacagagtctcgttctgttgtccaggctggagtgcagtggctcgatagctcactgcaacctctgcctcctgggttcaagcagttctccctgcctcaacctcccaagtagctgggattacaggtacccaccaacacacccggctaatttttgtatttttagtagagacagggtttcaccatgttggccaggctggtctcaaactcctgacctcaggttatgtaggcacctctgcctcccaaaggttgtctgcccacctctgtctcccaaagtgctgggattacagatgtgagcaactgcacccagcgcaaagattttttaaaagaatgcttagtgttgctgtggatgccgcactcttacacacttctgggggaatgtaaattgttggtcttcctggaagggagcttagcagagcctttgataccacaattctacttaagaatctatcccaagaaaataatcagatgtggatttatatataggatgggtctcacagtagtatttggtggaacctggaaactgtccagcattaggggaatgattatgtcatatatccataatggagagttcagtaactaaaagtgggatttttgtacgctttttaatgacatgagaaaatgctcaggcagtagaggggaaaaaacaggatacagagttttacataggtagaagattaatattgtaagagaactacagaaaaaagattaggatagtaagtatggtcatgtctatcttcagctctcttagaactcagccatgtgtgatttttgggatggagtcccagaggatatctgagagcagttttctgttctcacaagtagttgttatctagcttactaagggaacataagtctgttttaatcacagtttgggtttgttttgtttttgaggcagggttttgctctgtcacccaggctggagtgtagtggtgtgatcatggctcactgcaacctcgacctcctgggctcaagtgatcctcccacctcagcctccagagtagctggggctacaggtgcacaccatcacgccaggctactttaaaaaaaattttttttttagagacagggcctcactgtgttgctgaggctggtctccaactcctgggcttaagcagtcctcccaccttggcctcccaaagtggtgggattataggtgtgagccaccacacgtggccacagtttgggcttttgaaaaaagttaggtggaggaagagaggtatgagtactctagttttcactgcagtatcccatttgtgtgtgtctgtctcttgagggaaagatagactactattctaacactgctccggaaaatattcttagtcattaaccttccaagttaagtggtggatcagaaatggaaagctggctttattcatctttatatcacaggaatgggtccttctaggcattttttaaatggctaaattctaacctatgccttttctgttgttttaatctcccccgtgagctactagtaaattacatttgtatacatgtatccttaatgtatactggattttaatctctcatacgtctccatttggagatgactggtgtcagtaggaagtgaatgaaatcaggtggcttcacatgagatctatgtactgtacaagagtgtaggaaggaagtagtgtggaagaaggtggttggttattggtgatgtgtgaagcaaaagggaaatgctgcttttgtatttatcctgtttctgtctttctgcagtgattttttagttttgtttttaagattgttaaagcagctagaggacaggaccactatctctaatagacttggaataacatttaagcttatacaactaagtgttcatgaaacttcattagcagggaatagttccagtagaaggattgtttgctcatataagtctaaatattggtatgtttcttttcttgttcttttttcttcaaaaaaattttttaagactagtcaagtgcagtagtgagaagtggggaaatatcaaacaagggtttcgatctgtaactgactgtgaacagtcaattgagataactcactaccttcagacctgctaacagtttcttttctgaaatctgtccccaatatttagatgaagctatttgcaaatttagagtacccaaatagattgtcatttcactttgttgggtcagaaaaggtctgtctccaaggaacaaattccctcagatttgttaaggaagtgtgtcataaaaggttccttaagccaggtcttttaactgatctgcccttagggtctgacttcacaacactgcagtgccataccatggctttcgaagccacattctcaactttcagctcaggttctgcacaatccagctttgttcactctggtaccggtctggggacccaccccacccttgtttgccgctgatcactgagctttgaataaaggctatggactgactgtattttcaccatgtgctcactaggctaagcatgattagtttttattctcctagcttgacacagtgtgttattgaaaattgtatttgtgtgagttaaggatgaaaagataaattttacttttaacagcattagaacgtagtgttataccttcctttgcgtgtcagatgggtcagtaatatccacacagctgggcttcagttaacagtttagctgaggctacagagtaagcatgggtcagagcttgagttctggactccagtgtagtatcctggtcactagaatgtgcacagtcagcatttgaaagaataaaggtcatcagctgagaaagagaaatacatttggacatgttcttttgaaaattatctgtgtgtacacatacccatgttggtatcatgtgctttggggtagggcatttgagcgaggttatgctgttagaaattaaccctaaaatgtatggacttatttttgctctgtcatgacttgggcagcacttattttactaataacgatttgctgcttattgaactggctgactggtggcaactgagggaggcattaaaagttgctttctaggcaagttgggtttgtttttcatggtaatgttttattcagagtatctctttgttttcagagtaaacatcagtctccaaagataactacatcccttcttcccatcaacaatggctccaaagaaaatgggatccatgaagaacaagaccaagagccacaggatctctttgcaggcaagtttggactcaaaagttactctaggaacctcctaaatggctttgttaagttgctgagttaaagtcaaaaccaaaaaaaaaaaaagtattgggaacataactttatgtaaagtacttttgtggaggattccaaagtacatgaaatacaggccctgccatcaagattctttcagatttagggagtaagatataaatacacaattgtttaagaaggtgagttaaactgttaaacaataacagaaatgcagttggaggaatgatagaaatactaagtcacaggagctcagaggagtgtgagaccagtgactaaagcagtgcgtgtagccttgtgtgaccaagactaggagtaagaattgcatttggtgtcataatccaaaaatgtgcatactggtacaaaacagaaacaaaagttttattaaatgacttgcccttactacttctaatacagcctgaaactttctattgtttcctttttcagtgctctttgcaacacattgaattgatttcacaatccaccaacaagctgtaacctccagtttgaaaaacactagtataggacagtttctcaaccttagcactattaacattttgggctggataattctttgttgaggggtgctgcactgttctcaacagagggggtgcttttgccccccagaagacatttggaaatggttggagacatttttggttgtcacagctggtggtagtactactgttatctagtgggtagaggccatggatgctgctaaacactctgtacacaggacaggccctcacaacaaggaattgtttagcctaaaatgtcagtagtgctattgttgaaaaaaccctgtctaaagtgatcttgggccaggcacagtggctcacacccgtaatcccagcactttgagtggccaaggtgggtggatcacttgaggtcaggagtttgagaccagcctggccaacgtagtgaaaccccatctctactaaaaatataaaaaattagctggattccatggcgcacacctgtgctcccagctactcaggaggctgaggcaggagaattgcttaaaccctggaggtggaagttgcagtgagctgagattgtgctactacactgcagcctgggtgacagagcaagactccatctcaaaataaagaaagaaagaaagagagagagagagagagaaagaaagtgatcttggaagaagcaggatttatgcaggagaaaaggaaaaaggggccccatggttgggcaggaagtataaggtatgtttgagtggcagtcagtaaagttggtggaccacagcaggacattcttggagaagtcatggaagataaggctggaaatgtaatttggaaacagatttgggaggaccttagacattaataattcgagtctggattttcatcttaatgccaattaaaagccattggcagctttgtgtaaagaatgtggtatgggcaaagtaatgttttaggaagactgacctagtggaattggaattatattaaattagttgcagtgggcagagaccagataatttttcgaaggtaatcacaaactagttcaagaatgaaatagcaaagactgaacataaggtaataaaagcaggaaaggaaaggtgaaaacttttcaaaagggaaatcaacaaaatctgattttagtgattgaatataatggatatcaaaaaaaagtggggattgaagacaaagtcaaaaggtttcaagtccaagggttgagaagaaaatggtatcattatagaaccccattctaaagaagaaactggctttgggaaaaaagtaagctttggttttagatactttacatttgaaatgcaaagggaaatacccaggaggtgacttgaacttttctttcctacctgagggaagacaagagctggacatatgggaatcatctttctagaggtggtagttgaaacttccatgtgaacgagatcctcaaaagagtgaatggtgaggagggagaaagacaagggtggagggtaagatcttgggacgactcttacgttagaaccttggtaggaaatttaaaagacatacaaggaaagaagagattagaagaaagaatagaaaaattgagattttccacttcccttcatccctgaaatttaaatatacaatatttattctgatactgattattttttggataaaatttctggaggaggccaggcacggtggctcaggcctgtaattccagcactttgggaggccaaggtgggaagattccttgagcccaggatttaagaccagcctgggcaacgtagcaaaacctcgtctctattaaaaaataaaaataaatttctggaggagaagtgatatgaaggcaaataatgaattgtctttggttatatggcagattgaaaagaaagtgaattttctatctttgggaccttaacatttatatgatctttcattataaggagacctgacctgacagtttagtgtaatagttacccagtgattgggttttatacacatgaacatgcagatctttattagggtcatatttgttcatagtgaggattctaatttacttcattcccctactagttttttaagtagccaatacctgcctcacttctaagaaaggaacataaggtatctctagaatggaaagtctacaatgagacacttagtttaggacttcagtagcttctcagttgttttaggtatttgactgtggaaacttaaacgttctgatatcatttttaaataataaatctagtgatgatcagagtctctcatggagcctgaatgcttttccagtactcttaacaggagttcaaagagaaaagcatgttttaatataagttttggcatctttgtcacatgaatttcagtagaagatgcacagctcttcaaaaggcttttttttttttttttttgagacagggtctcactctgttgcccaggctggagtgcagtggtgtggtcatggctcactgcagccccgacctcccaggctcaagtgatcttcccacctcaaccttctgagtagctaggaccacaggtgggcaccaccatgcctgttaatattcgcatgtttgtttggttttattttttgtagagacaggcttttgtcatgttgcccaagctggcaaaaggtttttagtagctttctaaagggccaaatattttagatgagtgatacttcctgtttcatttccaaacatgtttgttaactgaattatttgtgtgggacctgcatgatgtgaatatcctacgcatacttcaactggttgcttgtttcagagacttctaatatgctaacatgttcattatatgtatagttagtcctcgaacaatgcaggcgcagtcaaaaatttgtttataacttccccaaaacttttctaatagcctactaatagcctactgttgactggaagccttaccaataagataatcaattaacatgtcttttgtatgttacatgtattatatactgtattcttacaataaagtaagctagagaaaagaaagttattaagaaaatcataggaagggaaatgtatttacctttcattaaatggaagtggttcatcataaaggttttcattcttgcatcctcacattgagtaagtaggctaaggcagaggaggggttggtcttgctgcctcagggtggcagatgcagaggaaaattcatgtataaatggacccgtgcagttgaaacctgtgttgttcaagggtcaactgtacttttttgcttgtttgttttatactcccaccccagagtcagattatgttaccacctttctcactttcctgatagggatcagatttcatttctaacagtgtggcacccctgtttgcagacttgattcacatttagtgattagaatactgatctgggacttgattatgctataggcatatatgcataaaccatcatctctggtttcgtttagccccaaatgaaaaagaagcagcagcattctttgtatttcctaagattaagatagaatacttactgatcagaccaaacccaaattgacatttatgttttctgttactaaaaaagaaaaaaagtttggactgtttaggcttagagcatctagttccactgctccaagttgaaagtgcattctttttatttgcataaaaaattttaatgcctagaaatggtacataatgctatttttaaagtcccttctctggaacactgagggaatgagtcgttctgttcaactgagtactccccagatagacaaaggcagcccttaagcactgttttttaaactgttttgagtaggaagattttcagatattacatgtcttttttcacaaattggatagcatatagtaagtataatttaacctttacaaggagatctaaaccattaggaaaaattcttaaaccatgacaaaataacagtgctgtcatcaggtgtggaaaagtgccctttcccaaatgttactgtgcttgtgtcttggctccatttttttctagcttatagctttcctgacacttgctttgacgtcatttttttcctgtcagtatgcctgcctcttctatcatattggtgtgtaaagcaaatatctgaacttcttttacaagcaattttttttcttttttggagacagagtctccctctgttgcccaggctgaagtgcagtggcgcgatctcggctcactgcaacctctgcctccccagttcaaacaattctcctgcctcaacctcccagtagctaggactacaggctcaggccaccacacctggctactgtttttttgtatttttagtagagacggggtttcaccatgttgcccagggtggttttaaactcctgagctcaggcagtcctcccaccttggcctcccaaagtgctaggattacaggcatgagccgccacgcccagccttttacaaacaattataacaagaataaatagggctcatataatgttctaaaggaatactccgaagattaaaattgacagactaaattagctggctgtggtggtatgcacctgtagtaccacctattcaggaggctgaggcaggagaatcacttgaacctgcgaggtggaggttgcagtgagcccagatcgtgccactgcactccaacctgggtgacagagtgacactctgtctaaaaaataaataaaattgataaacttattttggctgtgttgtctttttgcttatccttggttcttgtataaattctaggtaggagagggtagccaagtggttgtatttggaaagaaggagaggttgttctactaagcctgtgctagaagaacacttcccttaccttcctccccttttctccttgtaaacattttatgactttcagtctaagagcctctatgtattgagagtgcttgctattgttcttgtaagttcttagcctatacaagtttagccttcaaagactcattactgaccttcattttaaaatatcaacttcattttagatgccacagtggagctatccttggacagcacacaaaataatcagaagaaggtgctagccaaaacactcatttctcttcctcctcaggaagccacaaattcttcgaagccccagccaacctatgaggaggtgaggatctgtgctcttggtcttatcgcttttagatattgaggactgtgtacggccagtctgaagtgtagttgagtatgaaccttgagaaaatatttgttactcttgaaggagatctttatggttaatggacagccagaatccaatacaggagtctttcttgagcagagtatctattgcccagagagcacgaaggctttcagtggttactaaagatacttagtgtgcgaagcttccacattcaggagtatagtttctcctcactcccttcctagcctgcaagaggcaagtctttctaaatctggcagttattcattgtcatcaaaataagattttaaggggatacatgtaacaaagacttgtaagctggctcctaatttaaaattttgagagttggtacattgggattgttgggaatggacaaaagctgaacactgaaggatacatcttgattttattagattggtataaggttattacagggtaaaattgatagctttttttttcatatcaactctcatgatttgtcttttcttgaaaaagctagaggaagaagaacaggaggatcaatttgatttgacagtcggtataactgatcctgagaagataggtaagtggttcttaggactccttgtgatgttaggatgtggctgtggaaagcataggtagctaatttcaggatggctacccccagagttgaactagccaatgtgaagtacttcattagtatcttttctgtaaaagtagaccccttgctatgtttctaaggccagagactgctgttactcaatgcgttagtcagtcttttcttggcttcaggaagaaaaatcagagtcatcaaatactactagaatccctttttatttttattcttttggttttttgttttttagagacaaggcctcattttgtcacccagaatggagcacagtagcactatcatagctcactatcatctccagctcctggactcaagcagtcctcccgcctgagccaccccagccgcccaagtagctgggactgcaggcacgtgctaccatgccgactaattctttttttaagagatggggtcttgctatgttgcccaggctggtctcaaactcctggcctcaagtgatcctcctgccttagcctcttaaagcaccgagattacaggcatgagccaccgcacccagctagagtctctttttaaaaaccccaacaggccagccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgcgcctataatcgcacctactcaggaggctgaggccagagaatcgcttgaacccgggaggtggaggctgcagtgagctgagatcatgccactgccctccatcctgggtgacagagcaagactgtgtcttaaaaaaaaaaaaaaacacacacacacacacaaaaaacattatcttctccttcagagttgataagaccattttactgtcttttgagatagtaaatccaatgtaagcaccctaaaaaatacatgttctaaaattgagggacactgaacttattttttccctcaagaagtttgaaactctcatttatacacatacttttgataaccttatgaggtggggaagtctatctgtgggatccaagttgaattgtactcaaaattgaagttagatcttcaaaaagcataacacttaactttgtctggacttggatttttaggatggctttcccctctaccaagcttgcaagagttatccctgagtggagaacaataggcctcatctttccttgttctagctatagtcccttatggaagaggctatacagaacctgtcttcctaaacaggagtggtgtttatacagttaagaggacaaatgtaattctcaactcttggtctgtttggtactagggacaggaacttgttagactttatgccaaaatggttgtctttttttttttttttttttttttgagacggggtctcactctgtcacccaggctggagtgcagtggtatgatcacagctcactgcagcctcgacttccccaggctcaggtgatccttccacctcagcctcctgagtagctgggactacagatgtgcatcaccatgcctggctaatttttttatattttttgtagagacagggtttcaccatgttgcctaacctggtctctggccaaaatggtggtcattaaactattgattttaggccaggtgcagtggcttacatgtgtaatcccagcagtttggaaggccaaggcaggaggatcacttgaacccaggagttcaggaccagcctgcccaacatggcaagaccatgactctacaaaaagtaaaaaattagccctgtctctacaaaaaaataaaaaattacagaggcatggcggtacatgcctgtagtcccacgtacttgggaggccgaggtgggaggatcatttgagcctggaaggtcaaggctgcagtgagctgaggtaatactactgcactccacgttgggtaacagagtgagatcctgtctcaaaaagaaaaaaaatttttttttaatttgaactgttgagttttacttttcccagactgttggactggtaggatgtttttgagcgtcttacacagttctgtcatctaacagaaaaggaaattgaggaccaaaaaggaagtagctttcctggtagggcacagtgtggcccatgatagatcctggaccaggactttggattatatgtctagattctctcttgcttctctaatatttatggatagtctataaacacattaattttaagctagttattcaccgctttaaatccttggtggaataagatgaatgaatggcacttattctcttaaaatgtaataagtcatgatgtctgaaccaggagagggaacatactggtttcctaaggctgctgtagcaaagtaccacaaactggttaaaacaacagaaatttctcacagttttggaggccagaaatctcaaatcctggtgtcggcaggccattctccctgtgaaggtgctagggaaggactgttcatgcctctctcccagcttctggcagtctcaggccttcctcggcttgtcgatgcatcacttcagtctctgcctttgctgtcatgtggcatccttcctaagcgtctccacattgccttccctctatgcatgtctatctctgtgtgcacattccctctttaacaaataaggacaccaacctgagtggagtagggcccaccctaatgtcttcattttaactcagttacatcggtaaagaccctgtaagatcacattctgaggaactgggagttagaacgtaaaatgtacctattttgaaggggacacaatttatcccattacagagagtaatttaaacagcccatggatcagatgcatttaaacacaaatcactcttggtgataagttttcacctccttgccctgtagtctagattcttagtcatgttgatgccaagaaaccagctaattaaaatattttcatattcaaggcctgatctttataacaacgcattctgtttgtgtgggctgtttattcaacatgtgcttcttgttcctgcacacgtctaaataatttagaattcaacttttaccaggatatgctttttagagccttggtaatttgcatatgttatcttcaactctgaaattattctggaaatttacgtaaatttaaaaccttgtattactagcttatttgcagatctgtgtgctctctatgtacatgcagtatgtctcttttcatgtacattgcctaagtaaaagcagctgagaaacaaaatatctgaagatcctgcttttctgttttctctgtgtttgcatttagactttcttaactgcaggcactaaattatgggattgacttcttggacatttgaccataactattctgctgtgaatgaaattttgaatattacttctataaaataaacttagatttcttttttttttttcttttatcagtagtaaacatccttagtagtattgggtaatgttaataaggtggtttagaagagaactaaagttggtaatcagtataaaataatttctaaagtttagcttatggtttctgttttatatacacccttttggtaggggctggggaagtatagcagacaagccctgtattcctgtgtaatcttcaaattcttggtaaatttttcaaaaagcaggcatttccagccatcttactgaaaccaagttgtaatgtgggaagctgctgatccagtactgcctgctcttccttcccttggcccctcacccctcaccccagaaccagttcaggggcttaagcagctggtaactgttgacctaggttttccggtttgatgtgggaaggaatcaagggtgggggaggcagggaacaaaaccaaccccaaacaccatagtccagcactggagctgtgtctgtttggattccagaatatgtcttttcagtgctcaggatatcaatggcatctttatctccttaagtggtctaggtcaggacatcaccacagagaaaaacaatagcttgaatcccaaattatttaacagtcaaagacttcttcataaaaataattgctccaggaaagggagatttgtgtgacattaggcagccaaagtgtcttcctgccagaccctttgctcttggtgaacatgctagatcagagaggtcagtgtcccccccggcaccaatggagggggttgtgacgatatttctgaaagagcaaatcgagcccagagctagcctagggtagaactacttgtttccttttatatcagttgcttccttctcctcctgctttatacagcaagagaattgtttggttttggacagatgtgtgtaaccagcccaaatattggcatggtaacaactgatggattgtcagtatccagtgctgctttgtggagggtataaatggagcctggcctggctttggaacagagggctgactctcttgtgtaactcaaactggggctcagccagcatccatgggggcttgctatgtgccacagaggccctgaggcaaagtaggaactggattctaagattgcatataaagcttggagatgaaacaagcatcccttcttatccagggttcctatggcttttatgattcctggtcaaatgttagctggattggcactgctttggtttacaagataatcttctgctttcttgttctctcacaggggatggtatgaatgcatatgtagcctacaaagttacaacacaggtgagtccaggtgaccctgctgatgaccatcttcatagactttggtgcttataccaaggtcatcattcagattatttctgggtatctcctttgtttctttgccaacatcttcatgtttactcaagatagagcaagcctgcatccccttggtaatctcatctgggtactccagactgagtctttttaatactcttccagaaagctaacatttcagtgtgattctattaactcgtggtatatctgatacagccccatccctcttagagaaccatgtggtttggagctagattcacagattgccctaaaccatcttttaaaatcttcaatgcttctgaggtttcagagagcttttttaaatacttaaccttttgcccctctagtctgctcttcttttgtatataatattaatgcatacaaaatgtatacaatgttgtatacaagttaggaagcataataaatgaagccctaaacttaccactagtcttaaagttgagtatcattggatccacctgcgtgtttttccatcatatcccctgcctcataccttagaggtgtcctttctcctgagttgtctctcatttcctttataagaaatctttacatatatatatatatatatatatatatatatatgactgttttgctttgttttgagtttcataaaaatagtatcatgggggccggtcacggtggctcacgcctgtaattccagcactttgggaggctgagacgggcagatcacaaggtcaggagatcgagaccatcctggctaacacagggaaaccctgtctctactaaaaatacaaaaaaattagctgggcatggtggcaggcacctgtagccccagctgctggggaggctgaggcaggagaatggcgtgaacccgggaggcggagcttgcagtgagccgagatcgcgccactgcactccagcctgggcgacagagggagactctgtctcaaaaaaaaaaaaaaaaaaatagtatcatgctgataattgtgcttgctttatttagcattgtttctctcacccatccttgatggtcatggctgtagttagttcatataccacaaaatatttatgttttcctgttgtgaacattttctgctgtcaacatgtttctggtttttgtaactgggaactttcttgcacatctctagtacacacgtagaaggatttctctagagtatgtaaccaggagtaattcccgtgggtcataggtactgcaaatattggacacaaggaatacaaactgttttttaaagtctttgtaccaatttgtaccccatcagcagtgtataaaagttcccattgattcacttccttgccagcaattggtgaggccaacctccttaaattttgcctatctggtgagtttaaagtgaactctcattgtgatgtagccctaacttttttggtagaaatctgctttgtattgtctctctactacttgttggcctgcgtcctgtgagctctagattatgatactttagaggttactgtctacagcttagacatttcatccaattcccaccctgctcatcacctgcttccccttcttagaagcactttttgtctgtctttagtttggctgctgtaattccagcagctaatacccttaaataagtcaatgaggcttggcgcagtggctcacgcctgtaatcccagcactttgggaggctgaggcaggtggatcacctgaggtcaggagttcgagagcagcccggccaacatggtgaaaccccatctctactaaaaaactataaaaattagctgggcctggtggcaggagcctgtaatcccagccactcaggaggctgagacaagagaattgcttgaacctgggaggtggaggttgcagtgagccaagattgcaccactgcactccagcctgggtgacagagtgagactccatctcaaaaaaaaaaaaaaaaaaaagcagtgaagaatgagctgggcatggtagcgtgtgcctgtattcctagctacttgggaggctgaggtgggaggatcgcttaagcccaggagtttgaggctgcagtaagctgtgatcgcaccaatgcactccagcctgggcaacaaagtgagatcctgtctccaaaaaaaaatagtcaataaaagatgaatgggttactggttactatagaattctagctttaaactagaactgaacatttctttctttagaacaagagttcttaacctgggaatgaaactgtatttgaatttttttttctcaagggtcaccatggcttcagatgtatttgaatttaattgattgcctttataatcctatatattttttgcatttaaaatcattattctgagaagagctccttaggctcccagactgccaaaggggaactatagttttaaaaagtttaagactctctgccttggagaaagttatttgccaggtgactgaagggcagggatctgggaaatgggtttctttaatgtcaataggatgactttcaagataccatcccctatttggaatgaaattgccttgtgttttttcctgtccccaagacaagcttaccattgttcagaagcaaacagtttgcagtaaaaagaagatttagtgactttctgggtctttatgagaagctttccgagaagcactctcagaatggcttcattgtccctccgcccccggagaagagcctcataggtaagcctgtggtctttcattccacttggattgttttcctttgcattctctccaaaattcactcactgttcagtatatgagactacttctattaacagtcttgtggttagaaaagagacatttccagtgttttcctacactggaggtctagagaaaaatagcatattttggcatgttctccttgggtgcagtaggagctctgggtttagcctccagagatgttcgtttgttttctgttggtcttcaggagtcttacatgattgcggttgcctccagattgaaatagactacattggattaggggtcagaggaagaaacctcttcattttgtttgtttgtttggttggttttttggtttttgtttgtttgtttgtttttgaggtggagtctcgctctgtcaccaggttggagtgcagtggcgcgatctcagctcactgaaacctccaccttccgggttcaagagattctcctgcctcagcctcccgcttagctgggactacaggtgcccgccaccatgcccagctaatttttgtatttttagtagaaacagggttttaccacgttggccaggatggtcttgatctcttgacctcgtggtccgcccgccttggcctcccaaagtgctgggattacaggtgtgtgccactgcgcccggccaggagcctcttcattaacatcagttgatgtttgtactcagggttccatggccgcctttttaagaaaatgtttactctgcaagtcctagagtttagaaccttcagcacttagagactagttttcaaaagtggctctcatgtaaagaaccttttgttcatccctgcatataacatagaagtggccttaggctgtgtgctagcctcactgcctttcctcctgttgacacttaaaaaaaaaaaagatttatcctcttcatgatgatttatggttattttgctttttaaattccattctagggatgacaaaagtgaaagttgggaaggaagattcttcttctgcagaatttcttgaaaaacggagggccgctttagaaaggtaagtgccatgcagccattttcctgaataatgtgaggacaaatgaaaagctgaaaagtgagtctaaatgacgagacagtccattgagttagagatgaaacgtgaataaattgaagttgcacacctccatattatctcttaacttttcctgagtcgcttattttcccaccttgagaatagaccatcttctgttttttccccatcctgagtgagcaggcagtcatattcttagacaatcaatcaaatatgaatggctctgaggtttctttctgaccagttatttttccctccctttttggaaatgtcaggaatgtgaacttgaatatgcttacaaggagagacctacttaagtaccttatcttagggtactttaagtacaaaaagtacagaagacatggtatcactgccagcactgtgtgacgcccagaaccttctgaggccagctcaactaaccagatgataactgcttaccttttaggtaccttcagaggattgtaaatcatcctaccatgttacaggaccctgacgtcagagagttcttggaaaaagaagaggttagtattcagtgcaaactgaatttcataatttatatctgcccctagtgaaacgaaactagttcattccaaaaatatgtgagcacttaacatgcctagtactagactgtatcctagttttgtgtgaacccctgagagtgacaagtatttttcagcctttgaaataaaagaagctctgcccgaagtcaaaagcagttggttgtaagggtcaaatagcagcctagtattgtcttactggatcaacacagtgatctatttggcaggtccttggcatgttgtaggttacttcttggctcagattgaatgtatattttatgccaggcgggtcactggttaacagttaccacaaaccacagaactaccatgtaggaaaagtgttgattgaagtagacagtctctttcacaggctatgcgtaggctagtcatgattgtcaaaaactgaaaacagcccaattgctaacagtggaagaattaagtaaaatatatcaatataaccaaatacttgattctcatcataaacaaagtatacagaaatgttagtacatggacatgtatgttaaaagaattacaaaatttgaaacatgaaatagcatataaatacagctgtagaaacatgtaagtcattaaggatcaaaagaaacactggagtgaaatgttttatctcacaggaaagcaaactagaaggaagtaagtgactgggtagggctatcattttgctttaatttttatttttaaatttttctttcatttgtatgtagtatgtgttactccagtgaagaaaatgatactaaataaatgagggggttttctcctctaaaatgaaatgttttcattaaaaattccctgtcaaatgcttcaaatcttttagtcttttcttgtggatattcttaaatcccttctgccttttcaccctctcgtctttactccatacccctaagcagggtatgtctgtagcagcactgtggacactttgggtcagatagttctttgttgtaggggttgtcctatgcattgtagagggttttagcagcattcctggtacctacccactagatccaggtagcaccccctccccagttataacaaccacaatcatctccagacattgccaaatgtcccctaggaagcaaagtggccccaagtttagaactactgccaggccaggcgcggtggctcttggctgtaattccagcactttgggaggctgaggcaggaggatcacctgaggtcaggagttcgagaccagcctggccaacatggcaaaatcctgtctctactaaaaatacaaaaattagcgggtcgtggtggcgggcacctataatcccagctacttgggaggctgaggcaggataatcacttgaaccctggaggcagaggttgccgtgagctgagatcgtgccactgcactccagcctgggcgacaagagcaagactccgtctcaaaaaaaaaaaaaagaactactgccatagagtcctgaacactaaaatctgactttttagcatagtgtgctgtatatgctatagatttttcagcgtcctttccatgccctaggagagtactggggagactgaacagcaatcagattgtttctgaatatttggcatgcttgactactaggttatccctgaaagtagccttgatctgaatcaataattttcttgtcctcggatatttgttcactgaagaaaattcgaacacagcacgatttcagtgtcttaagacttttaagtctggttttgtacaaagtgtgctaatccaagggaacttttgacttttaacaagagtatgcttggtacttaagcagttcatgcctgggtaggcagacaatctcaatttgaggtcacctggccacgtaacaccccagtctactttttttctgtataaaatatcaaaagctgaaaatgttgctgattctttttaacatggttctttgatttttctgtatggacatgttagttgtggattcctcagactgcctttgaaaacaatttacagttcaaataatttgtctggcaagttttggcatgccatctgatggatactaattcttctgaacctaaaataggggcagcagataacttgccatccctgccttcttggtcttgtagctgccacgtgccgtgggtacccagacattgagtggtgctggtctcctcaagatgttcaacaaagccacagatgccgtcagcaaaatgaccatcaagatgaatgaatcagacattgtgagtagccctgtgcctcttacctccacctacacctcaggcttatgggtcagaacccctaaggagtcctgaaatttctgagattagaaacttttttataagatttttcagtccctttttgagaaacaactgctaaagaaagactgtactgcacccataaaagtaatctcattaaagttctgggcttttgtgtttcagtggtttgaggagaagctccaggaggtagagtgtgaggagcagcgcttacggaaactgcatgctgttgtagaaactctagtcaaccataggaaaggtaacaagctctgaaatgcacttggagctaggggaaattgttgtctctagtgaactggagatgcgagggcatgctgttccaatcctctcagccatccaagttgaaattctcagcccacctggtccttgatgttctgataaaaaaaaggtatgccctgtgtctcctggcagaaaacatgattcaaccactgtgggcattgtgctttctacctgggaggggtgcagggaagccatcccagatacagcatgacctgggatatgggcttctgttgattttgacttgatggcttacatccaaaatgatgtcatacatgcttgagctacatggtcaaaccagcaatgcgtaaatgcaaggaaaccacctgtctcctaatccttctgcatctctctttagtgaaatttgcttaagagcttgtgaaattttcccagtttgaatcttttccctctttgccttaaacatgctgataattagaaattgaaacagacagaagacccatagcatgaggccagggtaagtaagggttggcaaagtataatctggcccatgggccaaatctgaccctggttcctattgccatgagctacaaatttaggtttttacatttttaaaggaatgaatgaggggagaaaagaatctgtagcagactatgtgtagccttcaaaatctaaaaaatttattattagccggtcgcggtggctcacgcctgtaatcccagcaatttgggaggccgaggcaggtgggtcacgaggtcaggagttcaaggccagcctggccaagatggtgaaaccctgtctctgctaaaaatagaaaaaattagccaggtgtggtggtgggcatctgtaatcccatctgcttgggaggctgaggcagagaattgcttgaacccgggaggcggaggttacagtgagctgagatggcgccactgcactcctttacacaaagtttgccctactctagaacgtgcaagactatacgatgtgcacatgtattcactcttctctcttgtacagagaggctaccactcatgagcttcaacataaatataagaatagtttctttggcctgtttgttatttaacaactgggctttggttctccagggatattggagctgcttccttcaggtaggcctaacccagtgaaactcaggacagctggtgcctctccctcctgctcctgtgaccaggccacattctctttactctctgaatacagttaactgtggtgtaagtgactgggttgcagagccctcagttcccagatatgcagtgggcggcattgctaagacatgccatgcagtgtcagctgatttgtcccttttccttgtgagatcagagaggcctctgctgtcttttcctccttccagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgtaagcttctgtttccttttctcctccttcccttgatttgatttgtttttcctttgctggtccccttcccaagacagtttcatcccattatagcttgtaaataggtgtcactttttctacttttaagaggaaaggtatcctgtaaaccaagcaatctattcacctgttagctagttatcactgaatcattttgagccccacagccaagattcctagatggcatttggagaaaagaccactcttgaatttccgaataggttgccctttattgttgaggccagacagtgtcttctgtggtcctttcttgaagcaaggttgcttacagacctactctcttggtcccctggagcagtgacttcctcagtcctttggtctttgcctccttaacagtaactggtggctttgccctggttaagagctcttgctgacttccacttgtccttccagtatgggcagtcaggtaactacatggaactggcttggcattgcatggaggagtgcggccaggggactgagagagcttgtcaccagagccttcctgtgctgtgtcaccccacactggtaacattccagcctgcccctcgtcaagcacctcactctttctcctggtgatcaagcagtgtggtttccccgtgagcactcctagtgattaaggttaaggaattttgacagtagtattagctgtcgcatggcctccctaagacagaggaaagaaccaagaggaagcctggcacctacactctaagggcctaagtctgtccttgatttcgcttgggatcaggatgtgtgagcctcagagttagaacagtgccccccgctcgttccccgtccccaacatatctcccattagggagcttgtgcgttgtgtcaggagctgagctgctcccaggctgtcacttaccccgtggtggagatgcctcatagagcctggaaggttgctcattgtcctctcccattgctatttggtttgctgctaactccagagtgatgagtctacctgctatgtaattcttagaactgggcaggctacttagactggagagccagctgcaggaagggcaccctctgggggaagctttctatgaggagcattgtttggggtctctggagagcacagttcttggatatggcccccaggcagagtgagcttgtaccacaggggtgagggccttgcttagagctacatgggctggggctggggaagtgtgcctcatggcacataattgcgaatggtcttttctcagagacccttcatctgcctacctcatgcttatgagcctggtggtgggattggagagaagagcaaaggtttcttttctgctcttccctgagcatggagccggaccactgttaggccagtgggttgggcttgagtctaactaactcagataagaggttgccctttacctaatcttttgacattgaggtgttaagatgctgcagggtagcagcagtgacaatcctggggcaggtgaatttggtggcattgcattccctaaggttcaagttttggcaaaagcctgtgctgaggaggcatagacaatatgcagggaaggttggggcgtggtggctcacgcctgtaatcccagcactttgggaggctgaggcagatggatcacctgaggtcaggagttcgagaccagcctggccagtgtggcgaaaccccatctctactaaaaatacaaaaattatctgggcgtggtggtgtgtgcctataatcccagctactcaggaggctgaggcaggagaatcgcttgaaaccaggaggtggaggttgcagtgcagtgagccaagatcgcgccattgcactccagcctgagtgacaagagtgaaactccgtctaaaaagaaaatattcggggaacttttgcagggcagtgagggagccgctggaacccggctgggcggctggccccaggcacagatccttgatccaggctgctgcttggggcctattaagcaagtccgggtgggcgtggttagtcaggccagcagcttccttccctggaaatgctgattgtggtcaaggaactggaaacaaggaaaactagcaaatagattttggggagcttcttggaggccttggtagcctagagcaggtgagtgtgtggttgggaaaaagcaatgtggccctatggtggttttaggtgttgatttaaagatttgttaagctaaccttgtgcattatttgggtgtcagtttaaaggctgggtccttagggtggacttccctgacatatttcccaggctaagctaggcctctggtttcatgttatagtaccctgctgctttcccagtagtctgcatacttgtatctatttgtaattgtaaatgtaatgttggccttttccattagatgacaagttccatgaaaatgggaccatgagtttcatccactgtattcttagctcctggcacatggcaggcactcagggaaagtatgtagccttatgaactgactgatctgagggaggcacttctgtaagccatagtattggtcactggcatgaggccacctactggatccctgccatccagccctgggagtagcatgaagcagcatggcactggccttctggaagcttggagaggagtcttacccaagctttgctcctagacattaaacttcccagctgggcactaacatgtggctgcagaacctgcccttgctcagtctgtccctggtgcagctgctgggagagcctgcctcgaggcagagccagcagagctcttgaagagctggttgtgctcctcctcaaccccacccccacaggctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgaggtgagtccactgaggcagcccagccaggggtgttctgctggttccaaatgaacccagggcccatcccacccagaggtttggaaccccacagggggaagagcgctgattgagtctaaagggccgtggctgctgaggaagcctctgagaatgactccaggccttcctgaggcctagtccccctgttctttttctactctacgcagacttgtcaaatcagaatctctggcccggcatggtggctcgcgcctgtaatcctagcactttgggaggccaaggtgggcggatcacttgaggtcagaggttttttttgtttgtttttgtttttgttttagatggagtctcgctctgtcaacaggctggagtgcagtggcgcgatctcagctcactgcaagctctgcctcctgggttcacgccattctcctgcctcagcctcccaagtagctgggactacaggctcctgccaccacacctggctaattttttgtactaccgtgttagtagccaagatggtctcgatctcctgaccttgtgatccacctgcctcggcctcccaaagtgctgggattacaggcgtgagccaccgcgcccggccgaggtcaggagttttagaccagcctggccaacatggtaaaaccccatctctactaaaaatacaaaaaattagccagggctgggcacggtggctcacgcctgtaataccagcactttgggaggccaaggtgagtggatcacgaggtcaagagattgagaccatcttggccaacatggtgaaaccccgtctctactaaaaaaaatacaaaaattagctgggcgtggtagcacccacttatagtctcagatactcaggaggctgaggcaggagaatcgcttgaacctgggaggcgaaggttgcagtgagctgagatcacgccactgcactccagcctggcaacagagcaagactctgtctcaaaaaaaaaaaaaaaaaaattagacgtgatggcacacgcctgtagtcctagctactcaggaggctgaggcacgagaaccgcttgaacctgagaggcagaggttgcagtgagccaagatcgcaccactgtactccggcctggatgacagagcgagactccatctcaaaaaaaaaaatcttggcaggaggggtcctggctgggtctttgaaaagctacctagctgattcagatatgccttctcgtgagaactaaattaagttttccaggcctttcagccctgctggtgagtacctaaactggaggctgctggcatgtcagagccttcttgaaggaccacacttggtcccagatgcctgaaacacaggcatctcttttccagtcagcccctaaagtagccttctgccggactctgacttacgtgtggaatcctctgtgacacctcatcttacccacagggacagacagacataatgatcaattgagccctcatatgtaaaatcgctgtccaaatgtgaaggcttaataatggtgccataatatgaggtgatcctttctttcctctttcttcccagtgggagtctcgggtgactcaatatgaaagggacttcgagaggatttcaacagtggtccgaaaagaagtgatacggtttgaggtgagatagaaaatcctacttctcacttagcatgcagtgcttgttttgggagtactcttggtgttgtccaactctgttgggtaaagagagaggtgccagtaacttggcagttctcgtgagcaggcgtggccttctttgggggggtgtgtgcttgatcctaggaacagtggcaatcttacacttgtggctggaccacagcagttaaacacaaatcttgcagctgccatataccctcggtcccctgtcgtttctcctccacttcccatctcctgccctccaacaaagcctttcaaggccttggcagaccctctttggctggaaattacagctgttccacctgctgcctctactttctgagactgtgtttggccttggtcagcaataaacaccaccatcccatcgaaagggaaagcaaaaactggatggtcagtgtagaatcttgtctcctagaaagagaaatccaaggacttcaagaaccacgtgatcaagtaccttgagacactcctttactcacagcagcaggtatgtaagttgtgtgtgaccttcatcctctactgcctgctccaaaggccagctgcctcctcggggcttctgcaacaagatgtgcaggccctgcttctgaggggctgggccctcctatagtccatcattgaaaataggtcctgctgctctgacatggagcatccaacagggtcttttaccaagcaggagggcccaggtctgctgccctcattctgaggtgagttagtttttgaggacaaaccccatctccctgtaactgcttacccttcgaggagccaccccatggtaccacctggccctcctgaggctgaggcctcatcggtatgtgaaacagtggccccactgtgaggaactaactgagccaggcaaagctgtggccaccacaggggtgctccctctggggtggagccaagactgtcttcagagactgcccttgcacttggggctcagtaactgctgccttccctgtcgagagggaggtgtgaaggtcatgtggcctgtgcagctgctcggagcctgcctttgtgtggcaggcgcttggggagcgccagggtactgtgcttgattcctcccaggctggcttaggctctgccactaggtgggggcacttgcttaatgtccccacttctttgcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatc

SEQ ID NO: 38025 - DNA, 2656 bp, Homo sapiens; identical to SEQ ID NO: 36837

SEQ ID NO: 38026 - DNA, 159218 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaaggtgagcgtctccagggccccggccccggcccgacccccgccggggcggcccctttccccgcttgggatggtggggagggcgggaaggtcacggccgggcgggaccgagcgccggggggactgggaggccaggagggcgcacaaaggaggtgccgggccgggcttgcggcgggcgggcgggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcgaaataaaattgagccaaagtttccaaaaagctgtatggagcgctgtggggagtgaagaatgacaagaagattaatgttgaccaactttggaatttccttaagaagttctcatagcagtacctgaagtattaatttctagtagctgtgggtttctgtggacgcctagagaaaaaaaagaccacaaaaaaagtctgtttcgaaaatcgactggccaggagtttgtttgtttttttttcctgcttagaggcaccaccggaggactgtgtaaaggaaactgaaaactacaggttgaagagatgaacaatggagtttagatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacatacagcactcaccaacgttgaaatgggcattttccgctgttggaacagcaaatctgttaatttcaagttgctccagagaaaacctgagctgtccctttaaggggttctgcttttcctatttgtgttggcatttgaaagattgtggaggcagaaaactttctggaatgtcaaaaaaaaaaaaaaaatgctggaactcttaaattgagtatttccaaatgtgagcgctaaggggcgccagttattttttaaccatggaaatggttggaacaaaatgtgtaacatactcaatctgactgacctatattaaatttagttgaaacttaagttatagattatttgatttgtcataatgtgtttatatagtgttttcgaacattgaaaatactttccttaaaattattggcacaactttatgacgtttcaaaataacactcttactgtcttctccttggcatattttggttaagttaaagttttagtagtattagtaacaatttctggtgaaagtttgttttcttgagtgcagttgtttagaaggaatcctttatcgacgataaaatgaaaataggccttggcaatatttagggttaattaaaattaaattgcattcctgaaatgtcgaattcaaagactataggagattccaaaaaaaagtttgaaaatactttcaccttatgtatactatttaaaaagctgcatacttttgcgttctttagttttaaaaggcttcttgtgcttttatgttgatctaaaatctctaaatttagagctgattccttgttatcaagtttccaaccttaggctttaataatttttaatctttcaaatccagaaatttcaattatgtcattgtctctgacaaaggcttatttctctctggttggaaatagtactcgtttgcgttttaaatgtaagagaccactatgatatctcctagataatgtttgtttccccttccccttttaatgtggtttactccatctcttgtcttgctatctttagttttagccttgtcaattccccagtgtaaagattgcttctgtgtggcatatagtatgtttaaaatgggcaatataatgacgaggaagtttgattgttttttatcagaccagtacaaacatgcaggaaaaagggctattccttagtgtggaataagcggcttcctgtaattgttagccttgttataaacttaatttgacttaagaaaaatattggtttctgaagtccatcacatttttttttctggatgatttaattgtgaaatttggcatcttgtgctttacccctttgtggtttgtcattgtccaaaacaaattgatcatgacttttgtttctggttaggcattacttttttttttttgcctataatgcttggctgaaaaattacttttaaatttagataaaatttagtaaaaattttactttagtgattggtttgatgaagttaacatcgtgcttagagtagatgtattttctgataattaggaattttaaatgagattttaaattttttattttaaaatatttttcaaagaataagctttttaaaaatatgcttgtcagcctaagaatttccatttggctagttacaaatttgaggattaagtgtgctggttttcccagttgatgaagacttggatgttttagaatgagtattttaattccttgccaagttaacctttagtctgtatcttgactgtggacagtccttttgttttactgcttgtttttgttttgttttgttttttgctgttgctggtggtgggggtgtgtgtgccagctcttccactgaagtatcttcaacacggttgttttttaaagttgtgaatacattttaggttgggcccatcataaaatataaaggacataaacttgagtttgaaaccttttattgaagatagagatgattataggattacacataaaacctaggtcttaaactgctctacctttagagagacgttttcaactgaacccttagagcagttaatatatggtttttaaaaaaacagacttttcttgtcatgagaatgaaacaacagtagttgaatgcaaattgttataataaagttttgtaatttagaatcgagaaggtgaagagtacggtctattagacttaacaatcctgtattaggggaaaatggagaactagtattttaaaagctgattttgagttttcaattttttaggtggaggtgggcttaaagctgctgatagggaaataaaaaatgtgtaatgaggaagaacagtcaatctttttatcgtggatatcagaaaaattagtgtgtggctcagaaaaagagagcagatggattagaatgccgtattactgatttgaaaatatattttcattttctgatggtctttttgtgtttacagtaaactttctgtctgacctcagtttagtttataccctgcctgctccctctcctttaaatatatgagtaaaaatatttcgttaaaacttgcttaaatagttgctattttttcatgttaatgtttattttcacttcttctgcctctgttattggatgtatcataaggttttcttaccataatttttttttttcctgagaattcatttacaaaagccttgacttaagaattatatggtggttggtattgagaggactcttgctatacagatttcttacaaaaaggttttctttttgtctgaagaagcaattactgttgtcagtaatcatcatctgtaacaaacagattttaaggtgaaataatctgttctttagaaactaagatattgcttttgtacacagtccttgaattagttgtagcaagaaggaagctactatttataatcacttctttccattatcttttctcacccaggaggtgtcagcagctatatattggcagtcacggaaaagatcagttgtatcattatggggcatttattaaacattcattctgtacttttaaagctaaattcccctgtaggtggaacgtgattcctttggaaactgtatccagtttacatgttttgtagtaaaagttgtatccgactgtaacacagttgagttgatagaaataggtctctttgctagtcacatttacgagtgtattttgggatgaacactttttcttaaatgactgagaatgtcaagttaaatcaagttaatttgacttcttaaatgctttatgcacattatatttctgttaatgcttcactagtcactgtcgctgtcctggagctgattgaaattggtcagtttcccataagagcaaatggtttttggtttcctttttcagggaaatagatttctgtgatgaaagaagtgaagtataataaaaccctcatgctttgacctggccttcaccgaagcatgattcagattctttttttgaggccaatatacttagacatgtaagggcttttcttttcttttcttttttttttttttttttggtggtttttttctttccttttttttttttatggtttggtttggtttttatatcaagggaattacaccagtgtgatcataggagcaactttttataaactggaactacagtttaatttacttgagaaattcggtgtagctaatacatttgtttgatttatttgtttgatgttgcagttgtaagcaaaacttgcccttctctgttggagatggaaaatgctgtgacattgttggtttttgtttgttgataacttaaaaggcagcccactgagcaactttctgctattggtatgtcagctgttatgaacatatccaaggttctattttaaggccaagggatggggagtggtgagtgggcctatgttaggaggtcacacagatatataccagctttttatttacatgatcaacgggacttcatttttttctccagtccctcctgtgtttgacattaagacagcttaatgtgaattttaagtgcaataatgtgttgtttacccttaatgataacttttagggaatatttatacccctttaaaaaagttttgggcccacaatagctagattatttcgtgttttacagttatattttttacttaacagaaaatcacaactaacaataaacttttatggtgaatatagtttgttatcttagtgggactgttaagaaatttgtttataaccccagtctgtgttaggtactaccttctatggagtgatcattatagttagcattggaatattattacctgtctgccctcttaaaattactttcttgaaggtgcctaccttagagcctggcatacacttctcagatgtttgttgaattaaacatgttgacatcttacctccttttttgatttctagtttctcaaagatagggtatgtgcacatggtttaaaaaaaaatgaaaatctgaaagtgacattagaaatattgtctaataattttaagaaatgaagcagttgtgtgattgttgatagttttgtgcccttagaggaaaaggcacttatatgttttcttaaaaacaacttaaaaacatgtcatgttatttgtagtacttgctgccaaggtgcttaattttactttactgtcattgttgggaaggagatttaggaagataaaattgctttacttaaatagtatagtttcttgtcagtccttataccaaagggtatcaattcataagcagagaaaaactaccagtgctcatctcagctcttggaaaattttggcatttatggaattatataggtaaactccccaccccgttagttacccttttaaaagtccccacatatatagttcttgtactccatgcagggcacaatagataggaatgatttcttgtccctaagtgctgctttggtgtgttcaggataacgactgtatttgattgagtgattttagtttaaaagaaagctgagtataatcatatgtggctgattgtcatttaacacaaatagctatgtttttaaacacaggtgtgtcttttaattttaaacagtgccattacttagaaaactgataaattgaagttttcacttagctgaaactaagctcttttatttcttttttcttttttttttttcagttggagtctcgctctgtcacccaggctggaatgcagtggcgtgctctcggctcactgcaacctctgcctcctgggttcaaacagttctcctccctcagcctcccgagtagctgggattacaggcgcccgccaccacgcccggctaatttttgtatttttagtagagacggggtttcaccatgttggccaggctgatcttgaactcttgaccccatgatctgaccgcctcggctcttgaccccatgatctgaccgcctcggcctcccaaagtgctgggattacaggcgtgagccaccaagctctaaactgtttattactgtgctttagcagtaacagtgtttgaaaatctgtgatgaatttttaaaaaatatattgcagaagtgatttatctagaattcttacaattagcaagaaaaggactgcacttaatgttttcgtcttcagtttcttgatgcggaaactctagtttgaaaatccggcaatcctatcaagtctaacaaaataaattatgttcataaagttgcttcatgtattagtctaatatttttgtagaactaaattttgaggctggggaaatgaatcgattgtaagatttatatcacattatttattataagcagaatgtgtcatattctgcttagcagataagcagatattgaagtatcggaaagaacataattagtcggatgtggtggtgtgtgcctgtagtcccagctacttgggacgctaaggagcgaggattgcttgagcccaggaggtcaaggctgcagtgttatgatcatgctactgcgctccaccttgggcaacagtgagaccctgtcttaaaaaataaaacatcaaaatgcagttacatccataaagtggctccacataatggtcacaatgtaagtaaagggcatgtgtgtgcaggcatttatatctgtaagtgaagacatgcagtgaatgtgagctgggctttgtgagtactggggctggttaagttccagctgagaaaggttggccccgggattgaataagtagctggccttaagtaagcacctcgcttttgctttagtgcaggagaggtcattgtagagactgggcctgatctcctggtcagtagcaaatcattggggagcccttggtttttaagctgattttatagtttgaaatatataggaaaaaacaaacaaaaaataatacattttaagagtagaattagggaaatgcatagtaagaaaacaaacatgcaattttaaaatttgaaaccgagcctggtgaggtggctcatgcctgtaatcccagcactttgggaggccgaggcaggtggatcacgaggtcaagatttcgagactagcctggccaatatggtgaaaccctgtctctgctaaaaattagccgggcatggtagagtgtgcctacagtgccagctacttgggaggctgaagcagaagaatcgcttgaacctggtaggcggcggttgcagggagaggagattgcgccactgcactccagcctgggtgacagagcgagattccatctcaaaaacaaataaaatttggaaccttttttgtaaactcttcaatgtcatagttttacagggtctcaaacttactttgcagattatatcagagaattgtgttttagagctgcaggggacctgagagttgggagtatatgttcatttcataggtgcaaagacaagtgggcagcagagctagagcaagacactcacttctgccctctgttccattttgtggcgtgcctctccacaaggggaactggagggaaaaacctggaatatttccatatgctaaaaatctgctgctgttgcctcaagttgtgaaggtaaagaagacaaaccaaatgattttttgctaattctgtgatatgctggttttgaacaaatgatggtcagattcttagaactagaatttatttttaacgataactttctaattaagaggctaaaagtgagaaagccatttttagaggatttcagctcattcacttctttgtaagcaaaggctagagcctcagttttttgaataatgtaaaaattgttgctgctattatttttactactcaagaggaaacatttttggctgggtgatttaatagagaagtatgctattgctaagtgattcaagttaggaatgtatacttgtatcagttttagatcagcctggggtaaacagcccaatgatatatcaggtagataactgaagagtgacacccaggaggtggatggttatgaattgaatggaaacggtgctgcaccagatagccaccaggtagctactatatcgtattcctgatgccagcatctgggggatgattgctcatttcaaataattcaaacaaattaaatgtaagccacagttctttgctatgttacagcaattatatccctttgatacagttgttacatggcaggtgaatacatttttttaagaaaaaaaaatttcaaactgggatcaaaaaaattaccctgaaaccgcatctaattgtctattgtcgctgattccaccgtggttgcagtgatgccattatcatgagagtattcaagttttaactctgtatgtgtgtgcctgcacatgcgtgagccagcataaagatgaaatgaatttatgtttttgtgcatatgctaatgagaccctgtgatgaagtggtaagcattcttgtactatagacctgggatctaatcatgactccgcaattaactggtttggtgatcttgggtgagataactaatgtctctgaacctcaagcttcttcatctgtgaatgaaattatcaactgccctgccaacctcaaatccaaatactctgaagttgatgggtattcagaagagcctctcatactataaagtagcagcatcactgcttggtttttaattttttttttttttttaattttgtgtgagtctttctctgttgccaaagcactggatcttggctcactgcaacctctgtctcccaggttcaagtgattctcctgcctcagcctcccgagtagctgggattacaggcgtgcacctccacacccggctaattgctgtattttagtagagacagggtttcaccatgttagccaggctggtctccaactcctgacctcaggtaatatgcctgcctcagcctcccaaagttctgggattacaggtgttagccactgcccccggcctgcgtcatctgctttctatcaacattttaaaatcgcttatgataggataaacaattaaataagcaaaacagcttttagagaatgagaaaagaaaaagaaagatgatgtatccatgtaggttcagctagtttttatgtgcatgagagtcactactaacattctggtagtttagaggatgtcactttgagctgaactatctagttatgtttatttgagaagtggaacctgagttgatattaacagctggtatgatttaatgaggtgaatgggaaggtggaggatgttccaggagaagggaaggtgcagcattgccagcaccatggtgatgggcaaggcttaggaaataggtacggatttagttagttggaatggcaaatgcatagatagaagtagtgggaatagatagagactacagaaagcagaccaggttagggctagattgtggtgggccttgaaggccagaatacatagtctgaattttattctgaaggttgtagggaatctttaaggcttggattatttgggggtgtcagaatgaactctttgtgcataaactgagaatgtatacaatatatatgggtttaaagtagacattggatgaagtgtgaagagtcaaactattatatacgtggctaaccctttaggaaaattttttgagtagtgatattttctcaaaatagtattaataaaaatatttatattgagttttctgtattttaaactccttaaagattttttaaattttgttttaactagaaacaagtctttgttttccttacctacaggttagtgtattcatcctgaaggattgagaacatgtggggctcatttgtttagctgtcagagcccaatttttagttagagaattgagcttttatttctatatgagctaaagacaattgaagagactcttggagaaaatcttaggaattcttgaattaatttgccttgaagaaaattttgtcccaatttcagagatcctttaaatatgttttaccaagtttgatgcgggcttttaaaatttaattgtattaatttttgtgtttattttaggtaaatgagagatatcttgacattctatccctagagagatacatatttgtgtatctttaaaagttaacacttccttacatagtgacattacactgagcaagatggattaatcctacagataacgtaataaccagtccatattcagatttctgtagtggatcccctgatattctttatagctggattgttcaaaccagaatcttactcaatactgctcattaaatctggttgttacgcctttttaaatctagaaccatctctttttttttttttttcaaatgacattgatttaacttgttcagggcttgttcctttatgccctgtgtatctattaacattggaagctagttctaaagtaggttcaagaatagcatcttccactggagtacttcataggtgctgctgtgtactttgttatcttacatcaggaggcacagtaactggctctgccatcagataaggaaagattgatacctggattagagtggtgatagatggatccttgtactttaaaggtagttttttttgttttgttttgttttgtttccccacttggaaccagaaggtgccccatcgaccaaaggtgccccgtcaacattcacacctggttttgaccagttttttgcctgaatcagtttcatcagagcttgcaccatgatgatactttaattctgccattctttctgcaattacttggcatcctttgaaaggtacagctttctgaccccaacacggaaatacattgcgattttgaagtgagtttctaatggggcaagccagatatatgctgctgcttattattacttggttctcaaagtaaagtgttggtttgctagttgcttcaaatggagaccaatgaattttttctctcttttctaatcatctttgtagactcatggatttcatagattcaatgtacttaagtcaactataattaattttgatgttaaaattattacaactttagccattgataattaaactggctcctgtgtctgttgaactgctgcttgctttctggggcacaaggcttcccttgtgccttgtctgccttgcctgttctggagctacacttggccatttctccaataggaatggtatgaaatacttgaatttaggtgttaaacatgttcattactctcaggatgtgattacttctgagccattttctatggacagtattgactttaaaattcattcattcatttttatattttcaattcaattttttaacgttactgttaattttatactcgtaccttttttttttttttttttttttgctggccacagctaaactaatgttgttcttgatggtgacatacttatttgctttattctacaatattaaggaaaatactttcaaaataacaaaattaataatattactaatagcagtaaaactatctttaaaatttttaaatttgttttagacatgttaccaataatatagccagtgacccatttttctggttgatgacaattattttccttttttggtgggggggtcctcattctgtgtatactaagttttaatttctactgaatcttgtttttgactttttgatgctgtcatttattagctgtgttcttttgttgtacttactgcttctattagcttttaccttatgctcagcagacatggaaaatacacatatattttaatgtcaggtgcgtgcgtgtgtgtgcctgcatgtgtgtgcgcgcgtgtgtgtgtgatggcaatatgatccagaaagataacttacaaggagatggttgtttatactagtgctttgtatcttaagcacgaagggtagggaaaaaagaatatgacaggcaaaatgtttcaatttagtgaattcttctgaataatatcagtaaaaatatatatagatctttaaagcttttaaagtcatatgaagtaggggaaacctcataggtagaaagtaagtcttaaaattgtatttcttagtagttgcaaaatctctagtgcaaacttgttgtcattaagaacttttagtagtaaggaacttatgttccagcagatggggatgttagtacacaaaagagagcactcagtgattaaaatgtgttgagaaataacccttttgccagaataggaaaatgttctcctttaaattgtaagggaagagttgctcaggaatgtgacaaataacagttacctaattgagtattttcattggcatgtgaaaaagttgtcatagttctttaaagaacttgtctttttaagagactatatgttggtatgttgaccatattaaatgtaactagtttagtacatcagattgattgcagctattttctgaaatagtttctgcctttacaactcagttgtttgaagggtttttgttttggtgggtgactgagtcacatatattgagaggtatcctgtttgtacgttttctttgtaattataaagtctttaggcagtttatttctgtttattaaaataaatcagaagaaaatgtgtcatagtttactatatgttatatgaagagaaagttcttttggggatcatagttttatcatagtaataaaaaattatcagcagtaaaaaagatagtcttatctcacttttattatagtttatagcattacgacatactgttagcttttttagtaggtaaatactacatagattgctttaacatatgctttgcaattgttgaaatactgctcatttaagttccttcttagatgtgattcagaagtgtactttaatgtatttaagttatattttcctagttcagttatattgagctttttttttttttaaactgtcaaggcaatttaaaatactcttgccttcagtgacttgaaattgaactctgcacaggagagaagaatatgtcttgtttctatatagagaaccaaggaggaagagattgactttgccacctttgtaactgataataacttgcattttagtccctgctccccagccccacttttttccttttctgttattcctaaaatgtagagaattggagatcgatccacagattttcagttcatctttggcagtagcatggtttgtaacttttttcattcctggaagaagcagtggtgagggcacagagatagcgtagcacattgtctttgaaccttaatgggaattacttcttttcagggaaatatagcaatggccaattttgtctatacattttaagattgtttcttatagttgttagagattttatgagaagcttgaatttctttcagtaatcctaaagaactgttataaagaacttatttatcagaagaaatattccttattgggaaaaactaaaatatatcaattaaaaagttaaaagtactcatcatgcactgatagctgctcttaatgtttccttgtagtccccccccaccagtgtttatggatgtagcaaaattggaattacggtttttaaaaaaaattatatcatgagcaaaatttttccttgccatttcatattctttgcaaatataatgtttatagtaatatatttcatgctgtcgaggtatattataatttacttaactaatctgttggacttgccactttgctttcaggaaatgtgtgtaatgatagcattaagtggctttagaagttacttttttaaaagccttaagttacaaaatactgtaactgggaattatgaataccaaactcttatttttgcaatgcagttaatctgaaataagcattttatgttgcattgcagtagaaactggttgttaggatgcaacgtgattttcgaataatgtcagagttgcatatttcatgtattagtttttagtgacttaacatacttaattgaaacttttcattctattctaggctgtttggttgtatgctattaatatgtgtgcgatgttatgagggacacactaaagcttcaaattcattccttcaagttatctcagtagttggaaagaatatgaaaataagagtaacaaaggaaatagaaacataccaagaagactaaagactggtgctaaagagggtgtttttggctgaggaggctatggaatgtttcaggagaggaggtaaaatttcatctggctcttaaaggacaggtaggattgaagtggagaacaggtaagggagtggcgttctagacacagggaacggtgttcttgaatgtgggaacattctgagtaggaaggtgtaaataattctctattagagagagctttttatacctttggtcttagctttttcctttatctgcctccatatttctgtttttagtccagattttcttatctctatcctgtacaggcattacattatagagtgatatattaatgtggtagattgctgtgattgctgctgtccttctcttcccttcattttcagatgttcttttttcttgactttgactctctttaggtttttggagaagaggggtatcttactgcctaacttttaattttaactattgtttatctgtatgcttaatttggctttttattttttttgttttcctagtgcatttggattttacttagcttttattatgaagccatgtgtttcagtttttttctgtatgtgtaggtgattgggcttatgaattgatcaggagcatggaggaataggtacatctggattagcgagtgtgtgaattcttgagctgatgggcctaagctctaaaggatagattagttgtcagcatattctggtctagatagtatggcatagtttttaccagtatgctttcttttccccatcttcccagtttgctttttactctaatggcttgaaaaagtataggttaggttggaagtgagagaacaaaaatctgctaatttaactctgaacaaggaaggctttaggctgatgtttgaaaagtgtgttccatggaatactggtctcctgaggtagtctgagaaaagaagggtcctgtagtccaggaagttctgcatactccttttgtgaattcaggatgtgttgccatattaagtctccaggatttgcagtcaagaaagttaacttggtttaactgagcattttctgaaattacttggttaaggaaatacggtttttctttcttttattcttggtactagttctgaggatatgttaagggaaattttaggggattgttaaagatctgtggatccttgggtggaggcaggtttaaacaataattgtttgggaatcttaattttgaatgagagtgctggctcaagtcaaatcaaagtaccccttggaaaaaaaaaagttatattattccacttaggttgggcttcaggtttcaattgaaaggaagcaagaaaactgtccttgtctggctttcattaaataacaattcagtcaaatgatttcagtaatgaattttgtctaactcaaatgcatttgttatttaaataaaaattaagatgtgctgttttttaaaaatgtaattctctaaataaaaaaaattaacatagaatcctgccagcttaaacatcaaactgaaacttactttaaaataggtatatacagagaaatatgctcatgttgtaactcatgcctggtttacatctacattttttaaatttgggaatgactgaattgtgaggtgaagaggaattagtaaattttggaaagaaaaatacttatctttgttaggtcatttaaacaaacattaagatgcaattttgtgagatctgtcagtaacaccggttgttttctgtgaacttagattttaatctattaatagaatatattatctcccctcattcagttatatcataaagttttggtgacctttgtagcctttataaaagggaagtctaagggtggatagtagaatagcattttatttggaaggccctaaagatttttgtaaaaaaaaaaaaacaaaaaactgttcttattaaaaaaaaaaaaaaaccctgtaattctgcaattttaaagcgggtgtggatttgagagatcgtagacccattcttcattatatatgtaaatgctgttcctttacaaaggatatgaatacattttatattttggaaactgctggtttcaggcatgttagatcatttggctcttgggacagaaatatatttaagttacattattaacaagtaagagtacctttgggcctgatcccctctaagcagaataatgtcatgactgataattgtgtaatgtggctaccttctgttgtgaatagtcttaattaatttaattctgttttgttgctggaagtatctacccagggtattttaaattcttcctccaaataagaatacaatcaagcatctaatgcacagtcatattatcattaaattgatgttaaaccaaagacaaaggctctcctaggtagtgtccattagcattttccagcagggtgaatctaggtctaggaacaattcactgaatatttgcctaagggttttcactttccatgttttacacaatataaataatttaaaatcccccccctttttttttttttaaagagatggggtttcaccctgtctaggctagagggcagtggtgctatcatagctcactgcatcctctaactcctgggctcaagcgatcctcctgcctcagcctccagagaggtaggactgcaggggtgagccaccatgcctggataattaaaaaaaattttttttttggtaagagacagggtctcacgatattgcccagcctggtcttaaacttaaggcctcaagtgatcctcctgtgtcaggtgtcagccagtaatttaaaatgttttgttaagagtagtctctctctttccccactttgttatagatctgagtcatttgctttggaataatgtgataaaagtctaagataaaggattgctagactaatatttagacatgtttgtgttgatgttctgtacaggttgtagttttataggctagaatagactaaattttgaagggtgattagttaagaatagactaaattttgaagggtgatctgaaaagactttatattgttcttttgtaaatcttgagtaaaagaaaataaccaaacagggtagtgagtagagagataaatgaatcccttaagagaatgatagtaataaaggcaggtggaagtaagatcagagttagaaaatcttagatttgttttaggttataggaaaattgatttattttacatgttggtaaaaggcacaagaggcttctttttacattttactttatcaaagtgaaactttttcatttgatttttaaattggaacacattaactgaatggcataggatatatcatagtgatgttgtttaggtacatggtaactgcagataggtctcaagttgaccacatttgaatgttacattattactttgtggatatttaaagacagatggcttgaagcctgagaagggggaaggagtgaaagtataggagcaagtggtggtaatttaagaagatcctcaagtagaagtctgattttgtgatttcagagtctctttaattgttaatgttactattattaaataacaggtacatatatcctaacagtataaatatgaaccagaaaaatagtataagaatgaaccacaggccgggcacggtggctcatgcctgtaatcccagcattttgggagaccgaggtgggcagatcacgaggtcaggagtttgaggccagcctggccaacatagtgaaatcccatctctactaaaaatatacaaaaattagccgggtgtggtggcacgtgcctgtagtcccagctactggggaggctgaggtgggagaatcgcttgaacctgggaggcagaggttgcagtgagctgagaccacgccattgcactccagcctgggcaacagagtgagactcctctcataaaaaaaaaagaatgaaccacgaaaggtagcatgccttgcacttttaaaatgctacctataaggttaaatattttgttatgaacttaaaatgtgtacatacacatttatataactcaacaattgaaatgaaagtttcatgaaataatacttgtctgtactgcctgtgatgcagtatactatttttctattctgtttcatttttaaaaaggttggttgtgattgataatattgatttagtggcttgtgtgctgtgcagtcttagcaaaaccgatgtcgattcctgctgtaatttagttttcaacaaacttttttttttaatccagctctttgctgggtgctggggggatacaaagatggataagacatagtctagtgctcaaggagccacacaatggcatggagagtaatgaaaatagaagctgcaatgctgtaactgccctaacagaggcatgcccagcctgagatggaaggggccacatcatttcctagcaggaagatggcagtttcttctaggttcacagattactactgcgtataatctgataatccctcttatgacgggcttaccttgatgggaaagttagttttttacctagattttataaaaactaaacaataatcaagtttacttgaaaataagatatttttgaacttttagcttactggccaagtttgttaaaaaataaatattaatcttggcactttgggaggctgaggcgggcggatcatgaggtcaggagatcgagaccatcctggctaacacagtgaaaccccctctctactaaaaatacaaaaaattagccgggcgtggtggtgggcgcctgtaatcccagctacttgggatgttgaggcaggaaaatggtgtgaacccaggaggcggagcttgcagtgagccaggatcgtgccactgcactccagcctgggcaacagtgtgagactctcaaaaaaaaaattaataaataagataaatgttaattatatagataatctttaaaaaaattaaattttacaaatgagtaatattttcctaaatatgtcataggaactagctttaatattattattggagaaatacttctttcctgactttttcccccctcagtattgtgacttattaagaaaggtaaagtcaggtagaagtttaatataaaaatatatttgattatttgtacagatggtaaattaaactgtaaaataaaccattaacttttaaataatggaataaaagatgggtacttaattatccaacacttaaaaatgatttttttaaaaaattgcaacttgtgtatattctgtatattgactttttatctcacagtgaattcacaataatactgaatctagacgttaatagattagttgcatattatccaaaaaacataaagcatgacatttctatagaatttagtttctgtaagttacgcaattgttacaggtttttcctgtgaaggataggctgctacctcaggttgaagaagctaatgttggagtgaatgtggtggttgccttagaatgattttgccggcagcagtgaaaaatgttttccttatagttcttgtgcagcaggccatggagtaaagcacatttttataataaaggtgatgaatttaatcgcaaactggcagcctaatggaaattgcagaccttgatactgggagaaaattgcctataaagcaactcttgagagaacaggctttaaatttatccacccattttgacattgaggagaacattggaatcatagggtattttgcttggcctgcttagttcagatgaatgacacttgagtattctatttaagtgttagagatggtttaaagttaagttttatacattaaagcctttagcacatgcatttttgtattttataaagtatttaaaattttgctggtttttaacattttagtagatgatatgcctaatgaaatccatttgccacgtttctagtcatatgccgtgtatttcatgtttctgctgtatatatgaggaactgcaatcttaaaggatatagaatattgtgggcttataattaacactactgacagaatgtttgtcatataaatgatcagtctttactattttctattgtatttaagccatttatattataatatttaaacacagaatggtagaaaatttctattacaggaaaatctgggtttttgtcattttttactctaagtgactaatgtttgtaatttcttaggaataaccaaacccttgattcagtacacactatttaaagtgtttaatccagaatttaggtgcattgtagtgtgtattttgagatgcctgttctgtcccgcagtatacatgcttgttaacagatagctaatgtccaagttcagagaattatttgtggctattggaaacatttacccatccaagcaaggtaaatgtttaaaatgtagaaatgctgatgtaaaatataaaaataacatttctcattatacttattgaaactactggggtttaaaggtaaagaagtgttaacttctagaaggttattcgattttgcttccatacacaaccctgattcttttgactgtagttttgggcagcatggtacattacataataagggtatagctgtggtagatctttgttctctttaggtatagaattggagaagtttaagtttaaagcaagtatgagagcttaatattttgatggagaaagcaagaaaaacgttttacaaattctctattcagggaacaacttactgaggtggtcatgagactgaaggtatgaaaaggaagaaatggcaaggtgcggtggctcacacctgtaatcccagcactttgggaggccgaggtgggctgatcacttgaggccaggagttcaagaccagccaggccaacatggtgaaactccatctctactaaaactacaaaaattagctgggcgtggtggtgtgtgcctgtagcaggagaatcttttgaacctgggaggccgaggttgcagtgagccaagatcactccattgctttcaagcctgggcgacagagcgagactccgtctcaaaaaaaaaaaaaaaaaaaaaaaagggaagaagaaatagaagtattccttttcttgctaaagcaagaaccagtaaattgtatatttttcattgaaagtagttccatctaaattaagagcctgactttttggagaatgattacattcataggagaagagcatgtaatgttggagatacatttgaatgtttagccatctctcaatttccatggagaggagagttcaaaataaatcaactctttaattcccttatcggtgacatagatacttggtcatttgttttatttggctgaaggaagctgtggcaagttgagaattcagaggtaaagcctttgtgagagagatgatgtagtttaattattttaactctagttctcctgatccaggaaagctttatttttactttcagatgaaaattaaaatttgttgcaatttaacgtgtaacacgaagctagaataaggtatatacataagctatatatgtatataatttaaatgatacaagtgatgtatgtatacatatagtacttatgttaaaattttactgtttttctgtaacaggctataaatttagtgtatcgattatcaaagtataattagctgaatataattatttgtttatgagatgatactaaattcagttcccatagatactggtggtgatttactttttaaaaagagtttttcttgttatgtgcttaaatccacacccgaaatgtagccataatttagttcaagattgtttatgccacagtctggaaaacacctgaagtaattgagatttttgagtggttgtgaatggattttagaatcatgtgttgaacagtgacatcactaaattagccatagtaatgttactgtttcacattgagggtttcaggtgtgatgcttttcagttttttgtttttgtttagataactattttagggtttgagttatagttatgcaaatttacattacggtaatgcaaatataccttccaaacttgtgtcaatatgtattagacgctaaaatgccctcccctcccatctctgtttccctcaaattattcatttgtggttaaactaattttaaactccggaaaagtggttaagccaaaaaaggtcagatcctggaagaaaaagctctgaccttttaaaaagagtgttggaaaagtatttgacggtcattttcataagctaaatgtactgtgaggtttgtgtttgagtagcttttaaggttttctggattatgtggttgaattttaaggaggaacttagtaaaaatgagttgggaaaattaacctgttacattctaccttccttttgctatgtatagtagatctacatgtgagaagtcatttgcaaacagcatttgttaggtgtcttttctaagtattttttatgcctacaaagtctgggaaaagaccattttcagatttcagataatatttcagataaataatgatcagatcagtagatactgtctttcagatctatcagaacacagtatttccagaatataattttacatcacagtcatcatttataatgacattgatgaccagtactattattattttaaagagaaagatatatatacacatacacataaagtcatgcattgcttaaagacagtgatagattctgataaatgcatcattatgctatttccttttgcgaacatcatagggtgtacttgcataaatctagatggtatagcctactacacacctcagctgtatggtatagccttttttgttcctaggctgcaaacctgtacagcatgctactgtactgaatactgtaggcagttataacacaatggtatttgtgtaaacgtagaaacattctaaacatagaaaaggtacagtaaaaatgtggtataaaagataaaaaatggtatacctgtataaagcacttaccataaatggggcttgcaggactggaagttgctctcggtgagtcagtgagtgagtggtgagtgaatgtgtgaaagtcctaggatactactgtggatttaataaacattgtattcttaggctgccctgaatttataaaagatatttttcttaagtaataaattaaccttaacatactataactttataaacttctaaattttttaaacctttgactacaattacagtttaaaatacaaatacattatacagctgtacagaaatattttctttatatccttattctataagctcttttctgttttcgaacttttctatttaatttttacttctgagtcctttttgttgaagacaaacacacacattaacctaggcctgcacagggtccagatcatcagtttcatcttctttcacctccacagcttggcccactgccaggtcttcatgggcaagggctgtatggcttaccagtgtgtctccagcacagtgtctgataccacagaaagataggaactactgcattaataatagcagattcttgagcatgtattacatgacagacacctacaaatatttgttgttcaagcgaaagaatttattctatcaaactcagaattttcgctctagaataatccttcgtggtttttttttgttttttttttttttcgggggggtgggggacggagtctcactctgttgcccaggctggattgcagtggcacgatctcggctcaatgcaccctccgcctcctggtttcaagtgattctcctgcctcagtctcccgagtagctgggattacaggtgcccgccaccacacatggctaatttttttttttgtattcttagtagagatggggtttcaccgtgttggccaggctgttctcaaactgctgacctcaggtgatccacttatctcggcctcccaaagtgttgagattacaggcatgagccaccgcgtcctgaatcctttttttttttttttttgaaacagagtctcactctgttgcccaggctggagtacagtggcttggctcactgcaacctccatctccagggtgtgagcaattctcatgtctcagcctcccgagtagcaggtaatacaagtgtgtgccaccacgcccagctaatttgtgtatttttagtaaagattgagttttgccatgttgaccaggctgatctcgaactcctgatctcaagtgatctgcctgccttggcctcccaaagtgctggaattacagacgtgagctactgtgcctggcctagaataatcttagaagtcctcatggatgagtaaatatggatggtgaaaagcttaaatgagaatgtcttgtctgattttcattccacttttaatttgaatataccatttcctttcccccctcattgtatatgtctctacttttttgttctttactttattcatagttctaatttctactcactgccccatcttttccttcttctctatctagctcttaccatctgtcatcactgcttttcccactatcatgatcactcactctagcagcaaccaaatttaactttggggatggagcagtagtgctggagaggccaaatggtatgagtaaaagaatacagcttttggagtcagctagattttcatctttatgtggtctttggtgaaagtacttaatccccaaatctctctttcctaactatgaaatgaaggtgaaaatattacttacctgtaagggaatctacctgataataatggaataaaatgctgacttccaccacagagttcttggggaggctttttatgtggaaagacattagacttcattactctgaattctggatttgtatctcctagccatatagactgaatgactgtagaatccaacataatgcttttaatattggcataacttccttagtttaagttatatgatgagatgtagaaactcaataaaaggtaaaattattctttgtgttatgaagtatgtttagaggtttcttttaagaggtcttattttgctactctgcttcaactatagtttttgttcatttagtttgttatagaactgggaccatgtctgtatttgcacatgactatattcctagggccttggccagtgcctggtacagagtaggtgtaaaatacatagttgttgaatgcatatacgaaaaaaatcattatattgtatcattggtaagacagttttttttttttaaaacaggttatactttattcaggtcagttcaattttgtaaagtttttacttttaggaaattaaaaagcttttattttattatgttctgaatatatttttactaaatatactttgagtacagggttaattaggactgtgcaggctatgaatatagggtttatgataaagctcagtaggagtggatgattgcagtccttttgtgcaatcctggcaggagcagccttttccttattggctcggtttttttcttaaagccaagactaagcacatatttagatgcctgtatattttattttctcatctgatgtaagatacactggaagaatttagcattgatgtaatgaacatatgttattagcaaagtgttctaaacttctcaagtccagaataaagagaccaagccatttgcagaagagcactgtgcatttatattactttaaagggaagaggagtaagctagctagaattgtcaagcagatgccatattgatgcttgagtgaagttacaagaaatatttttggagctttgcgtgtttttgtgctaatagtcctaatatttgttcaaaaggtgttttttctccaaggatgtagatgttacaaatatagcaaaaggcaaaaacaaagctatctgccctctcagctaacattctaatgtcaacaggcaataatcaataaacaagtacagtaatgtattaggaaatatgaattatagaaataaaattgaagggtaaaggggatctggagtgttcctatggattgaggcaagttgctgtttaaaaataggaagatcaaggttggactccttgaaaaactggagcagaaatctgaaggaggtgttagtgtgagccatactgctctttggggaaaagctttccaaggcagggaaagagttactgcaaaaccttgagggcagggctagcaattccttgtgtggacttgtagccagggacggaggttaggttggttaaggacatttgatcagaagggcaaaaaaggtgagggcaaggggagcctgtgtggatgctgtaggctattgtttatctttgtaaggacctgggcttttataccaactgagatgggaaatcattagagcagtggttctgggcatccttttagggaatctgtgaaatcagactatctttgtgataataagatgttatttgccattttcaccaccatttacatacgaatgtacagtggagttttccagaggctgcgtgctatgtgatattgcaacagattgaattcaagagaagagagaatctagctgtctttattaaaacagacatttaaaagattgcaaaagtataaaactgaccttttcagtaatttgtttagttggaaaataggttattttctgtaaaatgtgcatttttggttaatatataataagtttactagtattttaaaatgaaaaaataatttaaacatttttagttttaatttctagcgtggtaagttttattagacataactttcatgaacagggatctctttgggctcctccaattaatttttagagagtggagtcctgaaaccaaaaagtttgaacagaggagtgacatctcacttggatttcagcaggctaactccaaagaataaagaatagactgaccaaggtagtggtggaagcaggtagaccggttaggttaagattaggtaggaaatgattgtggttagagctgtaatgttagggcttgtgatggtgaagtgaaattggggatatagtctgaaagttgagtacacagtatttgctagtggatggaatatgaagtgtgagaatggacttgacattgtgtcattgcccgagatcaggaggaacaaattttggggaaggcttaggagtttagtcttgaatgtatcagataggttgagaagggagttggtgataggatttcattgtggagggttggtctggaatgtccattaccagggtttttgttggattgtattagtaatatatattttttaaatatagtatttagcttctaatcagttatacttttacaatctcaacacagagggctgtattctgcattgaaaaactgattaaatttgctttccaagtatgttattatatgatagaatgtacacttgaagaggcagtaaaaaagtaataaatgtagatttgccagtagcatgacatgacttagattttctgaatctttgtgaagtaaaccaactgtggtttaattaaaggagatcatattgcttaccatattaaaataatgttttcaataccaattactttgacatttgaaggcactgtgtaatatgttggtcttgttacagaccaagatatttttgctgaattttatttttcgaattcaatgtcagtgcttgttgtagttccttttggaatattgtgtatagtagattgtttcttaagcctttaaaaaactcttcaccgggtacagtggctcacgcctgtaatcccagcactttgggaggccaaggcgggtggattacgaggtcaggagttcaaaaccagcctggccaagatggtgaaatgctgtctctgctaaaaatacaaaaattagtcggtgtggtggcgggtgcctgtattcccagctacttgggagactgaggcagataatggcttgaatccgggaggcagaggttgcagtgagccaagattgcgccactacattccagcctgggcgagactccgtctcaaaacaataacaacaacaacaacaacaactcctcttggctttttcataatatgagagaattctcttgcaacacctgtgaatgtcttttgacatgtattttctttcctaaaaatgtcatgaagtgacagacatgtatttgctttgtttatggtattaaggtgatactgaggtaaacctatgctacatgattataaaccttaggttctttctgtattgtacttaggtgaaattttgaatacaatcgaaaaggttaattaaaaatcaaataaattattacctaggaaaaagcaatttacccctacctcctacacagacgtaactccttcagaatttttggggcatcggtttcattttcagtctgatttaccaaattccttttaaagccctaagggatttggagcttcaagagggcgaaatacataggtacagacctttccccacttcttcaagagcaagtgtagaggaatctaattacatgaggatttggtgttttccgaggatgtaatttaaagtaaattctggtggccagtagtagtttaagacattttagaatatatagttctggcaggagtaggatagtctggcctggagttctcaaccagtcattgagtatatacagcccttgcctgtagggggtcagtacagaaggagcacaaaatggaattctctgtaagaagacaaagagatgcattttagggcagatggaagccataaatgtgatgtggtctaatgtgctcatttcgcagatgaagaaaatgagacccagaaggttcagtttgaaggcacacagctcagctaaatcatgctggcgaaacaggagtaaaatccaggttgtgtaaactcaaggccagtgctttttgccttaccacatgtattaggaagataggctttttatagaaaggtcattgttttggattgtaatctttctccaccttctttaaggaaagttcaaagtgtgtgtgttttcttttaaagcagtatattaaagaaaatctaaaacgtatagataaaatttacaaagcttttgcagggaaagtcatctgtagttgaggttaacattagatcttttatctgtggatatttattttggagaagagtaacgaatatattaagcacttatatttaacatatattttggatgattagtaatgattgcttatttgaagaaagcaaatatgtataattaaaattttaacaacattatttaaactgtagaagataccattttgagtgatttttttccctcagttttctttatcttttttcacagctttcatactttgtcacattatttccccccttccctcattagaataaataaccccaaagtccaaagcaaacactttttaattattattattattatttttgagacagggtcctgctctgtcacccaggcgagtgcagcggagtgatcatggaccactgcagcctctacttcctgggctcaagcgatctttccacctcagtcttgagtagctgggactacaggcacaccaccacacctggctaatttttgtggagatgggatttgccatgttgcccaggctcactttttaaattgtaattctttattttgaaataaatttagatttacataacagtggaaaaaaataatgtggatgttaactcatataatcatagtatagttatgggaagcaggaaatgagtattgatacagtgctatcactaatctgcaaatcttactcaaattttacctgttttcctcctcactctgttggtttttctggtccaggttttcctactctgttggtttttctggtccaggttttcctactctgttggtttttctggtccaggattccacattgtatttagtagtgatgtctgtttcgtttcctccaatctgtggccatttcacattctttcatgaccttgacacttttgaagaatgctagttattttataaaaatgttcttgaatttgggtttgtttgatgtgttctcatgattataatgaggaccatttttggcaaaacaatcacacacaagcgctgttgtgcccatctcagtggatcatgctgtggagtatatgtcttttttttttttttttttagttggagtcttgctccgttgcccaggctggagtgcaggggcaccatctcggctcactccaggctccgcctcccgggttcatgccattctcctacctcagcctcttgagtagctgggactacaggcgcccgccaccacgcccagctaattttttgtatttttagtagagaagggatttcactgtgttagccaggatggtctcgatctcctgacctcctcatccgtccacctcggcctcccaaagtgctgggattacaggcgtgagccatcgagcccgaccgttgtggggtatatgtcttaatactggtaatattaactttgattagttggttaaggcgatgtctgtcagatttctccactgtagtttctccttttttccttagtaattaataaatgccttacaggggagatactctgaaaccgtacagctatcctttcatatttttgctaactaatttagcattcattgaatgatttttgtttgcattgatttttactaattaaaattctttaaggaagagctgtcccctttcccccttgtatttatttattcagttatttatatcaatcttttcttatgggttgtaattcattactatcactatataagtaaaaacttttaagaaaagtttctgaaaagttaatacattgagataattcaaaattcagagactcgtaagagtacattttcttctatccctgttatcttgggtacccgtttccattgctaagagtttatttttattctttcagaaatattaaaggattgggaaaagagttgttaataataattgctggattctcaggtatttctttttacctggattctgatgatatcaaactaacttgctgttgcatcttcttcggatattcattaaaatgttacttaactagttcgccattagatttaaatttacatttcagtacagtgactattatatatagatggggactggcttcccctgagtatcctaagaaacgacatgaccagaagaccacattttctattaaataaataatagttaaatattaacgtgtaaaagtaaacaggtttaaaagtaaactcttttttggtaagttgaaacaaaagtcagtttaaatgagaaaggctgcctatccaattaagtaactggtttttcaaaagtgaatgaaggccctccccaccaagtcccccgctctgttctgttcttttcagtgacctattttactttctgtgtctactggcagtatccgtttattcattcaggatgtcactttaggaacctagacctggagttcatctacagaactgtgttctgttaaaatggagtgaaagaaaagggctaaaaagactttctttcacacgctattaaaacagtgaacatactggtctacacttattatagtacagccagcaatacatcaaaaggtggcttattccattttatttccattctctaattaccgtttcttaaaatgaattttaagagtttcttatgccaggaaatcctctatgaaactcttaagtaaagctggttagactagctgtgacttggtccagtttcttttatttttttgatttaccttttctttatttttattgatagatattttacatatttatgaggtgcacgtgattttttttttttttttttttgctacatacatagaatgtgtaatgattaagtcagagtatttgaggtctccatcaccttgagtatttattatttctgtatgttggggataattcaagttctctcttctagctactttgaaatatacaatgtattagttaactgtagtcactctaatctgctgttgaacagtaaaattcatacctttatctaattatatgtttgtacctattaacatacttctcttcatctcttctcctactcatccatccttcccagcctctggtatctataattctactctgcctttatgagctaacttttgtagcttccctgtatgtgtgattgaggacataacgatatttgttaattctttaatcactgagcattagttgttttttctttttattttgaggggacagtaaaaagggtattgtaatatatcctccttcagattctggtgaagaccagttgagtcatgtaaaaaataactagatcgctttatttttagagttgggaggcaatgaattataacatctttattatgctactgtttttatataggcagtcccatgcttgcagtgttttgatgtaagcttttctgctttctactctcctaataggtgattattgtaagaaaaatttatataataacatgaaagcgaaatagtcctcgtaaattcatctcccagagatgattactgttaatagttgtatcttttttgactttgttgtgtctaccaaaaaaatgtatacttaaatataaatttgatcatacagtagaggttcttttctataaccccaggaacgtgtgtgcaacttactgttaggtacttctgtaatacagaactgctgctgagaacaatcaggaaaatcgaattaacattgttacaaagtttttgctgttttgtatttttgcatgtgaaatttatcgccagttgtggacaattgttagttttggtagtacaaagaggagttatgattaatttaattttgtagtttttgtttttggacttaggattgtgaagtacagagtacaatttaacccttggaataaggttccatctagggaattactaatagcttgggttttttttttttttttcttgccagtttgaaagcagttactttgaaattaaatcagatttatttggttgttagagtaagcaaacatatttcacttaatagtctgtactctaggctaggcgcagtggctcacgcctgtaatcccagcactttgtgaggccaaggcgggtggatcacctgaggtcaggagttcgagaccagcctggccgacatggtgaaaccccgtgtctactaaaaaaaaaaataataataaattagctgaccatggtggcgggcacctgtaatcccagctactcggggaggccgaggcaggagaatcgcttgaacccaggaggcggaggttgcagtgagctaagattgtgccattgcactccagccttggtgaaaagagtgaaactccatctcaaaaataaataagtaaataaataatactctagtaacttgctttttaatctagttgctctctgtaccttgtgaacttggcctcttaaaaagagcacagtgaagttaaattccatgggtggttctcagctcaaaaataactttaaaactttctctgtatttagtcaagccttaattaaagtttatttctttttacagaagagattgttgttaaccctaaattcataaggttacacaccagccacctctttatgaagtgacagttcttcagttttaaatagattactaatattattgttttaagatttaatgagtattatctaaataaaaacgagtaatttgttattaagacctaaaataactaaatcttactttgctgtttgtgttagtgagctactttaatgtctagcaagaggtagggattgcagacagtgtggaaatactggagcctatttaagcttcagatgaaagcagtcattttaacttacctcataaaatgtattttatgtatatcaaattatgtatgtgtttatatatacttgtcgttttactgacaactaagattttccataagttaatggaaaatgttaaaaagcacagttatggtcaaatgacacagtgaccttttcattcctttattagctcctgctctagtacaatgataaggcagattttgttgatggattcaaatgtacaaagaaacagcagatagatacccagtgaaaaaatatatatgtctataacatcagcattgcaagttgagcaattgaatcagctaccacaacactaagtataagatgcattttatgtgagtttttcttcagtgttttaaaactgttttgtttttttacaaatcctgaaagtaattctttggtgcattttggctttgaattttacttttcattaatattttgttgcttatgattgagttagtaaatagtttttgtgtttcatttcctaattttgattttcttagtttaaatttgctgaaaaatttctaaaccagaaagtaatatagagctgtatttgattctttggctttccaacattgcagtattgattttatacacagccttagctatgtatttatatattttatgaaatgactgctcaatgctgtaatttagatttctcaccccatatttttttattctcttaacagtttttcctgttcttaattccagtgttctagttttccagtgattgatctgttagttaaatccaataattcatatatatgtaattggatttaacatatgtgtgtataacatatatgtataacatatatatacacacacatatatatgtatatatgtgtatatatatatgtatttcttttttgagatggagtctcaccctgtcacccagactgtagtgcagtggcatgatctcagcttactgcagcctctgtctcccgagtttaagcaattctcctgcctcagcctcccgagtagctgggatgacaggtgcctgccaccacacctggccaatttttgtatttttagtagagatggggttttgccatgttggccaggctggtcttgaactcctaacttcaagtgatctgcccacctcggcctcccaaattgttgggattacaggcgtgatccaccacaaccggcccagtaattcagatattaaaaggatatgtacaaaagtagcagagtgcacgtacaataatttggatacagtaaaagagtagtggtaatggaaaagccaaagacaaacatgagctgaggctgttgaaacatgaaacctaagaattactttaaaaccttttagtgaaatccatagttgggtgaattaaggggaaagaaaaaagaataaaggtcacataaaacagaactgtgcagtgacatcggagcagaattaactgacagttgagccttagtttggaaaagaaaaaaaatcaagataattaaagcagagaaatgtgacgaggcagtaagtagtaacaggttttcaggcctaaacaaaaaatagttttcagcgtagtgaaattcgaaaaaaaaaaagtaaattcaaaaaattgtaggaaatgggaggagcctaaatgctgtaaaggcaaatactccccaaagctgaaaaatgtatatgctaaatttgatggcataacctgtagattcctaagcagattatttcctatttaaactggtggctccagaaggaggttctggtcccattgtagcttgggatttcatcaagtagtagataaagatgtgcctgtattttgggatctgggccaaagaaatctgtgctctataaaattacggttggattcttgactcggagactattcatccttaaagaataaagaatatcagctgatagattaatatcagtctgctgaagggatatgtgtagcagaaaataaccaggaaaaaaattgaaatcttctgttggtgtctaaacaaacagttgtggaattatggaatggtagagacttgtcttaacaccattagcaaaatgtcagcagtgtgctgtgtttgccaaggaagtaaagatattcttaaacatcatcacctcttaaacagtgattatggatggggcagagtttgggactagaatttgatagcttcagttggcttatccattgatcattatggaatgttgtgtacagtatagggttttgcatattaaaagggacctagacagatcagagtgcatctaaacaagtgggagggtataaaaccatgtcattggtttagggaagaggacacttagatattttagaatttttccaatgtttatggggctgctgagttgtggccaatggtagaaattttaggagagcagattttggtttattaaaacaaatttataatatttaagatctttagagatgtctaaaaatttctcttgatactggggatatttagatagaaaatacatgcctggggttcatgttgggagattttttgtactatgcgtgattaagcaaacggttctgaacttcagttctctgaacaactgctgcgggttgttgaaggtagtgcagttggtggtggggcatttgagtgttgtaatgtttgatacagcaaaatagtgtgtacagcatattagttatgaagcattcctatgtttcatgagaacacctgtgaagctattacttacaaaaggactaaagcatttcccaaacccgtactcgttgcatgtttccatagtagtttggctataattgtatcctcctgctaggataacattcccagaagctctgattgccacgacttacaaatggaaagttttaaagacaaaacttttaaaaacaggattatggagaaaaagaataaatggggctcttgcatagtaagattggaaaccagtggatttagttcattcattgaataagtatatgaagcacagacacagagaggttgtaagaaagagacttgtctaaaatcacagttactgttagaactggaatcagaacttgctctgactcgagtgttctgaataacaccagaatgctgatgattttctacttttttcccctgtttataaaggtagtacatagttggccaaactcaacagtgagtaagatttttaagtccttgaggactggaactatgtcttagttaccttttcattcccatcattactatcttatacattaatttgtgttctgttatgaaattgagtgatatatcttagagactgaaaaaaatcgtggtagaaagacttcttatctgtcttccttattagaataagttatttgagagctggaaccatgacttgtttaactttaatgctccagaaacctagctctttcttgcctttgtttacccccaccaagtatttattgagggccagctgtgttccaggcactgttcaaggacctgcggacacactgggtaacagaatctcatggaattttgtgttattaatcaaggaatcacataggtatttataaaaatacaacttaagtggtaaatggcttgtatcatctaaccagatagatgcttatatatgaggactgtttgttttatacattttctttttatttatttttttagacagttttttgctcttgttgcccgggctggagtgcaatggcaccatctcggctcactgaaatctccgcctcctgagtacaagcgattctcctgcctcagcctcctgagtagctgggattacaggcgtctgccaccatgcccagctaatttttgtatttttagtagagacggggtttcactatgttggctaggctgctcttgaactcctgacctcaagtggtctgcctgccttggcctcccaaagtgctgggattacaggcatgagccactgcgcccggcacgtttatttaattttttaatctagtcattttatctgaattttctgataacttgcaatagattcttttgttttttttttttctaagtttgataaatttgtttatctggaaaatcagtattttttcttccctagatttattatattactatggttacttataatagtagatttttcaatattgaactattcttgcactcagggtataaattctactatatcttagtgcatttttctttttctatttatttcagatgtttgcatctatatttttaagcaaattttatctatagttttctttcatgctgctattctcaggctttgatattagtgtggtgctaactgcagtaagaataggtagtttccgaagaagatatttaaataataattatatggaaagtgcttttttagtccagagacctggctaaaggatgtatgtgtgattttaattagattaaatttttctaatgtcccttggttaattacttgctgtaattatgtaaatgatgtaaaggagtttaaattgttgcttggttgttgaaaacttgatttgagaattgctgtcatatgctaatttaagataaacaccaagttgatactggacattattaggaaagatttaattatgaagctagaagtataaaaagaaccttaggaaataataaaattctgcccttatcatgtagtcaaatccaaggtaatctctagatttttgttgattttatttgctattcagagaaaagcatttcgtaagctttgacaaacaaattgttatttaagagataaaatttgtaatatgaatattggtatcactgaagcagaaaatgtattacagtgccttttttaattgattaagattttataactgagtaagagtacctttgatcctgcctttttgctgtgttggattttatttaaccgaaactgatttaaataactagttagaaaaattaaagagtgccttcatatttgatagttcctaaggaactatcaataaattgaacttccccatgtttggaaagcatacaaaatacatttaaaaaatacattttatttttaaatactaatggatgcaagcctttctcccaaggaggacacagtctgtaggatagagagacattacatctgcatctggctaaccttaataatgacaacccttattgggcagtatgttccaaaggacaggagcctgtcttctggtgcatactagaagcttaataatttttgaaaagatccattttctttatgggactcggctcattaaaatagaattctcctacttttaaaaaaaatgtctatgtatatccaagaacagtaatacaggtctttaaaaacaggtcattgattttaggtattgctacttccttttttatatttaatatttcaatcattaacccagtgtagcttgatctgttaccctctttcccttgaaacttctctgatcaccagtggcttagtggtcaaatccaaggtaccatcttttgctgtttatcttacattcttttgtagtattcgatactgttggtcaccctgtccttgaatctgtcatttcttagcttctataacacctctcttctctagttctcctgcctacctccatttcttcttggtttggatcttcttttccttaccccttcctttttctcaagtggattccgtccttctttctcccattacttgctctaagacatctcttctgatagctttaaccattaaatttgtatatgaaactcagacttctgctgaacttgcagtctgttgtcttttgaacatctctgtttggatattccaaagatatctaaaaataatggaagtggtcccgtttaaatatccttcggacaaattagttctgaagtacaaaagaggctttggtattagttttgtctgacaggcattcttatagttgtttactgaagctatgatttggaatgactggcctcgtttagacttggaaaaattagatgaactaacaagtccatattataccggttaggaaggagctcgggctttgaagttaatttaataagatatgttatttgattcgtataaaaattggtttgtagtagaaattaattaaggctatagtcttgtttaaacatgggcttaatccagagaatgatagaataggccaggagctccttatttgagttttaatgctttatcaatgaaaccctcccctgccctctcttttttcctctggactagcaagaatattttttttgtctaacacatttaaaatttttacttttaacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagatgtaagtatattttgttgttttattcaattttgttctgcttcacatatgttgggaagagatatatttggtggtaaatacttaagcattattagccactttaaaaaaatgcagtcatcaactgaagtgtgaataatttggcatgataatttaaaaaatttctctctaaatatgtttgcatttgattgctgctatgtcactttggaaatgcacatggtatagactcttgggtttcaaaactggatgaggaattgtggaaagcactatggcctgactgacacagagcaccaagcacaacattgctcatctttaatctgaccttcaagaagccacagcttgggccacagcattctttctgtaaaatgaaggtgttggaccataagtttcctttcagctctaaaatttttattgaaaccactgattgtaatctgattttcccccatcttagtccattgttgaactattctctataagcatcttgttgtgaatagcctccttgtcctatatctgttaatttctaaataaatccagattctttgctttttgttacaaagccctatatgatacggtccattctatttctctggcctcatcttaaatgattttccctcttctttaccacactgtagtcacattgaccctcttttggcttttagaataagtcaagtctattcccagtcttagggaccccatgttagttgtgctctgatctctactggctggctgcttcttgtcattaagaatttagctcaaatgtcacttcagagaggcttcccctgacctttttatttaaaagccatctatctagctactcactgtttcacgttgtctttttttttctttgcaatagcacttataatcgggcatttttctggtttattttctctctctctgtctcccctgaagaatataaggtgtacataaaataagaaccttgtctttgttattcactgctgtatccctcataatattggcacataataggtaacaatacttgttgaatgaaccaagaaaagatgatggctttttgctaagtttcagaggacttttatgaaagcagatgaaaaaaggagttattataatatcaaaaatatgatgtgctctatgattctttagttatatggacagaatactagtctgtagatgagaaatgtcttaagttgaattaataggaaaaagctttgatattttacagttacattacaatttgcaaaaattgatctgatacttttttttaaaggttatatacatttactctggttttataggtatttttggttgcaaatacacaaatagtcttggataatgtaggaaaagaggagttggttggaagattattgagtaacacagaggattaaaggaatagttggaaaacaaagtgccatgttaggctaggaatcagggcatctgagaacttgagcagcaggagtttgtggagcttctcggttgagagccttgctgacataacttggcattggtgcctcccagactttatctttaaaattcagattcttagaagagtgaatgtgttttgggcctttctgactggggaagtgaggttatctaccattacctagacaggaccactgtgagcctaccctaggtattaggattattcctagagatgggaaattgtgatttgggcagctgttccaattggggtctactgctgttaggtttttcactatcctggaaaggatagcaactgtctgttttgcttatttaaacgttaagggataatgtttctgcagtgggcattaacatagaatatgtaagaccacaagaccttgatagagaatataatgttaatctgtctggttccatctcttaaaaaaagaaatcctattcaaggaaggggtatttatgcattctttaaaagacatgggtttcatacagtcttctaagtcaggacttgagtctagagggcacctgttcactatattcctttccttcctcctccagttgtgacttcttgccacggtgaactactattaccgactggtgtgttggagcatggcatttgtcttgatcggtgattctcaaaacacagtccttggaccatagtatctacgctttctgggaactgtaaatgttcaagcccctttccatacttattgaatcagaaactctggggtaagggcgaggcctagcaatttgcctgttaagccctgtagataattccgatgcatgctgaagtatgagaatcactcctctaatttttttttttttttttggagaggggacagggtcagccaggctgacaggtaggtgatcatgtacctggtcattttgccaggcatcgtttcaggaggcctgaaacagtaagtggtgaagtgatgaattaaacagtgtcactggtcttgtggagtggacatttcagtgacaaagacaaacagtacacaaatgaatctatagctgtaatcagtgttatggagaaacataaagtggggtagacagatgaatagtgactgtgtatggaaggaggtattcatttttaagggtaatcagggaagaaatctgttacaatatgatgggaatggagagacaggaacagaatgatgggaggaaggcatgaaaaccatctgggagaaaaacattctaggcagagtgaacagcaagtacagctgactcaggcaggaatgtgcttgggaagtgttgtaagatgtgaggttagagagttagcacaggggcagtgtcatgccgtggtcaaaagtaggaactcagattcagacttctagctagttttgctgcttgttttgtgactttggtactacacttgatcttaaccaaaaggccaggaagtgatgatgttttgtgactttaagcaaattacttttcattcctggtgttcgcttttctcatttctgtaatggagatattaaacctctcacaagattatgaagactaaagagttaatatgagtgaagcagttggaaaacatctttatgctatgtgtcacaagctctatgagggcaggaatctttttgtctttcagtgctgtatttctagtgcttagaatagtgtctgataaatggtgtattcacaataagtatttgttgcacatatttgtatgaaactcattctttcaaatattgttaaacttttctttttctttaaacctgttgtcttttgcatttgcacatagcaccttacttacagaagtcagtgttaagttagagatgtgttttggacttggcagtgcagatctctgaaactgatatgagaagaaagtctcagactcaaggtctgagaaatgaagtagtgctatagtctgtagccctttgcaacgtttttgaagtttggcctcatgatgtgagaatgagaggctaatatgaataggccactgaaaatgtattaaaattttcacagaattaatatttattaataaagcagacttctattgcatctctactgtgtaccaagcacatcctaggtaagaatatttaattcttttgaaaaaaactctttgatatagtaaagacaataggtttcttagtcaggcctaggttttgaattctggcttatcctcttattggctgtatttgtcaacagttgccacaataatgctccatgataaaacactctaaaactgggtggcttaaaaataataatcatttatttctgtgctcatgggtctgtatgttggctgagggtctactggttagggtgaagcctagcttgattgaggctaactgggtgggtttagatcttctccatttatgttcctgctgggcccaggctaaagcgggcagtggctgcttagggcatgctcttatggcaggccactggaatgcaagatccaagccaaactgcataagcaggtataaggcgtctgctcttgttgctttccattagcccagtgattctcacctggtggcagttttacctatggggacatttggcaatactagagatacttttggtgtctaaacttgggagagggggtactattggcatctagtgggtggagtccagggatactgttaaacatcctgtaatgcacagggcagtcagcctccgtgcacctccagccccccaacaaagaattacctggacccaaatgtcagtagtgctgaggttgagaaaccctgcgttagtgataccaagtcacttcatttacagagagaaggggactgaaataaatatttgccgaaaaataattgagatgatcacattggctttgagcatatgcttgctttttagaatctgtttctttgtctatgaagttataaggttcacttcataggattgttgggaggagtaaaggtaacaaatgtgtgacatctgatagagcaggcactctgtggtttttgtgattacacataagaaaaataatcctgttcttgaaggagttcagtcttgtgtgaaggataaacgattaaattattgaagactttaagtttctcatgcattcatgaaactacagacatgaaagaacattgaagttatatttagaccatcaaattgtttatttggctggtcaggttttcttgtttgaatccatggagatgtgttataaatgattatgaatagagttaactgatttatttaagtaaaaagtgttatattttgaatgagtcagtaataattttgtcattaaatttgcctagttatcaatttcaagttgttagaaattgttctataggatctgccagagtagtagacttgataaatattggcaaggtctagctgttgatgatactagtcgtcctgttaaatacatgaacagattagattggtaaactgcttcctttggacatgatgattaaattgtagtgagacttcttggagttttatgtgaatataattctgattttctgatgtttttaaaatgggatttaattttgactaatagctttgaaaggcatctcttgggtctaggccatcatgaatacccatattgtcaaaggttttgtaagacagacaaatgtcttttcaaggattgtgttttcagcctgtaggatcccagcctggttgctatagttagtagtttagattcataatgttattcacagtacactccactgtctctcttataataatacatgttgatgatggaacacgagttgtaagttctctttctgtttcattttcctgggtttgcaaatcagcttaggctcgtcatagcttctgagttagttagcatagggttgttgtttgtcagcagtcttgagaagttggtgtcaaattgggtgttgagctggcgtttgttttagagggattatggggagaggggccaattcagtaagttatctttccttaaagtctttgttcctttgaccattgcggccttcttattgttgaaggatcacgaacttcaggagtcttgatgtacactactttcactttcattcttctgaataacaaatgatattaaatcaaaatttaatgatattcaaagtctcctttttcaatacccaggttaacacttgatttttgcctgaatatgatcatattttgtgagtgaaaataataatgctttaaaattacgatctacacatctgtctttgatagtttgtacagaaatctatttaaaggtagtttttctcaaaaggttagtacatatttgtattcagtggagttgtgaagtgattcagattacatattaaagttttaatttagcagtgtgatttgataatatagggcatatctttatgttttaggtagggaaaacttaatgtataagttcaactagatcggtttagtaaaagccaatttatgactctttgttttgttttgaagtttcctctttatttcactctgtaagggtatatttagggcctgttgtgtaccaaatatttcataggctttttatggtttgggatataccacatttcttagaatgttagtaaataattacagaaagggttacaggacagtctgaaaacaatacattttgtttagctgatatttttccaacgtttaacatttctttaaataataaggcctctctgagttttaaaaatgcaggcactttcttttataaataatatattttagtatttgataggaactagtgcttagaagaacaaaatgaaagatggggttgttagggaagaattattcagattagacagaaacgtttgtctatggtttatctaaaaagagtttcatgttaggatctactctgttaaaattactgcttcaaaggacttatggataatttgatatctactcataggtgttcaatctccatatctcttaagattcttgctgaaatagccaaagtatgtaatatggaaatcgaggagaaatctgcttctcagtgctatccatattccaggaacattgagctgtttctgataaagattaaaggaaagctcaaggtgatgatctactttcagcccaatttgagagagcagtgtctccgggagtaaaatggctaataacagaatcttcctcatcctaacccctcagaattgtcacacatgaaatgggctatgaagcagtcaaaggttatactgcttgaactcttccactcatttcagttcctgtttataagtaggtgacctaaatttattttgtaagttaatgagactatgttttcttttgatttcagtttgggcggaaaagtaccttagtttttgagatcacgtgcctttactttagggatgttgaggttgagtttttcagctactagcttttgagataaattcagttaatcatttcattgggaaaaaatacatatatatttaagtaatttttgttttgttttatcttagagacaaggtttcactgtgttgcccaggctggtcttgaactcctgggctcaagcaatcttcctgcctcagcctcccaaagtgctgggattacaggcgggagccactgcgcccagccagaaaacatattttatgtcttaataaacccaggatttacaacaaggtagcttacaaataaattggggatttcttgaaatcttgttttgtctgccatagaacactgcttttcccaagtccaaaatcagtgtcatcaataagcagcctgtctatcataaacttgggcatctacttgtttcatattggtataatattttctttattatttggtagggaattgattgactttgaaaacttctatcctgtattgtttggggttacagaacaatgattgttttgattagtttctttgtacttttaagattgcatataaatagtataaatttgccatgttaaggacagattaaaacaaaactcttaaaatttgaaaagtagttagaacttgaacactaaaaaggatatctgaatataaaacagcaaaattttggtatcatttcttcatcctggaaatgtttgtgtgtggtctgtgctaggtaacaggacacaggaatatgaaaagatgtaattgctctcatggtactgatatagccacaatcctggtatggaataatgagagcttgaactcaggcaatggcagttgaaatgaaaagcacaaattaaatagggagaattttaagatttctttatcttttacatgtgaaggctaagaatgagggaagggccttgctggtattgccattcgttgagaataaagatgtatgtgatgattattaaagtggtgacaatcagtaaaacatatgaaaatattgagaaaccaagatgtgattatctgaaatgatacagtaatgatatgtttgggatatatgtaggtggggaagaaatgataaaaacacaactggactaattctgaaagtaaacttggatttgaatagagtttctataaactgagtactaaacattttgaaagattaacaataatgagaaaactaaccatgaatttttcttgttatcagggtatatgttaaggtcattagaagagaggcattatactgtattaagtgtctgaactctagaatcaacctaggtgttctaggatttgggctactgatgtaacctcacatgtattagatgtaggtggtagtggtaagcactgtgcagtggtgtttcgaggattaagtgacctaatgcatgtaaaatacccagcccagaagttggctcatacttgaacactcaaaacatactgcagcatactcaacaccaaagaaatgttgaataacgtagtccttgcactcgtgatacttcgatttgacaccagcagcaaaggggaaaaattaataaccagttataaccaaaatttgaaatctgtggtatgcgaattaggatatcctaaattacggtgtatcattctttgagtactgatataactggataataagctgaaaccattcaaaacaaattcacgtgaggaagatagattatcactctagatgctaagtaacaattagaaaaaagattatttaaccaattaataaaaatacgaaggcaataaaggtcaacaagtgttttatgacaagagcagaagacagtatttgtgagagtatgagatccaatgcacaaggccttttgaaagatcccaaactactttccaagcctttattttgctgctacccatgttttctagccacctaagcaattcactcttctgtaaaaatggcaggtacttttaatttttcttccctgtaacacttcttttcttatttcttccttcccaccaaacatgctcagctccccctcatcccacaatattgagctgtagtgctccttttgctatttgtatgtgctttgactcctacagacagttgtttccccttagagtactttgtacccacctcttaagctgttatcacatggtatgcagtgatctgcctgattcttgcaggtcattctctgaagtcaggaactcgctcttagtcttttattttttagaaatctatgatatctcgcgcaatacatagcccatagaagaaactatgtagtgaaattacatagtgatttttcattctcgcagtaaaaatttcctgggattttttttttttaatgggtgggaaactacctggaaatagtggatgccagagtcttaaacagaaggaatgaaataataaagatcagagcagaaataaatgaaatagaggccaggaatacaacagaaaagttcaacaaaacagagttggtttttgaaaaggtaaacaaaattgacagacctttagttggactaaccaagagaaaaaaaagtcaaaatacatgaaggagacattacaactgataccatagaaataataagatcataaaagactactctgagtaaatatatgccaaaaaattgaacaaactagaagaaatggataaattcctaaaacatacaacctatcaggaccacatcatgaaggaacagaaagtctgaacagacctataatgagtgaggagattgaatcactaagtcaaaacctcccaacaaatagaagcccaagagcagacagcttcacgggcaaattcctctgaacatctaaagacgaattaccaccaacccttctcaaacttccaaaaaactgagcaggagagaacacttcccagattcattttatgaggccagcattacccttaaccaaagccagataaggacattgtaagaaaataaagttacaggccaatatccttgatgaacagttgcaaaaatcctcaacaaaatactagcaaactgaattgaatagcacattaaaaggagcgtacaccatgatcaagtgagatttttcctctgaatgtaaaaatggttcaacatatgcaaatcattaactgagctacaccaaattaacagaatgaaaaataaaaaccataagatcatcttaaaagatgcaaaaaaggcatttgacaaaatgtaacatcctttcacaatgaaaattctcaacaagtaaggtatagaacagtatgccacaacataataaaggctatgtgtgacaggcccacagctgacatcatacttaatggtgaaaagctgaaagcttttcctctgaggtcaggaagaagacccttgctacttccattaaatatggtaagttctagccagaacagttaggccaagaaaaagaaataaaggcagccaggagtggtggctcatggctctgattcccagcactttgggaggctgaggtgggcggatcacttgaggtcaagagttggagaccagcctggccaacatgaaaccctgtctctactaaaaaatacaaaaattcaccaggcatggtgatgcatgcctgtaatcccagcttgctcgggaggctgaggcaggagaatcacttgagcccaagaggtggaggtcgcagtgagctgagattgcaccattgcactccagcctgggcaacagagcaagactgtctcaaaaaaaaaaaaaaaaaagtaaaagacacctaaatcataaaggaagaaataaaattatctttatttgcagtggcataatcttgtatgtagaaaaacccaagacttcatcaagaaatctgttcacttagtcaagttctgggatacaaaaatcaacatacaaaaatcagttttctgtctatacactaacaacaaactattcaaaaaagagattaagaggtcaggtatggtggttaacacctgtaatcccagaactttgggaggccgaagcgggcggatcacctgaggtcaggagtttgagaccagcctggccaacatggtgaaaccctgtctctacaaaaaatacaaaaaaaacaactgggtgtggtggtgcaggctgtaatcccagctacttggaaagctgaggcaggagaattgcttgagcctgggagagacggaggctgcagtgagccgagatcacatcactgcactccagcctgggtgacaagagcgaaactccatctcaaaaaaaaaaaaaagggctatctcatttacaatagcatcggaaagaataatataattagaaataatacccaggaggtaaaagatgcctgctcgctgaaaagtataacactgatcaaataaattaaagatgcaaataaatggaaaaatattccatgttcgtagattggaagattattgttaaaatttccatacttcccaaagcaatctatagatccagtacaattcctgtcaaaattccattggcatttttcacagaaataggaaaaaacaatcctaaaattcacgtggaaccacagaaagcacctaatcgccaaaacagtcttgagaacaaagctgaagacattgcagttcctgatttcaaattatattaaaacaatttgcttctggcataaaaacagacacatagaccaatgaaacagaacagaatctcagaaataaacctatgaatatagagtcaactaatctttgacaagggtaccatgactacacaatggagaaagaatcgtctcttcaacagttggtgctgggaaaactggatattgacattccaaagatgaaagtggacccttacttacaccgtacataaaaatttagtcaaaatggattaaagacctaaatgaattccctgaaactataaaacatgtaggaaaaaacactgaattataaaggtatttgatactggtcttggtaatgatttttctagatattacacccaaaaaacacaagcaacaaaagcaaaaataaacaggactacatcaagctgacatgcttctgcacagcaaagaaacaatcaacaaaatgaaaaggcaacctacagaatgggaggaaatatctgcaaaccttatgtctgctaagggtttaatatccaaaagataccagaatattaactcagcccaaaacaacaaaacagcaaaaaaaaaaaaaaaatgacatcacccaatttaaaaataggcaaataacttttagacattttttcaaaagagaatatacagatgtccaaaaggcttatgaaaaggtgcttaacatcacacacacacacacacacgtgcgtgtacatgcgtgggcacagtagctgtgtgggtgatggatgtgttaattagcttgattgtggtaaccatttcacaatgtataccttgtattaaatcatcacaagttaaaccttgttcattatatctcagtaaagctggagggagggattcagtcactaaattgtaagttgtatgcagcacaggaactcatatgtttagaactttctcatataataagcctgactggctgttctcaggataaatcccaaaggacaaagtcagtaataaaaaacaaaacagttactatttccactttctatttcaacatggaagtatgcagctttaaatttttgttttgtttttacatagccttgtaagaaaccttttcttacacagcacttgtacgtaacatgtgccatgtgtgctatgaacaaaaatgtttataaaggcctaatatgtgaaaggttttgccaaatgtttcctgtaatgttaattatattttataaattagctatttctccaggagatgtatttagccacttattaatttataagaattaatatgaaggtaacaaggcataagatgctcgttttccctcaaaacacaagacattttggtatatagtctccaacttacaatggtctgacttaggattgtttacaatggtttgaaaggatatgttttcagtatgcttctcaatttatgatggggccatctccagataaaaccattgcaactgaaaatatcgtaaatttaaaactgcactttcaactcagtggtgggtttattgggacttaactccattgtaagtcaaggatcatctgtattcattctgtatttttaattaaaaacagttgtgctgttaatatatagacacaactcttctctcatcttacatacttgtataagataggcccactagtgttgactagattgggtgtggtccgttttttgtcttctgctaagtgaaagacttcagaaaatatacatatacgcttctgtgaatgtatttgtttcatacccactgtgttgcttatgtgatataatgaaagatttgtaaggcatctaactaaaatcaccctagaaataactagacacaatatttaaaaacattatcaatctgttgtgcaaaaagcaatccaaaaaagtgcattttttaaatgaaaacttggtctctccccttgtccccaaattttaggcacagattacactttatcagttcttagaagtgtttcacttgaggtgcttttcgaaatccattttttattatctattgtgataatgtgttgcaggagtttatctttaattagggaattttaaaaaggttaatggaagggttttctataatgctttacattttgtcattgggaaaaatctatcatttccatttaaaatgaagtgtgagcagcaatgaacagcattagacataattgttgttaaacctcttctttgtaaattaacatgccacttggcagaaatataattggtgagccacagagaaggtctgtatttaaacagtagggttaatgaatatctttttttcccctttttctttcccttcttttggcctttaaagttgcacttagctcaggctgtttgaaatgattttctttgaaagtgttgtgacattgttttaattgaatgaagctgcagaactggcgtgataaatcaacacagaatgaattttaatgcaaggcaaacgatattaacctggaaattggttgcagtagacaaagcagctgctgtgattagttttttttttttcttcattctctacttacaacattttgagaaggatgacctcgacaatttcagctgtactagagtcctgatggcttgcaccttaacatccttgagctgtttgtggcttcttggggcaatagtgattgtttcattttttaaggttagtaaaattttttaaggttagtaagattagtaaggttagtaagatttaatgtgattttaactgctttacaaatatttttaatttagtaaatcataattgtgaggattaattagctgtggtagaagcccttttctatgtaatcttgatgtggttccagccaaggagggttaatacttgaaaagcatggggtatgccaaacaaggctctatatgtggtcacagagtgtagggcagctggtttcacaaagggtacgggtcaaaaccaattacatattagtgatttgtactaaagtatctctgttcataatgcatttttccagacatttttgggccatatgtgaagtatataatgtgtatctagttagtgacaatttgggaaaagatctgtatagagtacaactattattgaagagtagctggcaaggttacttaaagaaatagccaaggtaacaaatatagtagaggcattttcacagacttcttgagagcagagtttcgttattctcaatccttcacatttacttcactccttgccacataataagccttaagtaaatgttttgttgaatttgaaaatgaaaggctgttctctgttttactgaaaaacagtgggtgagtgatagcatgtaaagattattatctctgtccaggttggaggagtggggaagtgaaatttaatgtaatctgtgacttacataaactggttaagtgatgatgttgtagaaaaaagtaggaagagcttattggagatgaacataaggccaggcatgttgatagattttctgttatgtttcttttttattcagatcctcatttcaacattgttacaccatactaccttatgtcaattctagacctctttagattaaaaagcaactgctcaaaaagtgccagtagacttgtgtttgttaaggactgacaagataatgcaggccagctgagcaattccaggaaaataggatacaataggaaaaaaaataactgaacacatcagagattgtgaatcagcaagattgtgaagaattactagttcatggtcttcaggaggtgagatgatcaaggatataaccgtgttttgggggatctctttttctgctgagcacgtttgcagaatctggagaggacagacgaaaggctgagctttgggggatagcgtttggagtctataatttgtctatgtgaacctcccttgccatgcccagcctagtcttcgcttgggggtagggacactgatggatacgtactttaggagtaagaatgaactaggaggttgcaggtcctcacagagacagtatctcagctcaaaattgtctatctcagtaagtgaaattgcattgatcctgggttgctagtaatagtaggtgcctggcagaagctgatatgtatctttcctggaggaagatattattgtctttggccttatattatttttataagctatttagttaagtgtattgtctgacacacactagaaaataagcacacaaggagacaagatgacattaacaaaaatctgaagaaacagtctgaaaaacaatacaaaatccacatactctagattttagaatttcagacccagactttataagatctgtaagttttcaatgtggaaggagacagaagaaaaggaagagaaatggaagctataaaagaaaaactaagccagaaaattatttacctactattaacaggtgggtttaacagaagattagaagcatttgaagagagaattagtaaactggaagatagctcagaagaaaattttcagcatggagatgcagagggatggaaaaaagtagaagggaatgtgaaaagtaaaaggaatatagtgagaaaatttaatatatgtagttgtagtattagaagaagaggagaggtggaatgggacagaagcagagtttgagggaagtgtgtttcagaactataaaaccaaagaaagaaataaagtcacagatttgtgaaattgtggttttctttatatttatcatacttactgataaacatgataaaggagaccacaccttggcaagtgataataaaacaactgaaaagtaatgatgagaaaatcttaaagcagctagaagagagaaaagatcaccttcaaaggagcagcgggaagacttagttcacttccattagtaacagtggaatgaatccaggagatggtgtataaagaatctttaaggtgcccttcaaaaataagacattttcagataaggaaaaatggagagagttcattactagaagacgttcactaaaggaaatgctgaaggttgtttttcaggcagaagaatgatgattatttgaaaagttgaagatgcataaaggaataaagagcaacaaaaatggtaaaattgttgataaacctaaatgcatatttgtacaaagtgaaaataatggcctgttgagtttaaaagatacagaatttgaaaaacaaaggcatataaactggattgaggataaatattacactttctgaggtccttgtatttgtatgggaaaagggtaaaagtacaaatgaacattaatgtttgataagtcaaggaagcatgttgtaaatactagggtgaacaagcatataacttccaaactaatagaagaagagaacgaagaaaatacgttcatattttcttcgtccgcccacatccaggaaaaagaggcaagaaagaaaagaaaataagtagaggacatagaaaacacttagtaaaaagatttagtaaaccatgtagtataaattggctgttcctgttaaaattcaatgaagaaacaactcatttagatgatttttacaggagtcctgtttaaaataaggataacaaaagtttgaaggtaatagattggatcaagaaaagacacataagaaaataaattctatctatattagtatcagtgtaagcttaatggcaaaaggcatctctagagataataaagaaggccacttcataatgacagaaagatatacacttgacccttaaacaacatggggctgaggggcactgactccctttgcggtaaaaaatccacgtataacttttaactacctccaaacgtaactactgatagcctactgtcgactggaagccttaccgataacataaacagttgatcaacacattttgtatgttacatgtattaacactgtattcttacaataaaataagccattgagaagaaaatgttttaaagaaatcataaggaagaaaaaatacgtttattattcattaagtggaagtagatcataaaggtcttcatcctggtggtctttacatggagtaggctgaggaagaggaggaagattcaggtttggtcttactgtctcaagggtggcagaggcagaaggaggtgatggaggtgggaggggtgtcatacttggtgtaatatttgtggaaaaatgttctgtaagtagacccacatagttcagacctattgtttaagggttggttgtaattgcctttacacatatacagcaaaaatagaagtaaaaggcgaaacaggtaaaatttaatcacaccagactttgcattctttttaagcacctatggaatatttacaaaaattgaccatatgctatgctgaaaagcaagtttgaacaaatattaaggatggctattacatataacatgtttgctgattacactgtaggaagctaaaaatcaaaactacaggaaattatatgttgaaatgagcataatatatttaaatatttagtagatgtcaaattaccttgactttgaatgaaaatgaaactgctccctatctgaatttgtgggatacaactaaaaccagcttagaggtatatgtaaagctttagatgtatatgttagaaaagaaggaatacaataagcaaaatattcatttcaaaaaattggaaaaagaacagcagattaaacgaaggaagggaaaaagaacagcagattaaacgaaggaagtagaaggaaggaaataaatgaagagtagaaatcaattaaagacaaacacaaaatgaagtaattcaatatatcagctagctatctctacattataataaactactccaaaatcttaagtaaaccacttgttgagctccttagtccttcttccagtcagctgtaaggtcagtcaggtagttctacttctgggagttgcgtggttgcagatattgatgatgactgggtcactgtctttcattccccaacaagttttagtccaagcttgtttacatgggggaaaggggctctaagagagtagaaccacgtaagactaacactgaggcatatcattctcaccactacgttgtattggccaaagcaagtcacaatgctagcctagattcaggaggtgggaggagatgcagattccctttgcagatggcatggacacaatgaggggcagagaattatggtcatttttgaaatcagtctacctcagtcaacaaaagcaggttcttttaaaacacttttgaagacagatcaagagaaaggaagatacaggtaaccagtcaagaataaaaaaatgagacatcgtttcagatcttattggtattaaaaataaattaggcatctattttaaatcaacaaatttgaaaatttagacaaaatggatacaacttaaaaattgacatacgaaggaatagaaagtctgaatccataatttaaaactttctgtagtgaaatctctaggctcaggtagcttcaccagtgaattttattcattatttaaggaagaaataacagccatatacaagcctatctggagagtggaaaaaggaggaatacattccaacatgttttgctaccagaataaccttgataccaaaacctgagacgtgtattatgagaaagaaaaattgtgggccagttctatttatgaatggacatttcttaaaaaaaaaaatcaccagaatgccaggaaacaatttgctcaagttgattttgcattaaattggtttaacatttgaagttgaaattgaatttgaaattaaatttgaagttgaagttggttaacatttgcagttgaaatccactgcaataacagaattaaggagaaatgttgttttaatagatagtgaaaaatgataaatttagatatccacttgtagttgggaactcttagcaaactaagaaatagaagggaattttaatgtgataaagtgtatcttcaaaaagtttaagattaaactttatggtggactgttgaaacctttattcttgaaatttggaacaagtcaaggatgacacacttttatttggctttgaactcaaggtatgctgaccagtactgtaaggatagcaagaaaaagaaataaaaatatatgataggaaaggaaaatagagaactgtcattatttccaggtgatgtgattgtttagcatccaaaagaatctacaaaagatttatgagagtcagtaatgaagaaatgctggttgtaaggttgatagaaaaaaacccaattatatgttcatataccagaaacagaaaatgaaaacttaaaattatgatatacggtagcagaaaaagccctgtaaatttgtaggaatgaatcttaacaacaacaaaagtaaaaacaagtaaaggcacaatcaaaaaagctctacatttttgaggctagacatggtgtctccagcctgtaatcctagctctttgggaggcttaggcactggggtggagtgggggtgaggatggcttgagtccaggaattttgagatcagcctgggcaacgtagtgagacctgatgtctacaaaaaagttaaaaaaaaaaaaaaaaaaaagccaggcatggtgaggctgaggtgggaggattgcttgaggccaagaattcaaggctacagtgctctatgattgtgccacttgcactttagcctaaacaaaaataaacttgacgttattgagagagatgagagataacttaaccaaatggagaaattttaccatgtttatggtttttgaagagtctatattataatgtgatctcagtgaaaattcttgcaagtattattttagaaattgatggacttattctaaaatatgtggaaatggaaagggccaggaatagctaagccactcttgaggaagagcaagagagaagaacttggtgtaccatataatttaccataattaatacagtatgatgttaaagtaaagataaataaatggaatagactagagagctccaaaacagacctaagtactgtcagctgtttgtatcctcaggttccacatctgtggattcaaccaacctaggatcaaaacttttaggggaaatatttaaaatggttgcatttgtactgaaatatacaaattttttcttgtcattatttcctaagcaatgcagcataacagtgatttacacagtatttacattgtattaggtattttaagtaatctaaagatgatataaattatattggaggttgtgcataggttatgtgcaaatatgacaccgttttatataagggacttgagcatctgtgaattttggtgtttgtgtggggacctgtaaccaatcccccccaccccagataccaagggacgattgtgtagataaatatttatgacagtgatgacactggagcaattggaaaagagtagtcttttcaataacatttctattcagtgacattcgtatatttaataacatttggatattcatgtgagagaagaaaagaaaattataacacagacatcaattcctggtacactgtagatgtaaattcgaaagacttaacaataaagcttctagaagataacaccagaaggtatcttggtgaccttagggtggggagagacttcttttaaacaggacacagaaaacactaaccatgaagataaggttgaaaatttgaactgtgttaaaattaaaaactttcagtcatcataagacaccattaaagagggagaagacgagccacaggatgggaaaaatacttgtcagttgtgtaaccacaaagtagaaatcaataaggaaaaggtaacacaatagaaaaacacaggaaacttcaaatgtccttcaaaaaatgcatatccaaatggccaacaaatgtgaaaaaaatgcttagcttcattagtagtcagaggaatgctaattgaaacatttaatacatacactagaatggttaaaatataaaaacactgataataaatattggagaggaagtggatcaaaataaatttttatactatacggaggataaaaatatgtacaaccattttagaaaataatttaacactatgtactaaagtttttttttttttttttaaatcatcttctttgtcctgtagtcttttttttctcaagggtcagtctcttgtcctgcttctttatcttgtcctgtctctctcatgatagagcccttcttgaacctttggtgaacattgtttaagtgtgaaacaatgaaaatctgaattaggagcttgtgttcatgaacagagctgtccgctgccaaccttaatttggggtgaccccctaaagtgctagtctttgagatggaagtcatataatggaacacagaattcttttcgtgggttatttcaatttttctagagaaaaaactagcccattacctacaagtcagaagcctggcctttgctgttctgtgggcagtgatggtcgcttgttctgtgtattagttccaccttttcattcttgttttctgcaaaactcagtgtgtgagtgtccagtctctctggagttctgtagggcaagtttgctgctgatcacatctccttctagaaatgacattccaagcttaattaagagtaagagcctgaggttttaagcaaaggatttgtattagacttggtaggctattgtgactgtatggcaaactttttactggaccttgtgtatgtattgtgctatacacatacatatctgtacatgccatcatcactatagctctgtcagatagtattatccccattctgtaattgaggcttatttgatgtgattttcagattcctttttttgttttgttttgttttgtttttttttttttgagacagagtctcgctttattgcccaggctgtagtgcagaggcatgatttcagctcacggcaacctccacctcctgggttcaactgattctcatgcctcggccacccaggtagctggaattacaagcatgcaccaccaagcctggctaagttttgtatttttagtagagatggggtttcaccatgttggccaggctcgtcttgaacgcctgtcctcaagtgatccaccccgtcttggcctcccaaagtgttgggattacaggtgtgagccactgcgcctggccaatattcagattcctgattactgttttcatatttgagcttggataccagctagaatctgtgtgctctcagagtttaagcacataaccgtagtatactacttgagtttatttaaattggagatgtaggaaggttaagttgatgagtttctaaattggaagtactttgttaaaatggatcatggtgggggtttaggttgggtaaagaggtaaaattactatatactgaagcactgggcaaagataagggactttatctgaatataaagagctattagcagatttcagaatctaggatcttgaagagctaaattaagtgcttatagatgagtctgtgagtctcaacagagggtgaaataagatgtatgaaaatcccctcggagactttcttcgaatgatacaggcgtactacctaccacctttcatttgagaatcacttttctaaggtgtgacaatgcaaaataagagccagtggagtacagatgataccagaagtacccagcttcttaagccctgatggcagtggattttctagcacgttacttttatgtaatgatatactaaaagttggataaatgcaagaaaaaagtagaagaccatatgcataagaatcagtacctatttgattgaataagtaaatgaaaaccacctgtggaattttgtggaactgatagcaaactcttatattttggcctttatgcagataacatgcaaatgaggaaaatttacttttcacgatttagcccgtttttcctattggctttaaagaaataacttgtatatatgaatattaggaatttctgttgagggatggtaattttttatttttttattgtacagtttttaatttatacaattattgatatcactggcctatttagtgatattcagagtttaggtttcttataagttaaaggtagaaaggaatatgtactcttaagacacatttagtgtagccaacccatagttttcgtaacatatttctgaacagttgctttggagaaagtataatttttcttaggtaaataaaagaggactttccccaaaggattttggtagaaagggcagtgcctaacaatttcttcaacactgtcatgacaaagagacagttggacattttgtggaagggacttgtattcttggctggcatctaatattttgtcaaactctttaatactctctgttttaggttatttgttgatggacagttgtatctgttctagctgtatactgttcccagttcatagtttgtgttaatacttgtgaaaatataatgctaaacgatgagctattgtaattagacctgagacttagcaagaaattcataagggctctagattttatttcaacttagtattaaaaagacatttaacttcagtaagtaaatgtagatatactttatattttaagagctgtaagttccagcaagtgaataatgtatagtgatccttttttttttttctcagtttaattttgttgggagaatccttggacctagaggacttacagccaaacaacttgaagcagaaaccggatgtaaaatcatggtccgaggcaaaggctcaatgagggataaaaaaaaggtaagtccttgaaaatggactaagtctttatgtgagtaacttactatacttttacatcgtaataataaaatttccagatttttttgtgcttaaaacactatattccaggccgggcgcggtggctcacgcctgtaatcccagcactttgggaggccgaggcaggcggatcgtctgaggtcaggagtttgagaccaccctagccaacatggtgaaaccctgtctttactaaaaaaaatacaaaaattagctgggcgtggtggcgggcgcctgtaatcccagctactcaggaggctgaggcaggagaattgcttgaacccgggaggcagagatttcagattgtgccactgcactccagcctgggcaacaggagtaaagctctgtctcaaaaacgaacaaacaaacccactatgttccatgtcaggaacttttaaactttttaaaggtgttgtcatgattttcccttgtttttcttttttctttgtttgttatttttgagacggagtctcgctatgtcacccaggctggagtgcagtggtgcaatcttggctcactgcagcctccgctttctgcattcaagtgtttctcctgcctcaggctcctgagtagctgggattacaggcgcacgccgccatgcccagctaatttttgtatttttagtagagatggggtttcaccatgttggtcagtctggtctcgaactcctgacctcgtgatccacccacctcagcctcccaaaggtctgggattataggcgtgagccaccacgcctggcggtttccccttgttaattatcattttttacttagcaaattaaaatatcagttcatcatgttaccttcctttgtcatttacttttgggaagctgccagtttggaaattagtcagactgtaatgtgtgtaaaagtatataaaagttttgaaaaatctgaaatttttcttttgatgagatttaaataagaatggtcaaataactttggatgtatgtcagatcactgggagagttagaagacagaaatctattagaaggaaggctatcactagccatatgagatacactttgggtttcatcaacattttgtgttgattttacattttaaagtatattgtttctgtttctgtgggtttttttctcctgccatttcttcttttgctggtttaattagtaaagacccaactatctaaatattattgttaggaagattttatttacctagtttgtcttacccagcaatactgtgaggcaggatagttttgaatttctattcttgtaaaaattggcggatttaaaaaaatagattttgatggccaaagattaaaagtgttttaggaaggtttggtctgtctgtctgtctgtctgtctctttctctctctctctctctctttcttccttccttccttcctttctttccattgacttgaaggggctatctaggaatagtgcgtggttagctgtgttagaccagtacgctgaatcgctttgtggaacttacggaatgaataccaaacccacagggtatctgataaacttgttttctgagccctccgcctcatgtcttttaagccctcacataagctgactggatctcattcatttttgctcctcatcaatgatttagtagccaagaaatttgggcaaaaagttctcataatattgattatttaaaaatcttattataatgtattccttgtcaactgtgtttaaagatatgttcatgggagtctgtgagttctccttgagcaattttagatgtattaaatttttttatgagaatcttaaaaaaatgtgcatattttgaatcagttgagtgataatcttttcaaatgaacgttgccatgaagttttggttctcatgtttggacttaggattatgtggtcattaagtaatactagtttaattgcctatggacaatgaatgaagtcttgacaactggcagatatataaatctgtatgaaaagattagtatatattcatcagttaggctattctgtcagccagttaacaaaacccctttttccctgcttctgagtttctgtgaattctgcagtaatggccccccactcaaccttgcttactgtttcaagccctcacagacaatgagcattagagcttataactgtgtgattatactgttgcactcttataagtgtttataataaaagtaaagtcagaatggaatgcttggccatttggtaaagaacatgaaaagagatggaaacaaaaagaagtattgatgtaagtaataaagatagctcattgagatgtatttcaggagttcaagaggaaaagccatttgctttaaacttttctacagagttgtccatgtatatatagacatgtgtgtatatatatatatgtgtgtgcgtatatatataatgtgtatatctatatgtgtgtatatactgattgcctgttttacttttaacacaaaatgctacgatgggaatggtgtgtgctggtctgaatccttccctacactggtaaactcagtgagagcctaccatggctattctatggagtattaatttccttggtgtttggtgagtacctggcacagagtgcaggcacttgaaaaaaatacctgtgaaaggagtgactagttcaggtaataaatgaaaggcttaggtgtaccttccctcatgttccccgaaaaggttggttaaataaagaaaattgtaaatgctatgtacttctaatgctttggggaagttagtactatattattctaagctgctggtttttagcaagtaagttaatatgccactttagttttcattttcttggattgttattatttcagcattattgatgggctcaacagcattgatttagtgcataaatacccagtggaatggtactagttaagatcatggaaccagggcttgaaaactattatgaacttcttgtctgtaccagctattttgtaaatgaagagaccaaagccttggggaggttgagtaatttgccaaaggtcacacgccaaaatgtggcagtcaaatttgaaactaggctgggcacagtggctcacacctgtaatctcagcactttgggaggctgaggcaggaggatcccaggagttgaagaccaacaaggtcaacatagtgagacccccatctctacaataaaacttaaaaaataattagccaggtgtggtggcgtgcacctgtagtcccagctgctaggtaggctgaggagggaggatgcttgagcccaggagttgaggcaacagtgagctatgattgtgtgccactgcactccagcttgggtgacagaacgagactctgtctcgggggaaaaaagaaaaagaaactgaattctgagttctattctgtggtacattattttctaattataaaccatttctaagagtgataacttcagacatactagaacaacttgaatattgagtattagaaactttgactaccatttcacacaccacccagtacacttgtgaccccagatgttgtaagggtttctccccacaaaccaaacaaatctccagaaaacaccatctgaatgtcctctaattcagttcaaaactgggaataatgtcacataccacaggctgagggctcagtcccctaagactgtctccacttcagatgccagttacaagccccagtggtgacctgtgcttttgactgaccagctgtaaatgtgtttttttgcaagtccctcgtcgggttcaattaatttgctagagtagttcacagaactcagggaagcactttacttatttattataaaggatattacaaaggataccgacgaacagcagatggaaaagatgcatagggcaagacatgtgggaaggggctcagagctcccatcccttctccagtgtgccaccctccaggtgcatccatgtgttcagctatttggaatctctccaaaccccgtccttctgtttttttgtggaggtttcattatgtaggcatgactgatgttcatcattggccattggtgatcgactcaacattcagcctttctcccttccttagaggttggggaatgaggctgaaagtctcagccctctgtatacttggttagggtttctctggaatcagccttgatcttgagactatccagggcccccacccatttgtcacttcattatacagaaagacacaaacaggttccagaccaccacaataagggaacattgcgataaagctagtcacacatttttttagtttcctagtgcatataaaagttatgtttataccatactatagtctattaaatttgtaacagcattatgtctaaaaaatatacataccttagtttaaaaatactttattgctgaaaaatgctaatgatcatctgagccttcagagagttttaatcttttgctggtggaaggccttgcctggatgttgatggcatgttgatggctgctgactgatcagggtggtggttgccaatggttggggtgactgtgacgattgcttaaaataagaacaacgaagtttgcctcatggatttgctcttcctttcacaaagatgtctctagcatgcagtgctttttgatagcattttacccacagaacttttgctgttgctttataaactaagtttatgtaatattataaatttttttttgtcatttcaacagtgttcactgtatcttcactacaaatacatttcatctcaagaaatcactttctctgctcatccataagaagcaactcctgatcaagtttgatcatgcagttgcagcaattcagtcacatcttcaggctacacttctaattctagttctcttgctctttccaccacatctgcagtttcttcctccatcatactcctaaacccctcagagtcatccttgagggttggaattaactttttccagactcctgctaatgttgatattttgacctctctccatgaatcatgaatgttcttaatggcattgagaatggtgattcctttccaggaggttttcaatatactttgcccagatttatcagaggaatcactgtctgtggcagctataggcctatgaaagacatttcttaaataataaggcttgaaagtctaaattactccttgatccatgggttacagaatgaatgttgtgttagcaggagtgaaaacaacattcatctccttgtacgtctctaccagagattttgggttaccaggtggattgacaatgagcagtaatatttggaaaggaatctctttttctgagcaatatgtctcaacagtaggcttaaaatattcaataaacctttctctgctgacatccaggctttgttgttccaattgtagagcacaggcagggtacattagcctttttttttttttttctttttaagacagagtctcactctaccgcccaggctggtgtgtagtggtgcaatctcaggtcactgcaacctccgccttctgggttcgagcagtcatgcctcagcctgctgagtagctggggttagaggcatgcaccaccacacccagctaattttttgtatttttagtagagatgcggttttgccgtgttggccaggctagtctcgaactcctggcctcaagtgatctgcccaccttggccttccaaagtgctaggattacaggtgtgagccactgcacctgtcccatttagcataatttttaagggccctagtatttttggaatggtcaatcagcatttgcttcaacataaagtcaccagttgcattagcccctaacaagagaatcagcctgtctttggaaggtttgaagccaggcattgacttctctctagctatgaaagttttagatgtaatcttcttccattagcagtccagacacacacagtacttgtcacttaagttcactgtcttatatgggcatggtttggtgtgccccagaacaattacagtagtaatttcaaagattactatctacaggtcactatggcagacataataataatagtaatgtaaaagtttgaaatattgtgagaattaccaaaatgtggcttggagacacgaattgagcacatggtgttggaaaaatggtgccacaagatttgtttgatgcagggttgccataagccttcaatttggaaaaatgcagtatatgtgaagtacaataaaaggaggtatgcctgtattacttgggagattcaggggttttaggagatttgtgccaggaaacaaagaccaaatatatttatttcatcataaatcacaatatcatactatcattcctttgatttttcaggaattctccctagaggatttaatcccatgtacttaatggaaatctatatacttgagcagattacaaatgctagaggagtaattttagatgagatcgggtgcattcagtatggtatggtgtagactagaggatgaattttaggaaaagaaagtaattatggtgtttcacttgaggttgcagaggccgtatccagggctgtgaaagaaatgtattcatgctaggaggcatggtccacctttagaaacaggtgggagtcagctggttctaatgtagcaaatgagaacatgtaagccattaaaacagaacagtgttttgcacgtaattaggtacttggcaaattgttgtggagtgacaagtagtacattgaagttcaccctttgggtatatatatgcatggtcattgtaggggacaccatttgtggttttgtcttatccgtctgcaatttgtcagctcttctgaggtctcccttctcataaacaagaggagaataagtagccatgcttgtgggttcctccttctcacctcctttttctgtccttccttctctcccattgtgttgatgggtgaaatgtatgcagtttatcaaagccatgtcagtcagatgttgcatcatctggaaatgtgcaaagacttagcaattccagttcaagttctttgctcaaaatgaagggatgtgcattcttcttctagccattccagggctgctaataacagtggctagagcaggggtgtccaatcttttggcttccctggaccacattggaagatgacaaattgtcatgggccacacataaaatacactaacaatagctgatgagctaaaaacaaacaaacaaacaaaaacctcatgttttaagaaagtttatgaatttgtgtggggccacattcaaagccttcctgggccgcatgcggcctatggaccgggggttggacaagcttgggctagatggtatcagccacttttactatctgtgctgcatcatgttcagaccatgggacaaccttggaaaagagttacactcttccaacggaaatggaggcttaaagaagtgtagtaacccacccagttgctcatttctacctgaagagtacacaatatagaaacttccatctctcactggatattcaaattcagttgtacaaatcattcttgtcagaatgtgggctttgaaataaattggtaatagtttttaacttaatatttgtttcccaaatgtatttggccatagtctccccttttttgaagatgtccctataactccttgaagaactacagtgttttgtggaacatgacttacgaaatgttattagagtcatattgtataattgcagacataggtggaattcttgaattttgttttgcaggacttgtttaggtagagcatttaataacttcttttacgtgatgcttttcatatacattacaaattgttaagtatctcttatagcagagatttcttagctctatttgttatgcttaaaatatattttaattggtcaatatgttatatttttagaaaagtgagaaagtcctagagggtctcaagaaaattaaaggctcctgacattccattagtttagacactacccttgtttatagtttggtatgtcttgtagattgttcttcatgcagttatgcatatgtacacgtatggtatattaagtggatcatattatatttgctgctttataatcaacatttttttcctgcaactctgtatcctgtcctatgtcagttcaccgaatagtagagctttatgcctaagactgtgataggtgataggaaagtacacttaaaggacatttcaaggcagcattcatagtgatatgcaaaaataaatttccttgaatttttgggtgggggaacttacaagattttattcttatgaaatatgttactgctgtgtcaacactttgaaagagagaaattaattcagtcttgtgattgatacaccagagtggctttggcaattggtggcatgacatcaagtacaagtagggttccaaacagcctgttttatcgatcttgttgaatacttagctctctgacaagctctagcatggatatagttttttttttttacgttttcattatgcaaaattttaagcaatggaaagacaagtagtgtagtgaactctaatttacccatcacccagggtcagcattgcctctctcctttcaagagggaactctctcattccccattgcctcacttcaccttttgcctcccagattattttagaatcaaattcagacatataatttcaactgtaaatattttattagctatctctaaaatagaactctaatgataacgtgtttgtgttttaatatctagaaaattatttatcctcaaatatgttgtcagtgttaatagtttctctggtgtctcattaatatgcttttaaaataatttgttttaatgagcatacaaatgagggtcatctacattgtaattgatagatctcttaagccacttcccaaacctccatttctctttcttggcttcactgggtgatttgtcttgaattcctgtggattttgctggtggcattttcttggtggtgtttaacatttatctctgttccccatatttcttgtaaattggtaatgacaaaggtttagttaaattcagctctcccaccttctctttctcatttctgttcttttttgaaagaatatttcataactagtgttttgatggtagtacataaagtctcatttcctctctgtgattttagcaatcattgttgattgttttctaggtcctttttttcagtgggagttgcagaatagctatattctgtttcttcattcatattagctagatacagtttttatcagaaaggcggaataaatgtttaattctttatttgctagtttttaaatagtgaattggttcccaagaatcctccagactgaaagaatgagtgtttccctgccccccgcctttgggtatcactacgaatgcatttaaacagttttatatgtttccgttcattgaagatattatttttaactggcgctcaagttgtttggccattggagggacttcttcacattgacttctaaatcttttcaacataatcctagtagatgggaatagtaactttgccgtctagtgtagtgtgatatgacagtctgcactcttgtgagaattcttcctcagacttggaatcagccaattttttagggaagctttgttaacaaaaagtgacaaaaaaaaagagagagagagagaaagaaatagtgcagagattatagtctgggctctagtgattctcattattgtaggcttttcagagctgtgaaatacacacgaatattttcacaagctcattctcattaaatttaggactataatgtttttatttaatcttctatctgtatcttattttctcactgaaaattctggttcctagtgacacaaaataatgattcatttgctttatttcaaaaaaggaatacaaagcagtctcagaataactataaccactactaccagtgatacagttggtgacaattttacactgagctcttactattttgagggtatatccactagatacaagttaccatctcttaaagcagctggaataatttttactatgtaacagttgtgctagtatatagatccatggttaggttcatttgttgcacttgattttctagttgtggaaattgcataaaatattttcctgttttctaccttagaatatttacatggttccaaagcaaaatatgcaaagcagagaatttttataaagtatggctttcatctcaggcccatttatttacctagtcctcccttgctgtttgggtagattttttatttttagtttttggtttatccttccatttctttttttttttttttttaaacataaacagttatgtaacagttttgtgtgtgtatctgtgtataatttctcactcttcatagattattatactctcagcactttttaatacctttattatttattttcacttaatagtatattgtggtcatttaatgggagtgtataaagaatagcctttattcgttttttttttttttgccgttacaaaaaggtatagtgctgtgttgaaaagtgtttcttgaagttgctagtttatgtttgaatagaattgtagaagcaggatcgtgtgtggttttattagttagtgctaaattcctccgtcttagggtgatggtttgcgttaccatcagcagtgtatgagagtagcagtttccccccagcttcacaaaactttgctctgttgtgcaggagattgagcatctgttaaaggcactttcaaagaagttatgctgtgtgtgtgtgtgtgtgtgtgtgtgtgtgtgttgtgtgtaaaagtcattactgttatgaacactgttaccaccttcagtttcccaactattgtttgtagtgcgttttttaatattctgactgaagcagtttataaataatggttagacttacttgaaatggtaccattacaacatgtcttaaggcacactaattgtaataacttctggctgggcttaagaaactacttcttaaatgtttttaagtggaaatatgctttgatttttctgtaagcttaacaagcttttctcagctagggttcctcatctgaaccacagaaaataggaattatttcattttattaaagatgactcatcaagagaaccattatagttacacaggagagaagttaaccacatataatttttatgtcttgggctgggcattgaaatttgattctcatgtggaattcttagttgagaaaggtgtaccctgtgagaaatggtttttttctcgcattttatattactgcctctccatcaaaccatatatatctccccctcttccttcagcctcccttattggtaccatttgacgagatgattagggagtaggaactgttacaggttgtttgttagagggttaatcttacaaattgtattcttatcaactttcatgaatccaattgaatagtagaattcgctatgaaaacagatgagttgctttagaaaagtggcaatgaaatgtatactcttgtataacctggtttagagggaaccttattaagtcatcgagtctaaaccatatttgtgatacttaattccatgatatttcagtaagtagtactataaatgactgttagtcagttttcattaccttctaccatagttaatttaatacaatctgcggcagcagttatgtttttgaatgcctgtgattttttaccctcaaggaactttcacccctggaagactgatatattgacagtgaactgatgcagcggagatgatatatacattgtgcaggaagtcaagaagtaatgtgttctttgaaggttgaaggtttttaaaggaagctggagaagattgaagtaggagtttaccaggcaaataagtaaaatggtattctagacatcagaaatagaatcaaccagggtatgttgctatgtggatgcttggtgtgtctcagtggaaggtatggggcacagtggagtgttggtattggagataaggctgaggtctgaggataaaggaccatgaaccttatatccaaatttatttcattttgaaagcagtgcattgacactcttctcttttaaagatgagaagttatatgatgtattaattgttttggaaaggtaacttgacagtagtggaagagatggacagaagtgggaagtgactaaaggcagaagacaaatgatcaagtctcacacaactctgcctagaaagttctttcttgtgttaggataaaatctttgaaacttcagtcctctgatcttaatctactttgaattcaaaacaaatataatctcttaaactttagagactttgacatatttaatgacagtgcttgtcttaaaggtgttctgccctagctaaaagtttattgcctagtagccttagttctcttttttgttaagatgtcatgtgatatggtgttgaattcaacttcaaaagtggtagattggtttgtttttaaagagaaaagaagacccgctatccttttcagtgcttttcaaactgtctgtggtaagagacccactaaaaaaattcaatccattatatcttttggtgaaatacaataaaattagttaccagagaagtggagttttaaaaagacatatatttaaccccatttaaaactgtcttttatcaagagacataaaattatcctgtcagaatgctcaaagagtttctgaacaggcttgatttctgtacttgtaggctgcacttccggccgcactggtttaaatgccaactgtgacgtggtatgtttgtttcaggattgtaaactagctccctggtgtccctcctcctctacttttgttcttctcactccctcatttttttttattttttatttttttgctctgtgtttataaaataaaattcattttagattattgactagattatttttaagtttgatttctggttacatgttcattaaggactcaaatggcttagctttgttttaagatagaagagtacaaaacagtgcaataaagattaaatgtttatttccgggttgataatatctcagtacatttatagagtggagtcactgctttttgcccattgttaagaaagattgggaagacttgaaataaaaaatttatttgaaaatacatttattaaaatttgtgagacaccctttgagaggtaaaaagatggacccaataagaatagacttttgtttttattagtaaagtaatactttaacctgtaaaacttcatctcattactcagccatagatataactccaggatgagttaattgcccatgtctaatgaaatgagacgtgagtctcagtgaaaagggagagtccattttatcactagatgctcttaatgagccttttaaaattaagtcttgattggattgcagtcaatttcgttaaggaatatttgagcatcttgtagttgtgtcttatgtaacattttctttttagaggattcagctctctgttgacagagtgagtagtggaatgttgctgatgtgtattaatgctgcagcaattgatcttttcaaaacccgttaaccttagttggaaataatttttcagtctaatatattaacaacaaattattaggccgtttcataagcctagggagccatcctattctatcctattagttttagttttctgtttatttcttcagttatgagagaccactattaaattattttgttgttctttagattttaaaacatgtaattgttaactctcgattttaaatacctataatttttagtttggtgtttttaaatcacaggttgttataggacatagtttgtggggctgtgtttaatgtttaacaacaattgtgaatctcagattgttgaaattattcttcattttgtgaattgttacgtttaactatttttaaaaacagtaatagaaattatagcagatagtgaagaatgtttttaaaaaggtctgcaaaaacttaagatttttggtgaattaaaataagtataaggtagtctaaatatagaggactagtcacttcaaatagaaaaaaattttcttaaaaaatctaatgtgaagaaaatttggagtaattttatctttgtaactaataagattaatgtttgaataataatttgtgttatctcagtagtgagattattgaataatagacaagtgagtaaacggatgcctatatggatgcttcagggtgtgtaatattatcaagtgttacaacagcacattgtttagaacgtttaagatttaagacgagtaagtactttaaaaggagtcaaaagaagtgaaagcaaatactgaacctcatcttttataacataaaaatgaattttttcttaattatgaaagcctttcacgtttagtgtagaaaaaatttagataattctggtattttaaaaatctaatcttccccatttagcgccgttacttatgtgttaatacatattttgagatctatgtatttgtgacctgatatattttgtttaagtatattacgtactaaaaagtcatctacaatactttttttttttttttgagatggagttttgctcttgtcactcaggctggagggcattgggcaatcttggcccactgcaaccttcacctcctgggttcaagcgattctcctgcctcagcctcctgaatagctgggattacaggcgcatgccaccactcccagctaattttttgtatttctaatagtgacggggttttaatgttggtcaggctgttcttgaactcctgaactcaggtgatccaccgcctcggcctcccaaagtgctggaattacaggcatgagccaccgtgcccagcctacaatactttttaatggttataagtagcatttaattgtacatatgtgtactgaggtatattgtttgttgaagttttaaaataattgtttttactataaaaatgctgtgaagaatatctgtactttatcattaagataaatgtgactgggctccatggctcatgcttgtaattccagcactataggtgggattccaccactgaggtgggaggatcatttgagcttaggagttcgagaccaccttggacccttctctaacttaaaagtacaacaaaaaaagataaatgtgtagaattggttggttgaaaatgcatttcaaaattgcctttcaacttcactgtttgaaattgtaagctccctcagaaaatgaaaatgcttatgtaacgaatcttctaaaaaatcacttttttaaagggacaaaaatatagacaaaaatacaacaaacatacttctggttaacaaggttaaagcttatctgtttcacttgtttattgcctaacattgctgccatctgtaaacccccactttgtattttcttttcatcctcattttgaaaaaataaaaaattatacatgcagaataattacaaggctaacaaagtgaatttgtgtataccttcaacctaaatttgctgtataccttggccctccatactgcaggccccacatcctccaattcagccaaccacagatcaaaaaatattcgggaggaaaaataataaaaaataataatacaacaatagaaaataatacaaataaaaaatatggtacaatgatttacgtagtctttgcgttgtattcagtattttaagtaatctagtgattaaagtatatggaggatgagcctgagttctgtgcaaatactgtaccttcctatatcagtgacttgagcactggtagggaggcggtcctgggaccaatcccacagggatactaagggacaactgtagtaacgttttgttcatttgtgtgtacacacagtgttgattttttatttggaagttcacctacttgctgaaacttatgtgtaaccctcaaatcattactggcgacactttcacggtcattcagacacgcacacagtggcaataaaaatctgagtcacccaaatgctcttttttgatattgagatagaacaagatgacacaccaccacctttttacttcagttcatacactgttaaaaaaagttattttcatggtctgcttagtgtcacgttttgggttttttttttgtttttgttgttgttgttgttattgttgtttttgtgttttttgactgtttattatgattttgctgtttaaaatgtccctcaagcatagtgctgaggtggtgtctaggatttaggattcctaacagcaagaagactgtgtgtgatgtgccttatggagaaaatacttatgttagagaagcttagttcaggcatgagttaactgctgttggctgttgaatgttaaagaatcataaggtgtctttttttattatttatttatttattttttttttgagacagagtcacactctgtcgtccaggctggagtgcagtggcgcgatcttggctcacattaacctctgcctcctgggttcaggcgattcccttgcctcagcctcccaggtatctgggattataggagcgtgtcaaaacacctggctaatttttctgtttttagtagagacaaggtttcaccagttggccacgctggtctcgaactcctgacctcaagtgatctgcctgcctcggcctcccaaagtgctgggattacaggcatgagccaccgcgcttggcctaaataaggtgtctttgaacagaaacacatataaaactgaattatgtattgatggttgatgaaaatgtgaccagaggtttgtgggaaccaaccctgtatttccttgaggagcagtattggctaattcagtgttcctggtgactttaccacaaataatgagagttgcgtgtgtgtgtgagcatgcgcgtgtgtgtctgtatgtatgtacatatataaaataattattaccgtttgctgaatcatttgagagcaacttgcagacattatgatccttcatccctgtcttagagtgcatttcctataaccaaggacattcttttacatagttactttatcaaattctgaaaatttaatattattacaatattgttatttgatggacattctaaattcaaattttccaatttttcattagttgtaagttctttctgattcagaatctagtccagatcacagattacatttatttgccctgtctcttacagtgtaatttggaacagttcctcagacttttcattatcttttataatttgtgtgtgtctttcttcatgactagattcaggccatgcatttttcacaagaatgttttaaaaagtgatgttgtgtccttctcagccatcacattagcagttagatgatgtcaatttgcctcatttttgatgttgataactgatcatttggttaaagtagtgtgagttatgtattgtcaccgtaaaggtaactttttctccttttaaatcatatctgaggagaaatactttgaaactttgtaaatattctttcctaacaaatttaggattgtaatgtcttttgtccaattttcgtatcattccctttacatttgttagttaacatttaattgtaatgaatatattgtctgacatttctaataggttaagatctctttcagtattacatgtattcttgcatatcccattcgtttgctgattttagagtctctctccttgacttttacactgcttgatatctttacttggttagatggtgatagtagtggttgtggtgacaacaataagttgatgttattgttaagggcttcaacacactgagctttgatttaggcattgttatcagtccatgtgaattaacccatctagtcctctgaaagccctatgaggcagttattgttctaattttatagatgaggaaatgaagcattaaggaggaggtaaagtaccttctgtggctggtgagttgcttggccccaagatatgaacccaggctggcttgagtttaactactacattgtgcctttcctctaagtagtcttctgatttccttatttccattcttccgcccttttctcttttcagcaaccagagtgaatttaaagaataatcttctagcatattttaatgtattcagttagagtcaggtctttactgtggctaaaggccctacgtggccttgtagcttgctcctccctagagttttctactctttgcctcctctttgtgtattcctcgaacatacacatgctctcatcatagggctttggtgttgctactccctctgcctggaatactctgcccttatgtatgtgtaaacttgatttatccctttatttcagatcctgttgaatctcacttttcagagagactttccataaccacttggcccccatagagtaaaccttcttgcccttttgctctcttgtatttttcatcttaccatcaacagccctgacatgttctacatatatattactaccaccctcacttaagggaatatgttcattgagagcagaattgtctcttttattcattgttctgtcctcagtaatagaattgtacatacctgccatgtagttggtactcagtaaatatgtgttgaaggaaggagtagtttgtcttttaattttgcttataattattttgcataaagacattattaattgaatattttaaagtatattttattgtggttttgtggattctgtctttagtgttgtgctttaaggcctttaccttgttcagtagtttatatagatatttgccattttgtgccatcattagttttgttctagcatttgttcagttaaatcttaaattcttttggaaattcattctctaggggaagattggaaatttcgctctttatcaattattttgctgtttaaaacaattttattgacttaaaatttttaaaattgcttttaataattgtatagtttacttttttctgtatgttaaaaatgaaaaattcacatttgaaattcttaattcagtagcaaattttttttaacttattaaagaattttttggtgcagtgttttagtctttggaggaatttgcttttactgtataagtaagaatttactcaggcaattagttctattttatctagatgtgctatatttattacctaatgacctaggaaaaaataagagtagatattgtttgttaaaaaaaaaaaatccatgtttttgttaaaaccctattacctttgtattttgatagcatgcttaatttttcttctcagtatagctttttggaagagtggcattaagttttgatttgcctaggatagttttagctatatttattgtctagttgtaattactaatagcatctccattcacttccaaaacattctggttgagatgaaaacttacatagtcaccttcacatttgggtgttgttttagtgtttgtgacttctacaaaacactagtgtcattcttaaatctacttttgttactagctatcatgggatttgttaaggagtgatactgcggccttatgaagtttttgatataaaattaaaatactactttaaaaatttctgttactgtattgctgttagaataagaactaaattttgtatgatccttgaagaaaataagttatggaaaaatatgtaaatcagtggatgtttttgtcctccagtagtcttatttgcttataggatttaattcatgttcttcattagtttgctcctaccgcagctgtggtaaaaaaaaaaaaaaaaaatgtatatgtggaaggtatcctcaactcctttctgccctcagtcatttaacaaatttgcacaattgtacagcacagataaagaccattctcagtgttaaagaaagttttattggacaatgttggtttaggcagagcaactttatacagaaaatttgaagaaataaaagtttggacaaataattcctgtttgtaattttatgttttgagataattttaaacttgcagaattataaaaacagtacaaagctctcctacacacctttcacctcacttagccatgtgtagcatgttaccatatgtgactcttggtgcattggccaccatgtttgtgtccctcatcccccttcactttcaggcccctcccttcttccttttgttcttatgtctgtctccctctttccctcctctccccttttaagttggagtaattccccagacttagtttgtttttttcctcacattgttttgaagaatattacactagtttttagaaataattttttatgattaaaaactgattctagatatttgacaggtttgtacgtgtgtctgctgttagaatataaaactagactctaagcgtgctcattttatttttccattgcctttgatatcatatgaatttagttatacagatggagcatccgaaatgcttgggatcagtaatgtttcagattttgggtttttttggattttggaatatttgcatatatacaatgagatatcttggggatgagaccgaatactaaacacgaaattgattcatgtgcacatagcctgaaggtagtttcatacagtattttaaattttgtgcacgaaacaaagtttgtgtatattgaactatcaaagggcaagggtgtcgacacaggtatgcagttctacactgcggcatcatgtcagtgctcaaaatgtgtcattttgaagcgttttgtttttttggattaaggatgctcaatctgggctcaattacactggtttcaacgtgttttgctgaaaaactcttgcagtattaaaaataattcaggaatagtgatgattgaacttatttgacttctattcgtgtttacctacatgtatgacatatcttggaccaatttgtaatatttagataggccactgataaaccaaagctaatctagacacagcaagtgagtttttttgacgataaagagatgaagatagtcattgactcatcacttttgaggaattctcctttgatgatatgattaaatgtaaaagaagaacattttatcaagttggcaaggaagactaggacactttgtgacattaagtgctaggcttgattaaatatatgctaaaacgtgaatttgttttgttagcatcactgacagtgtacgtttagtttaacatttaatggaaataattcaaccaagtcctttgtctccctcatacaatgtttccagtatcttctgtgttgtcaatcctgtcctcaccttctaaaaaatcaagctatctttattcctttcacatgttctacccacccgccaccccctagactattctttcttctacttttcaaagtttgttaaatagtttagtaagtattttttatttcctactctggactagacacaaaactgggaggttcttgctctcatggagcataatttaggaagatagaagctaaacaattaaacgaacaaaggtaatttcagatagggataagtgccatgaaaattataataatgccaggcaatgtaagtatgggctgggtggaaggcttttaactaggagggccaatgaaggactctgaggaagttacatctaaacagagactctgatgggtggttgacatggggaggtctgcagactgaatgtttctgggtgaagttagagcaaaagctctcagttgtgaatgtgatgggactgtccaaggaatagcaaagtcagcaagggtggaaagtgggaagagaagacgtttatgtccctgttcatatgcttctctataggcttggtaaaattttattggaagtaccaggaagtcagttgatggttttaagcagagggatgatatgatatttatttttagcaagagttgtctttagcaattagagacatgtatgtgtgtagggagttgggcaagagttgaaggaaggggattcattagttggctgttgcagttgttgaggcaagagatggtggcatggactgggaatcgtcttcagattcattttatttccatgctgttagaattcttcaacatttgctaatcttggctgaatttccaaagcacttgttctctaaatatacaatgtaatgtttatatttattgtttgcttttgtttccttacccaggctgtcttcttcaggagggactaatttatatttccaatttcctcaatgaaatgtggacataattggtgcctactaaaaaaattatgttcttcctacagaattttacaggaaatttcttattttctgacgtagaggagcatcaaataatgcatacacttagaaatttaaataaacaactgaataagacttaaattacagaatagagaaaaaaccaacaaatactttatgaattagttggagtcgaagttaaggaaagttgaatgtaaaacctaaaagtaaaattaattgctaagctagaggcaatatgtgagcatattttgcaaagactttggtggccatattaggttttcaagccacgcccacacacataactgacaatttttgatacttatgaagtacaaattctcccctccaatgtatgcgtgattctccatagtaacacccacatgtagcttctgatagaaacccacaaaataagatgaaaatagtttctcagtcaaatggttggaatatttagtaatacttggcagtattttttattttgttaataacaggtgtcatttaatacaatgacttttaaattatatattaaaagaaatttttaaaagttttatggcaagctgtgaaatactcagatggataatgtgaattaaggcgtgttctttggccactcaaagtgctccccacccaacactggcatggactgctcactaggtggccaaaagagatttcgtttatggatgtgttttgaatgttttaacattaaaaaaaaaaaacccaaagcatttgaggcagagatttttttagacaatagttgtttaatgagctgcttgtacatacaagagaagagaatgggcctgattgctcacaatctgatgtttgaaaagtatttttctggatcttatgcatttgcatatctaattgctatgtaatcaaaactaagtgaactgtagctacttgaaactctaaaatgaaaggcaatcatcttacggggaggagggagaaccccgttccatgcaagctagcctgaatattagcattatagtcttcttgtgtttaattataggtgtctgactgagcagtaaatttatgcttgtgtaataaagaaatgaatgtgaccctgaaacaccagctcagctttgttgtaactgagcattggctttgagagaagttagcatccattgtgtattttggtgataagggattgtgccagaatggctgttaattacgtactttatgtgatacagaaagtagtggttctacactttctttccaccagtgacagcactcaattaaaacttgtattaagcagctataatgcctttatttatctgtttggaagacatgaggtgaagaaaattaactttattttttccagctgtttgttggcagctttgtttttggtaaatcctttgaggataaaaaactgtttgttatgtgtcctgtatgctttcatagactaaatattttattttttgctgcctcacaaaaaggttattaagagatattttatattcttgccgggcatggtgcctcacacctgtaatcccagcactttgggaggttgaggtgggtggatcgcttgagctcaggagttcaagaccagactgggcaacacagcgaaaccccatctctacaaaaaatacaaaaactagccagacatggtggcctgtgcctgtgttcccaactacttgggaggctgaggtgggaggatcacttgagctggggaggtggagatagcaatgagctgagattgcaccactgcactccaacctgggttaaacagtgagaccctgtctcaaaacaaaacaaaacaaacaaacaaacaaaaatatatatatatgtatattcttaatattggttaaatgtcatttagaagccttgtagactagttaaagctttttatatgttaacccatttgaacctaatgttgagtcagtaagcacttctcgatgatttaaactctgagagagcaagttcaacctggaccaaaattaagataaagtgaatgtttatccccctgccccccacctaaaatttttgtgcttcataaaggggctccattgtaggttgaatctaagagaaaaatagtgattgtatttatggcaaacttgaaatttatattatcattttgaacttattttatacatgaactcactaatttccacaactgtttatttggtggtattccatggtatgtatttgctgcattttcttcatccactttactgttgatggtcaccttggtggttccatgtctttgctgttgtcagtagtgctgtgatgaacatgcaagttgcatgtgtctttttggtagagtggttgttttctttcggatgtatacccagtaataggattgctgggtcaagtggtagttctgagttctttgagaaatctccaaattcttttccacagtggctgaactaatttacattcccaccaacagtatataaatgttctcttttcctcttagcctcaacagcatctatgtttttttgcctttttcgtagtagccattctgacttgtgtgagatggtatctaattgtggtttttatttgcatttctctgatgatagtaatgttgagcatcttttcatgtttgttggccccttgtatttttttttttttttttttttttgagaagacacttctcaaaagaaatgagatgaggctggtctcaaactcatgagctcaggcaatccacctgcctctgcctcccaaagtgctaggattacaggcgtgagccactgcgcccagctgctaatttttgtatatagtgaaagatgtgggtctaatttcattcttctgcatgtggctagccagctctcccagcaccattgattgaatatagggggtcttttccccattgctttggcccactttttaatggagtcgtttttttgcttgttgaattgtttaagttccttatagattccagatattagacccttgttggatgcgtagcctgtgaatattttctcccactctgtaggttgtctgtttactgtcctgatagtttcttttgctgtgcggaaactctttagtttaattaagtcccacttgtcaatttttgtttttgttgcatttgcttttgagggtttagttataaattctttcccaaggctgatgtccagaatgatggttcctaggttttcttctaggattcttacagtttgaggtcttacattttaatctttaatctgttttgaggttttttttaaactgttattttttggagacagagtcttgctctgtcactcaggctggagtgcagtggctcgatcttggctcactgcaacttccgcctcctgggttcaagcaagtctcctggctcagcctcctgagtacctgggactacaggcgcccaccaccacaccgggctaatttttttttgtattttagtagagatggggtttttcagtgttgcccaagctggtctcgaactcgtgagctcaggcagtctgcctgcctctgcctcccaaagtgctaggattacaggtgtgagcccccacccccagcggttaatttttgtatattgtgaaatttgtgggtctaattttattcttctgtgtgtggctagccagctctcccagcaccatttattgaatgggggatctgttccccattgcttatttctgtcaaaattcagatggctgtagatgttctggttctctattctgttccattggtctttatgtctgtttttataccagtaccataatgttttggttactgtagccttgtattatagtttgaagttgggtaatgtgatacctctaggtttgttccttttgcttaggattgcttttcctatttgggctcttttttggttacatgtgaattttaaaatagttttttctaattctgtgataagtgatgttggtagtttgatagaaatagcgttcaatctgtagattactttgggcagtattgtcattttaatgatactgatttttccaatccatgagcgtgggatgttttttcatttgtttgtgtcatctctggtttcttttagcagtgttttgttttgtagttctccttacagagatcttttaacttcttggctggatgtatttctaggttttgagggtgtgagtttggctgtcgtaaatgggatgcattggctgtcagcttgaatgttacaggaatgcaactgatttttgtacattggttttgatcctgaaactttactgtgaagtcatttatcagttccaggagccttttggcagtctttagtgttctctaggtatcaaatcatattgttagcaaagagagatagtttgacttcttttgctatttggatgctttttctttctttcttttacctggttcatctgggtgggacttgctcctcttctttttaaaaatgtttattagctctgaatccaagcatactattaaacccattttaaaaacactgcttacacttctttgccttctgaaaaccatgtttcctaatattttgaggaaaaaatgggtgtccggcattccagcagctccagctctagctgtagcttaaagggcctgaggtacagcttgggctgttacttcagaggacacaagccccaagccttgggagcttccatgtggtgttgggcttgtgggtgcacagaacacaagagttgagctttgagaatctttgcctagatttcagagaaagtatggaaacgcctggatgtccaggcagaagtctgctgcaggggcggacccctcatggagaacctctgctacggcagtgcagaagggaaatgtgaggttggaacccccacacagagtccccactgggtcatggcctaatggagctatgagaagagggccaccatcctccagaccccagaaaagtagatccactgacagcttgcactatgtgcctagaaaagctgcaggcactcattgtcagcccatgaaagcagccgaggggactgaaccttgcagagccacggggacagtgctgcccagtgctgtgggagcccatcccttgcaacaacgtgtcctggatgtgaaacatggagtcaaaggagattttggagctttaagatctaatgactgcctacccgggttttggacttgcatagggcttgtggcccctttgttttggccaatttctcccatttggaatgggaacatttacccaatgcctgtacacccattctatcttggaaataactaacttgtttttgattctacaggctcatgggagaagggattttccttttttcagatgagactcagactttgacttttgggttaatgctggaatgagttaagactttggggaagtaactagtgggatcttatggatggttatgaaatgtgaaaaggacatgaaattttggaggggtcaggggcggaattacatggattggctctgtgtctccacccaaatctcttcttgaattgtaattcccatgtgttgagggagggacctggtgggaggtgattggatcataggggtggttttccccatgctgttctcgtgatagtgagtgagttctcatgagatctggtggtttaaaaagtgtttggcagatgtgttcccaccccgcccgcctccatcaccttgtgaagaaggtgctcttttccccttccaccatgattttaaggtttctgaggcctctccagccatgcagaactgtgagtcaattaaactacttttgtttataaattacccagtctcaggtggtacctttgtagcagtgtgagagctaatagaggtatcagagagattttcattattcttgtgagattttcccaattgaattgacatttcagttgttggtctgttgaataatgaatgcactataaaagtggttgttaaaattatgataagggaacaagatcagtcagtaaaatccatgtatgggagttttatgattaagaatatttctgtattttgtacaggacatctgtaaccacagaaaattgcattgtacaaatgaagaagaatacccttttacatcacatgatttgtgatatctggaaaatctcccaagcacctggtttctggattttatttagatttttcaatgtattttctaagtcttaggcaatattttcagaaaagttagttctttcctactcctttgatcctataacttagccacatcattacttaagcacttagtctgctatagtggattacagagttctttaagagttgtaactcttatcttaaccactataatgtgcatagtgcctggcacattgtagacacttaggaatgcttaccatgacccttagtattgtatatttgagttaattgctagaatttttaatatctcctattgaatttattaatactattttcatacataagtacacccctttcagtgttgtgttttaagattatattacccacttcattcctcccatccctcactctcacccaccaatggcaactttgattaacatgtttgtgtatagtaatcctgtggccacaagcacatagctgtaagcaaggactgaactagaagaccaacttgattctgcgatgattaaaggaaaaatggctaggaaattgactttgaacatgagtaatgggcattgaagccagtctcacaagagtaaacgatgctttgggtgtgctgtatcacctgtgaatacagcctaaaagttatgcctgtcaccaaggaaatgtttctggttgcaggaggactggagataatactgtaactagaactagggccaagctgccaaatggcctgaatactggattattgatatttctatggaagaatgggctttgaactgccaaaataagaacttgagggtttctgtttccggtaatgaatgagtaaatttctgtcatacttaatcccctgcaataagcaactctaaaatatgcacgataaaaaccagctactccaaggaactctgtaggatgagtgtaagcagagtctgaaatagagttggtccttgaaggaaggaagttagtacactgaatactagttttcctggcttttagcctgaggcaaagcacattaggtggcactcattccaacccagagaaatctctgctgatggagaaagataaaaagaagggaaagaaaagagaacgggaatccccaaattgtagctgaccccaggattatatgtgcagagtagacataagcatctcatctaaagatgtgaactaagaccatagttggcacctgagaaacaaagtgtgcagccctcaattgaatcaagatattgcctactacaaaacaaaacgaaaacaaaaccagaaccagaaacaaaagaaaaaaattcgtcaaaataatctagaatcaggatacagtttaaaattaagctctgaaagtaaatcatactctcaaaagaaaatcagctgataccaaccattacattttggaactaagagacagattttttgtttttgtttttttaaatagctgttaactagtctcataaggacaaaatacagaaagacagttcttacagagaaatagaagcaaaaaaaggaaccaatggaaaatttaaaactgaaaaatagaatatctgaaataaaaaattcactagatgacataactgttgaggaaagagtatgtgaatttgaagaaagagcaatagaaatgttccattgtaaagaacaaagagaaaaaaaattgagaggtaggaatggcctgtgaagtggtctgacatatgtataattggagtcttagaaaaagagggtaaataagactgaaaaaaaatacttgaagaactaatggcagaaaaatctcacaaatttgatgaaagacataaatatgcaaattcaagatgcttaagaaacagcaagtagaatgaacacaaggaagactacactgagttacatcagagggtaaaactgtgaaaagccgaagattataaagaaccaatcatgaaagcagcaagaaaaaattacacaccatatataggggaacaatgatatgattaattgctcacttcttatcagaacatggtagagagccagaagagagtaaaatatctttttttctttttcttttctttctttctttctttctttctttcttttttttttttttatgatggcgtttcactcttgttgcccaggctggagtgcagtggtgcaatcttggcttactgcaagctccacctcctgagctcaagcaattcccctgcctcagcctcccaagtagctgggattacaggtatgtgctaccacacccagctaatttttgtattttagtagagatggggtttcaccatgttgcccaggctggtctcaaactcctgacctcaggtgatacacccacgtcggcctcccagagtgctaggattacaggcatgagccaccgtgcttgggcacttttacctttttaaagatattttactggccgggcacggtggctcacacttgtaatcccagcactttgggaggctgaggtgggtgagtcacctgaggtcaggagttcgagaccagcctggccaacatggagaaaccccaactctactaaaaattgaaaaattagctggacgtggtggcaggtggctgtaatcctagcttctcaggaggctgagccacgagaatcacttgaatccgggaggcggagttgcagtgagccaagattgtgccactgcactccagcctgggtgacagagtgagactccgtctcagtcagtcagtcaatcagtcagtcaatcaatcaatggtaaaagtaagaaattgccaaccctgaattctataaccagtgaaaatatcttaaaaataaaggtgaaagaaagccattttgaaatgaaagataacagacagaactaattgccagcagataagcacaccaggtaatgctaaagggaattttacaggctaaagagaaatgagagcagatggaaagttgattacatagaaatttttaccctgatactggtaaataccttcataaagaggaaaataaccattttttttgctccttcccccttcttaatttctttatattacatatgaccatttaataaaggggggggggaatagtattgtcctgtggagtttttgattcttgtatgtgtacacgtggacgtatgtggttacaggtttctacatattatgtgaaacagtataatattgattgtaagtaggccttgaaaagttaaagatttgtattgtatcccctatagcaataactgaaaaagcaatgccaaaaggtatatgtaaagagcctttaagtataacttaaaaactgaaatggaattataaaatatattgaaataatgtatatatagatatattgttcaaagtccggaagggaagctaaggaacaaaatacagaggctacaaatagaaaaacagtagtaaaaatggtagataaacacctaatcattcaaaaattccattaaatagaaatggaagaaccacttcaattgaatgaaagagattgtcagattgtcatcatggattaaaaattaaaagcaaggctggctgtggtggctcaggcctgtaatcctagcacttttggaggccaagatgggccaattgccctgagctcaggagtttgaaaccagtctgggcaatatgttgaaaccccatgtctactaaaaatacaaaaaattagctggatgtggtgatgcgcatttgtaatgccagctactcaggaggctgaggcaggagaatcgcttgaacctgggaggtggaggttgcagtgagccaagatcgtgccactgcactccagcctgggcagcagagcaagactctatctcaaaataataataataataataataataataataataataataataagtaaactaaaaagcaagccaagtgcagtggctcatgcccataatcccaacactttgggaggccgaggcaggtggatcacttgaggtcaggagtttgagaccagcctggccaacttagtgaaaccctgcctctacttaaaaaatacaaaaattatccaggcatggtggcgcatccctataaccccagctacttgggaggctgaggcaggagaattgcttcaactcgggaggtgtgggttgcagtgagccaagattgtgccactgcactccagcctgggtgacagagccagacttatctcaaaaaaataaatgtacagtttacagagaaatactagacacaggtaagttgaaaataaatagattgaaaagcatattttaagaaaacagtaaaagattgaagtgactatattaatatcaggtaaaatagattgcaacagaaaaattttgtatcaggtaatgtggattcttcatagtaacaaaagttcatcaggaggacatatcaatcataagtgtatatttatttaatgcagaatgacttaatacatgaaaactgactaaaggcagaaatagttccacaatcagattgagattttaatgtaactctttcagcaactaataaaaaaaaattactcagaagatttgaaatttattattagccattcttgatcatattgatgtttattaaacgttatatcttacagctagagaattctcattcttttcacatgcatatggtacattcaccaaaacagagcatgctgggctttgtacatgctgggccataaggtacaaaggattaagattatatagagtatgaattttgaccgcagtggaattaaatttcaagtatttggaaagtgacacacttttttgtaatcagttggtcaagagatgtcaaagggaaatcagaaaatattttggaccgagtgattgtggaaatgcaagataacaatttatgagatgaagctaaagcagtgtttggaggaaatttatatatttaattatgttggaataaaactacaattatctaatttcctacctaattaaacatttaaagaaaacagcaaggtaaacccaaggtaatgtaaaaaaaggaaataataataaattcttgaaatagaatacggacaactagagaaaaataatgaaactaaaaagagttcttggaaaagttagttaagataaagctctaattagactaatccagaataagagagaagacactaattaccagtatatttaataaaataggagacatcactgtcgatcatatggacattaaaaggccttttaagagaatatcataaacagctttaagccagtaaattagacaacttagttgaaaaaaataaattctttggaaaacacaaattattacccaggagcaatagaaaattttagtatccctatattgattagagaagctgaatttgcaattaaaaattattccaccaagacaatgtgaagcctaaatggccacactaataaattttatcaaacttcaagaaagaaatattgtgaatcttatgtaaagtcttccattaagaaaaaaaaatgagaatacttcttaactcattttattataacaaattggtaactaccattgttactgtgatactaaaattcaacaaagataacagcaaaacaaagaatcagtattcttcatggatatagatgtaaacattttaaacaaaatttgagcaaattaaattaacgataaaaaaagaagatactgcattaccaagagaggtatattttgagaatgcaagtttagttttaacatcttgaaactaatcagtgcagttaatcataacaatagaataaaggtgtaaaactgtataattatatctaggagcaacagaagtatttgacaaaattcaatacacaaaaatgataaagcttcccagcaaacttagaaggaaacttcctcagtttgataaattcgccttatgaaaagacatagtaatatactcagcagtaaaattctcagtgtgttcctcctaaggtcacaaacaagccgaagatgtttgattttaccctgtctattccaatttgtactaaaggtcctagcaagtgcaataaagcagtaaaacaaaataaaaggcatacagaatggaaaagaagaagactttcttattttttaatatagaaagttctaaagtatataaaaaggtcattccagcaagaagagatcatgatcctaagtctctgtgtatcaagtaacatagcttgaaaatatataaagcaaaaactaccagaactaaaagtagaagctcagaagtccacagtcatactgttcacacaactcctaataactgataaagagacaaaaactcagtaagaatagagatggtctgaactacacaagtagcatacttcatttaattatctaattatcaaaaagaacattgcatccaacaatgacactatttacattattttaaagtgtacatggtacatattgtccagttgaccacgtgctggtccataaagcttcaggaaatttcagacatctgaaattattcacagtatattctttaatcatagtggaatcgagctggaaattaaaaactaagagttggccataaaggatgtatgttttaacttaagcatctggaaagaacagtagagtagattaaaagcaaagaggaaaaattaataaatagaaaatgtattgaaaattatatagtagtccttccttatccacagttttgcttttcatggtttcagttacctgtggtacagtacaagatgcttcgagagatcacattcacacaactttcattacagtatattgttatactctattttattgttgttcatctcttactgtgcttcatttataagttaatctttatcataggcatgtgtttataggaaaaaacgtagtgtatatagtgtttggtactgtccatggcttcaagcatccactgcaggtcttggaacatatcgcttgtagataagaggaggacgactatattgatgattaactaaaatgaaggaagtttctgtgaaaatttacaaatgagacaaactttgtaaaactgattaagaaaaaacaagtagaactaaacttgattgtaattattttatgtatcaccaacttggtgatacataaaatacacaaaacaaaaaagcagattaattgacagagaacttgcagttcacagagtttttatttgtatatgaataatatgaataggctttttctaaacttatttcgtcctgtcatttcattgtatcccatggtatacattaaaagaaaaatgtaagtgaaattaattagtgaatgcctaagactttttcgcagagttcagtatcagtttttagtcatgtttttcacaacatacagcaatctatactaccaggaatgttcgatgatgcagcatttttaaaagagtgacttactattctcctctagaatttcttcccaggccatttcaagtttttgtgcacattgttgtcaagaaatgtgaagcgcctaagatttttatcttgtaagataagctagcttgccaccacagtttcatggatgatggcagaagacctaggacttctgaatcagaagccatgctttattatttacagcaaaaatagtagcagagtgttagcatacttgcactgatgccctgagccctggtgtgcacagggtaatgcagaggccagacaacacctgctcttggtgggctggatttcagaagaggagcccagggccaaggtccccacaattcttgagcaagaagcagacaaggcagtcctctacccttgacctcctcagttgcatatgttactgcagaaactgctcagccagaggagatagataacccttgcactctggcacactcagtgggaacattgagggctgctcagagctcacccaacagtggttagacaggaacacctgtggcttactgctgcctagcttatggcattaatgagacacatcgggtttcaaaaaaaccttaaaatactttttaagaaatgtcttagaataggtgacacactgtaagtaagtgaaatcaagggccaaatttgaaatactgtatttaaaaaatcatggaaaatgcaacaaacagctttagagctatacatttgaaaactgataataatttatttatcttaaagatatgtattttcaaatctatatagtaaaatctagttagaaatcctaactttttttctggtggaatttaatgaattgattacagaattcttaagatagtaaaattgcccattggtagttgggacagttctaaaagaaaaatggaggagtgctttcagagcatttaattcttatcagtttcataattgtctgtatgactgagggataagcaggttgaccaatggaattagactaagctattttactcggatatgtatgtgtgtattgtggaaagaaagaggtagatggagagaaatttacatgagaagtgggaagcgtgaatttaataaatgatattaggatagttgaatttgcatatgcaaaaataaatcttttgatggatcacatgcccaaaaatgaagagcaaaaaactcaaccactagaagaaaacataggagatacatttatgacttcattgtaaagcaggattactgactagaaaacttataaaggaatatcagtagctataactacattgaaatgtattttaaaaatcctttttatgcaaaagacaccataccccatttaaaagacaagccacagagtgggagtgtatttgcaacatctgtaacaaaatgtgtatatttagaatttattaaaaattcattcaaaaacaattttaaaagatcacaaattcaattaaaaatgaacaaagtgtgtgaacaggcaattcacagggcagaaaacctgaattaaaaatgaacatttgaaaagatgctttaccttattaatactcaagcgaatgcacctttatatttaatgagaataatgtaccatttgatgtcctcaatgttatcaaagctatgtctaggatatggagaaatatgaactcccacacaagtcagtgtaaatagacacagacatattggaaagcaatttggcactgtcaactaatagtgtgtgtttttttttaagaaggtcctgtttgtggaaatttcattatgtgtcagtttcttaagaaactcttgtcacatgtgttttggaagatgggaatgaggatattcactgcaggattgtttataataataataaattggaatcagtataaatggccataaatggagagatggaaatataaattgtggttctttgtgtagcagaatattttggggcagtcaaaatgatgaaatttgatcaaatacacttgatttaacacatactacatcttgatactataacgttcaaaagaacagtttgaaattattctgtatatttgattagtgataaaaatatattggtgtgttacaacaaaagggaaacttacatataatgatatggcgataggtcattctatatgtgaagtggaatttcaagtgatcttatttctagtttattaaactttcagaaagcactttgaatattgaatatttgactttttctggcataggtaattagtgactgttttctatttaagatacaaaataagtccagcaattgacatttgctatgtaatcaaagcttttcactttttatttttatctcaaatcggtcacctctttgtggtataagctgattatttatctctcaaatctgtcacctcattgtgatgtaatctgattatttatctctcaaatctgtcacctcattgtgatataatctgattatttttaaagagaataccttttgatgggatagtaactaaatgtggtattctaggatgttaaggtaaattaagattaatatttgttttgtgggtccttcattaatgtctttccttaggagtgcaggcaatttttagaaaatctaaagtacatatatgcacacatgacactcaacaacatacatacattgtacccctcagtgtctacctgttgcttgcaactcaattatggggccttttttgggaaaaatgtagagtttctaaagcttattttatttatttatttttttgagacggagtctggctctgtcgcccaggctggagtgcagtggcatgatctgggatcactgcaacttctgcctcccagtttcaagcagttctcctgcctcagcctcccaaatagctgggactataggcgcacaccaccatgccccgctgaattttgtatttttagtagagacagggtttcaccatgttggccaggatggtcttgatctcttgacctcgtgatccacccgccttggcctccgaaagtgctgggattacaggcgtgagccattgcgcccagcctaaaacttcattttaaattaagcttgagggcttttatggtctttcaatatacctttaataccttgatgacttatttcaagaaagctttttatttttctggtcttaactattttccatatttattggattaatctgtttattaaataaaatatgttttcatactgaaatgaatactacttgcgttcttactggtgtagaggtgtaggctagagtatttgacattctggaatatattttaacttacttggctttaaaatactccttatcatactataactgttttgaaacacatatcataatgttagcctcttgggttcatgccatgagctataattatggtgttagtgccataatgggatgttataagttttattttagaatttttatgaaggtgaagctttaaagaaaagcttaacaagtttcaaccagagaagcagtaggggacacacacacacacacacactcactctctctctctctctctctctttctctctctctctctctctctagctctctctagctctctctgtctcccttattatgaggaattggcttgtataagttcatgctgactagtctagagtccacaaagcagatgggtaaggaaggaagatccagagggcactgttgtaaacccagttggtgtttggaatatctgagcttagaaaagaccaaagccctcttttaaagacttctaatggaatatgtcaggttaacccaggataatctccctgttgattaacttaaattcaactgattacttttcttaattacatctgcagaatttctcacagcagtatctagagtggttttttgttttttgttttggttttggtttttgacacagtctctagctcttttggctcaggctggagtgcagtggcttaatcttggttcattgaaacctccgtctcccaggatcaagtgattctcctgcctcagcctccaaagtaactgggattataggcgagcaccaccacgtctggcttagattagttttttcttgagtagctgggagaaggtatgtgtatgctactaaatggccactgttttccatttatagtccacctcttgaaaaaatatactttatagaccatcccaactggaaacatacaagaaatgaaattctggaaactctagttcagcctagttaagctgacacactgcaaaggtatcacaccggataactaacttttttccctaaatagtgtctctctttattttgtcgattgatattaaaggatattttcattgatgagtgagggatataaatttaggtgttattagatgatacacagctatttctagaaggttaaggtaaatctggtaacctggtccttttttggcttgtatttagcttatgtttagtaaatgggtttacctgcccctgccctacatattctttgatttcctccctggcaccaatttcatgtgtttagtgtacaaactccttttaatatttattgtgaaggaaagtggtaattcaggaggtttttgccaaagtaagattctagtttattagaatttgtgtaatctagagagatgtctgattcttatcttaaatggaaaaaagctatagaagctggctagggaaatcttgtttttcaggaaaaactcacatccacggaaggtagttgagttcatttctttatttccttattcaacagacttcaaaaaaatttttcctttgtggtaggctgtgcgctaagtgtttgaatatccagtcaaagataagatacaatcaatgcctgcccttttgtagtcaggatggacagatacaaattttaactagaaggggccgagataagcaaaattggaaatcatgttttacatagatactgttttttgtgggtccatgttcttagttttttccagtaatgggtataattgagaagagccacagactcatttctaaagtagtcattcaggcttcttgcatataattttcaacactcttaaaaaccttatgaacattttaaggaagagagtattttgtacctttttgtgaagaaggctttattttggctgttgatattaaaaaatattatatttcattgatgagcaagagatacaaatttaggtgttactaactgttgtcattaaggtcaagttttatacatgtaaataaattgtagtttatgaactgcagacatagaggttgaggtttcatttattctgtagtagattgtagtaactactctttcagcatgatttacaaagaaaatcaaactaactcaatttatagattgcccttttccatagaatgtcaattttgtattttggcaagaatacctgtgaggtaagcctaggaggcacataacaattctgccatttccaactcttccaaaatgtaaataggtatttagagttacacaccttgtatggctacatgaatttatttatagtcttttctttttagagtagcatagcgacaaaagtagtcactggactttctgttcagtgtgaagatctgttggtatgtgttctgctttattaataaatgtagagagctgaactagagagttgatattcattgaacatgatatatcctctccctttccccaatcagattcatttcactgaataaacacctgagtatgaaggttatttcaagaagtgctgggcaggaatcctaaccttcagtagcacatagtactatgaaatgaaatgatatgtagacatgcagagttccttataaacatatgtcattaataagaacacatgagtaggactgttggagaaattcaggacaaaagagctcttaagacagcttgacaaaaggggacctcagagatcgtgccagatttcctgtgggccttaaaaagagtgggtgtgatgatatttttatgtggcacagtggcgacagagatgaaataaggagtcagatttgagttcaggttctgggccttctatttatggattgaaggacgtaagacaagttacttttgctgttgaaattttcacatgtgaaaaataagttaatatctaccattcaggcttactagatattaaaagtattatttttagtgttctttaatactattttagaatacaggcagttgatagatcctgaggtgtctatggtcgttttcaaaaagatgttttctccaattataatgattactattaacatttaaattgacccttgctctcataattaaccacaataattattaatgatagcttactttttaagcattatagttattttatatagttgttatataaagtttgtttaatatctcagaaaatgtttttcattgcattcacattttagtgttgtgatgaatggcatgttacatctgtttcttaattaaggggaagtgggccaaagatattctgaaagagtagagttactttttgtcttaggaaacatggctttaagcactagtggacaagtaacgtaccctttgaaaatactttcttgtcaccagtgaaacattttagagctgttatcaaagactgaagcaaacaatttttgattctatagttatatgggttgataatagggagaggaattgaagaatttcaatttagcaccatgtctctgaaacttgaacatacttgaaatgatttttaatgaaggaataaaaacatggattctctgaacttctattttgtatttctctgagagattactgttttcttggctgatgtagttgaattcttaggtgtttgcagtaaagtataagataataaaatggttaacgtttaacaaactcatcattataacactggataatgtatagaatatgtaaaaaatggcatttattaaaaaaatcatgagtgtaacagtctaggttttagctagcaagaagttcaggattttttttaaaatagtgtttggggaaattataaatgtcggttgcataattgtaattcatgaaggaagacattcatacagctattttttacctgttttcaaaactatagaaaaaaaaaggtggtacgagattgtcctaagaattatcctattttagcttgactaccacctattagctacaaggctttgcagtggtgctgttagctaggttcatatgacctatgtccaaatcatgctggcaacatcattgaagaatgattttttcaatgctttcaagttattaacatatttgaatgtacatgtcagtcttacccaaaggaagtgaaaataattcagtatcttcaagaaaatggaaaaactgcattatttaatatactctgctgcattaactatcactttttatagttttgctaatcaaattatgatgaagggttatgagaaatatatcactttttatagttctcttgttagccaaattttaatgaaagattggaagaaaagtctaggattattatgggttttggatgacagaggtgatgtaagtgtaggagaaatgtatgcctagaggacctaaagtcacctagtttttctaatgacgtaaaattacccttggtttttttctgctgagaagaatgggtgtgtgaaatacacgttaatactttggaatttaagtgaagaaagaactccatttaatacactaagcatttgtaccatctagtattatatttttaatctgcatcagacattatgtcatccgaatatcagcccatgagtatagaggtatgctcttcttagtagctatacctgctgccacctgactgtgcacaaggagcaccatgctttggatccttccctatgggaatcgctgggatgtgttgtagatacctgtctatatatttttcagttgaaattagaaggataatcttacagatatttaaatgtgttaaaccttaaatgtaacaaatattttagattaacatatatagactattaacattgtgtttgattcgctcttattactctaatcttaattctagaactttcaaaggttgaaagtcattaccaagaaaaaaatcatgacatcacaaataatttggggcaggcagttagatatatattttttgagacagaaactcactctgtcgcccaggctggagtgcagtggcatgatctcggctcactgcaacctctgcctcctgggttcaagcgattctcctgcctcagcctcccgggtagctgggattacaggcgcatgctaccatgcccagctcatttttgtacttttagtagacagggtttcaccatgttggccaggctggtcttgaactcctgacctcaagtgatttgcccacctcagcctcccaaagtgctgggattacaggtgtgagccaccatgccaggcctgtattttttaacccagagggatcattgattaattgctaatttattttttactctggctttgattttgaggcttcttaattgaggaagcgggatgtgcttatgcttgattatgttaatataatgacagaaaggacatcctgcagtggaattaaggggaatccctgttagctgaaaagccattttttaaggaagatacaggaaagaacagagataggagttacatagtaaaagtgttaagtattatgaactagtcactgtcttcaacatactttctttaattcttgcaaccttgtaacctttacagatgagaaaataagatttcaaaaaatagttaacattttgtcatataaccttgatcagtcaaccctcatatgtgcttttatataacacagtgaactttggtgtcactccctcaattgcaaataaatagttactagtctgtaggctccttgagagcttgcatgtctgttcacttgcctgtcataaaccttgttcactcacagggtgtagtagaaactcaattattatttatgtatttattaaataaataaatgaatacgtgagtgagttgctcaagattacaggggcactgaaataagactggcatttgagtctgtgttctttcccccactctgttttctacccttgtctggtttttaggggttatggagtgtggggagaggcctttttgtgcgtttgtttttgagtaaccagttcttttcattttgtctctattctccagtgagcaaatgaaaattcagggtttggagcaaacttttaacgttctgattatcagtcagcaaatatgagtactggataagtgtttagcattgtggtaagccccatggaattataaattatgtgcctgtttccttgccgaggttctcaaagttcatttatgccaacatagctcttccatacacacataaatacgtattcctgaacatcgtcataaactagggtcattattctacacagttgtgtttttgtcactgcttttcagtgatgtgtgcacgattacatgaagacagctgtgaattaatatttggggagtacgaacactgcagctatccacggtgccgttaggttgaataggacgtcgcaacctaccaactacaaatgatggaacctcctgttagtcttgtatcttaacattcccaggatgaaacaccttttataacgtaatgagctatgtgctgttgttctcttacattttggaaatcctaatatataacattaggctgtgatcttttgctcgatgaggaagtaaggcagactgtatgtggatccttcagcataattcttactttgcttgtggttgtagattatgggactctggttcagttctttagttttgtgtttttcattttaatttcacagaaggcaggtaaaatactctctttcagtgttgcctgactgagtttttaaaataaatcttgaatttttcaggtatttattttccctaactaatgtagaaaaatacacatgtggaatgcacgagaaagcaccatatggcttaggagcttagtaatcatgtaatcagtatattttatgttacttgctattttcagtttataatctaggaatattaagagacaataataaatgtcttttaagtgcttactatatgcaaaacattttggtagatattttagggaagtggtttcttatatagaaggacagtttagcatttgtttaataaatgcataattacagaaaccatggattccatagttccttttaaatgagtttgtagtatgttaattatgatagtatgcatatatgttgagaaactagtatatttgtatttgacatgatttcatttgtagaattcagagctactttgtttatacatatgtgagacaaatacagaaattaatattttaaaaactgatgaaaatatcataaaagatgtgcaagttcaaatctgggcagggcagaagagaaatagaaagctactggttgtgtaccaaacttttctttttagatgccttgtgaataatacaaaaaattaaaaggagcagtctttgctttctagagcttaccattatgtacactggaatattaaagtatgatcttaagtatcattttagagccataagattcgatggaagcaaagtggggcttagggagaatgaatttggatagagtagggtagtggaaaacagttaaggagtaggtagtatttgaactcattcttcaatttcattaagtttttataaattccctttactattcgttgtccattttgtgtactgcttgtgacatactaatagtcacggtttatcccactttccaggaaactgtaccggtcgtcctttacgtatcatttctaatccaaatgcttcatggagggcagggttagtgttttgatcagctgagctgtcttccagtctgaaacccaaagattacagttgtgtctttattaagctttttcttaaaaaatgtatttaaaaataattttattttcatgtaatggttaatatattttattaactaagttggttaaaaaataaattatcttaagctactctttttattctgaaaatacatttccaattttatttttctaaattataaccgctagtcatgtcattttatttgttgttcagtcatcccttcccagtatttctgtttaattttcttttttttattttttgagatggagtttcgtttcgctcttgttgcccaggctggagtgcagtggcgtgatcttggctcaccgcaacctccacctccgaggttcaagcgattctcctgcctcagcctccctagtagctaggattacagacatgtgccaccatgcccggctaattttgtattttagtagagacggggtttctccatgttggtcaggctggtcttgaactcccgacctcaggtgatctacctgccccggcctcccaaagtgctggaattacaggcatgaaccaccacgcccggccttctgtttattttctacgatcatctattctagattctagcctgtccataccatatttacattatggtaatattaatttcagagctcttaaatgacgggtactcgtccatgtgctatccgaacactaacatttaaaactcattgtagctctgagatgtaagtactatctttatgtctcttttgtagatgaggaaactgaagcatagataaattcaagcattttgcctaacactaaacagctattaagtggttagtaagtgtggtatcataaattccttagagtatcagaaaatgaatattaaacattcgcattttaaaaatcttattaacaattgttttgttttgaatctctgggatttatacctaaataaaattccctctgaagaatggagcatttgcacagtgaaccatgtgctgccactctcaacatcagtacatgaacctgttactgacctttgcttgagacaggctatatctggatttttcaaaacatcttgtttccttttttttttttttcctgttctctctctctctctcccctctctcctcttttctctctctcctctctctctcttctttcttctttccctcccttcctttcctttctttcttgacggagtcttgttcttgtcacccaggctggagtgcagtggcacagtcttgcctcactgcagcctctgcctcccgaattcaagcagttctcctgcctcagcctcctgagtacctgggattacaggcgcctgccaccacacctggctaatttttgtatttttagtagagatggggttttgccgtgtcggccaggctggtctcaaacttctgacctcgtgatcctcccccctccccgcctcggccacccaaagtgctgagattacaggcgtgagccaccacgcccggccatcttgtttctttttattgttttcaatgaaataattgtaatcttgattatgttgacttttaagtattgtatttagcctttcttcttaataggtagttgtcaggtcgtcaaaggcagacgagtgtcatctgaagtcggtttaactgagtacattgagtcaggtttctgcccattagtttatctcatttttaaatgagaaataggtgattataataatgcctacctctaagcttattaaaaggattaagttattttatgaatatcaagtactgagtgtaaagccctatatgttttttgtttgtttgttttagttgatattgaccacactaactttatttttgtatctcatgctgtgctctaaggagcacttattagaaagtctgtgctgaaagatatggagatgagtctgattccatacttcttgaaactttttaggaatcatacataccagactgattatgtcaaaagaaaaaatagtagaatgggagtattcagggaacatcctgtctggtaggacctggaaggggtatatttgattgaaagatgattattgaaactgggattttgatgatttaggaaggaaaatgggtataaggtagaaatgtcttttatttatgtattttcccctggtatactatcagtaaatattcaattgagtattttaaaacatcacattctaaaacaattatttcatttttctgtgccttgaattgtgtatcttagatgatggtgagaataacacctaatgtacaaaatctcacatatgaattagtgaaaggattcttttaatgctgtgaggaaatattttgtgcttcagtgggcagtaacgaattttatgtgggtgcttgttagcaacaggagctcagcccaaagtttccagtttaaaaggatttcccaacaatcatttatttctatcaccactatttttgttaaatatttgccagctttaaagttgttgggaaataacaaatcacttgatgatttttgtctttttatgggaaactttttgtacatatttaattcactcttctcagccttaactatgtttcatcaagatcatattcagcttttcaactgatcttgttcagaattgtttctgcatgctaaaagcagctcatatctagagaaatctcactcattttggtcatcgtggggccagaatagtattttggctagtattggggttatataaatttagtttagacataaagtaattaacaattaaattagtggaattaatgtatgaaaattggaagacatacctggcagtcaataagtactgtgtctgtaggagatagatgttacagtcctgttgtttttaacttggaaattatttggcaaaaaacaataaaagttatttgaatttaggaacttgttcctttgtgcctaatttaataagtatttgttgaatgcctgctgaatgacttcctagatgatgatttcaacggactgaatataaaattatcctagtcttcatactttattagaaaataatttgctttgaaagtgtagtttttgttggactcacattcaagtttttaaaagttttttgagggctgcttttataactgagtcagtgaggaattaaattgtgtgaaatctactttatgcccagtttctcaatgaacatttcttaaactaatctaagattatatgcacaactggagatggtaatatgtctaagctttaatatttgtcttaaaatgtatatattcacaatacgcctgttattggaaccttggtttttgtcagcatgtaacacttttgaattctgtttggaggggttttggcgtatgaactttcacattaagagcacagtaggagcagaagtcttgtgctcatttgcttgactacaaatgcataattaagagagtctgtcagcaggggtgggacaatcagtatactctaatgcttcatgttatagaatccctttgttgttcaaacagatattgtaattagagcatacttttaaacttcatagggcagcgattcataaagtttttcaaaaatccaaaacaaatactttgtttctcaaatgttgagattatttttttactttgtagttttacatcactgtatacagtggtttcaaaaatgaaatggaagttgttttattgaaaagtggtaaaatttagttataaacaatggtgttaattagtcctagcttagtaataatgttggaaatacgcattgtatattaagatctaattttagttttaacaacctcacctattcgaaactttaaagactagaggaattttatgtaagtgaaatagctacagatttatcctttttgtatatatgtatcattgtaatttgataggtgagtctctcatttagggagaaagcatttttctccctaggtgcaagagatctgttataccagatgtttttctcccagttcttgacattattctggatgtgacttactcagaaattcatttatggagaaagaatacttgacatgaagttaggagataggacaaatatagaaagacaaaaccaaatctactaaataatctcatctacccctttatctgccttcaaagtccccgccagctctaaattctgtgaggacaagatgtgcttagaattctacacaaaaatatttaaaggtaaaaaggtaaagtaaaaaattctagagattccactattctgtgttccgtttctggtttttcactattttatgatgctgttttaggtcaatttctcatgtaggtgatatgttgtgctaggaattagttgttgagggtgcatgctgtaaagttgctctggctaggtatggtagcttggtggtacaacacttactgcctgacttgactaaatcatgttaaatgttggtaagactgatagtcccaggttcatgtaacttatgaggattgaatgaggtgatgtatttatattgcttagcattgtccttggcaagcagtgtttgataaaagcttagttgccatcatcattttcatttttaagtttgcttatcatcacctaagtctaatttatctcaccatagtatacttgtcaagaatacagaccatgataatcattaataattgtgactatctgctctgccatcaagtgtgaatgaattataaagttgcttagcaagctactatatttgaatttgctgtataaatagagctattttccatttccatggaacctctgttgttattgcaccctaccttaaaagatggaaggttagtggttttgagctctgaacatatttatacatatagtatttatatgtaatttgcctgtgctgtcactttgctgttatattgagatagaactttagtcttgcagttttaaaaaatacttttgacccatcttgtctcctgttcttctgatacatcaaaacaaggtagcattgaggttttagagtaaaagataagcagactgatgggttgtgaaaaccagacctcataagagttattgtagaaaatctgggagaattgactagaagtaagagaacaagaaatggagtaaaaattgtcatgtacacctggtaactaaggagaaagaaagaagccgtcccagaaaccaagatacaggagcaaaggtgaatatatgagggattaactaaacaggcacagtaatcattagtacagcagagcactgtgggaaagctgcagcatattcatgcacagtttgatatttgatttgaatgatgctcttcaatcataaaagttcaattattcaattcagtaaatacttgtttagagccagatatgtgtaaaatcaatgtgtacatactgtcaagagtatgaaaatcagtgagatgattctgatattcaacttggagcaaactttctaatagctagaaaaagacaatgcacagataactaagttactatataatacagaaaaaaaagaaataaaagtaaatattaaagaaagggaaaggaggcattctagacataggcgatagatagcttccataaacttatgggtgtcaaaatccatgtttggggaatggccagtaatacagcatggagtaaatctgagcctatcgtgggaagtgaatgaacacggcacttcagattagtgtggatagatgtgaatgggtgcatgtgcagcagccagtctctgtcaaagcacaagtaagccatgactgtgtttcagagatttcctacaaagcctcaaattctaaaaatccacgctgattcagaaaattcattcaggatgagtaatagctgagacattaattgtggacagatttgcagcagggaggtatgaaccccagtttggacatgtggagttcagactgctttagagattgaagtatacatttctagttggcagttgaatttggaggtctagaaatcagggggcagtactgtgctggaaaatgtaaatttgggattatattgatgcaaaactgtgttcttctatgttgctgaagatttagtagcacatatattatgaaatgatattgcaaatggtaactgtaaaacagacattatagtagtcatgagctatttttttccacatcagtatctcagctattaacccctgaaagattgtttgaaacataattgtaaaaagaaacgaatgcctcgtagaacacagtttctaataaatacagcatttttggtgtgcgtccatatcatcatccctcctgtctgcttatttcaaccttttctttgtcctgatgtatttaagtgagaaaatgggttttgtgagtggattcttactatggatattttaagttcagaagtaaccatcctataattgcatctatccttaatgactaaaagaggaccttttggggtgtgttttattgatttctctataaaatttgccaatcccagattgcctttataatctgcttaagaaacagaatgagatcacagggagaaatagtatttgtattaaataattactaagctgcaaactcactgaaggaatttaactcttcttgagctggaatggactacagtagaatgaatatggcttcatggcttctgcgtagcatgacctcaaagcctttttttgtgtgacatttgatatgcacatggatgaaagattttctgaggcctgatgtggaaaacgggttggtcggtctctctcttcacactgcaccccctccaaaacactaaaagaggtgcttttagtgtttactttcaattgctacattgtttgattttgaagtgtccgcttcatttattccttgtggtgaaaactcagtgggtccttttcatctggaacctcagatccctcagttttgcgaaaaatatataacattgatgatttttctccctctgctttctttttctttatattggtagttggacatcgtcatttcagtttctgaacctcttggactagtcctctaatattatacagttctgcaccatttttttttatctctgtcttttgctacttggagagttcctcagtttgtcttccaaccttctatcaaatttttcatctttgctctcatgtttttagttgcaggagtttctatttgtattcaaaatttttaaatagagcattcttgtttcagcattgtagcgtcttttattaactctctgaagggtcagttgttcaagtctcctgtccccaagatgtgggcctgggttcccttgctctgcatttggagcaggggagatggccggccagcccagctgtcagagtggaagttaccctgtcaactgttctcctaatgcagtttgagcaagtgttttacttcctttcagaatcagtttctggtctactgctgggaattagggagtgcttgatagctagccatttgtggacaggggatatgggaattgaactgctttttaatgagagttcatctagtcctgcaatctcagccccaccctcacccctgttttcactgctgcccatttcctcagtatttttggggtggattgcaaggaaataagtttctttcttaactagagtcaggtaaattttaagttaaccatctgctttctagattcttaatttttaaatggtttcctttcccattttcttacttcttacgagtttggacattttatttatttatttataatagacacagggtctgactgttccccaggctggccttgaactcctgggctcaagcagtcttcctgcctcggcccccccaaagtgctgggattacaggcatgagccactgtgcccggctgagtttgtacattttaaactctgcagtgttgtagaagaatttttggtgggagtgtaagtacaccattccattaatttctccatctttgaaaatttttgctccttcaattgtttttaaaagtgtaagcaaaaatgttgattttgaagcaaacagggtagatgtagctttctcctatttttatatttttaactatcatttaagttgttgaattagtaagagtacgcattggccaagtgttttacaccttaaaaatgtattcttgcaataaagcaaaatggcaaataatactgcaactttgtttctatcatgaaaataattattccttttaaattctctggcttttctccatgtatagaggtttctgcggcaagtcaaattttagtttttattcttaagcttttctcaaaaatatttgattataaatgttcctcagttttcattgtattagtatctatatgcattagtgtttgacacacacacatagagcttttaatgtctttgtctatttataataacatctgtatcacttctagattggtttgagtgaattgattgggggggaggtggtctcatgtattgcatttttcttgctgctttgcatgcccgttaatttctaattgtatgccagacttttaccttgttgggtggatatttttatattcctataaatatctttgagctttgtcctgggacacagttaagttagttggaaataatttaaggcatttggtcttacttttaaaatgtatttagttgtactggaacaatgcttagattaggtttagttttttcctaccactgaggcaagacctttctgtgtcccttacccgtggggaatccttcaagtctttcagtcttgttcttttctagagccaggcactttgacctggaatccttttgggtggttccttccctggcctctggaattttctctcaagtatgcaacgatcagggttcagctgaatatttgagtggcagctctcccaggactctctgagctttggctgcctcggtttccctggactcttgcttagtctcctcatggagttgtctggagactctcaagccagtgagtgggggcagttataggctcacctcagttgttcccaactctgtgtcatttgtccttagttgtctgatgtccagtggcttgaaacttgttgatacgttttgccagttttttggttgtttcagcaggaaggtgaatctggttcctgttactatatcttgcctggaaacagaagtccctcatatatatgcgtttagtcaaataggtgcacttttaggcccaccaaataataccagactagtagcttttgtaggtctctctccaaaaaaaaaaagataaataaaaaatacaaattttggtgagaaaatactgttagcattcttgaacataacaattgaaatctggataacaaaactaatttttcttgccacagttagagatattaatacatattttatttcttgccatacagataaccctgaggtttccagtttcttgattcattgactccttggtttcccacttagtttgcatggtgtaccctagtcaaaaagaaatatttcagagttctgtttattaaatatttactctacaaacaactttgaaacagactatacattttatttgtaaataaccacatttttactaatagcatttgtattttcttgggtgctgttcaaattctcaaactttggaatcagatttttgtactgccaccctcttttcttgttccacattgatttttgtatgttcttgatttttattacagcaaccgctaacaacctagctttgtaaagatatgacatcatcaaaaagaatgtaatgtgaccttatgttgaaacagtcagatattctgagctggtggttcacacagtgtcggacagatggtacccctgtaaaatgctgtgctgactcagagttcactctttggaaatacatagatggcccagcataggattgtgtctgattttttttttccctgtatccccttacaatatgtggatgcattttcatcctaaagatgtgttgattaaaaataaagcagaagcatttactgttaaaatttatttttagccttattggctaagctcaatcatgtgaattgttgcagaaagcagttttattatgcctgctttattttcttttactggaatctaacaattaggtaaatagtaacttctaaaataaaggtccaaaaacagcagatatttattgtttgtctgtggtaccttgctgtgtgccaggtgcatttatatttaccatttatatactacttatatattcttattttatttaaaaacactttctctaaaacttaaaacagcgattctgaaattatgccaactctacttaacctccctgtagcttaaccaggttttcaacatggggatatttcttactagaagacattaaggaaatgaaatatagatattctctatgaaactagtatttatgacttgatataattaaagagtagccttacagttaattttaaggtatggtctgatgggaatgtagataaaactattttcataattaccgcatgaaatacttaaaacaagtggtagtcatcttacacaataacatctatatgcaaaataccttttctaatgctgaatacaaccaatgtcattaaaagcagttgtaatgaagtggaaagatcactgaattagagaatgaaaactttgattcagttcctaaattgacagcctgttagctgtgtgacattgagaggtgacccccttaaccttgatgaccttctgtttacttataagtaaaatgcagaaataatgacatgtttctcaaagtgtttttcatggtaatgtaaggacagtatcagatgtatgttgtatgatactacatacatgatgatgatgtatgcttctagtgcataggagcacgcttggggctgatctttagcatctggttctgtgcctggtagatagtaagtgctcagtaaatacttgttggattaattatcatttgacccagtagtctcacattcaatcaaactttgaggacccagaaaaataattcaaagacttgtgccatcatagcaaaataatgcaaacatagctgaaataattgacaacaggttagtattatgaaagatgtgctctctctttaaagagaataattttaatcatgtactctgtaaattttttaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagtaagtaataatttccagaccttagatttgggcctcgtccttttttgtcagtttattttaaattatcgtaatgtttataaggaataggttattggttgttagaaattttatttaagcataaaattaaaaacacctgactgatacttctaacataataaaaacataaagttcgtatttaggggtccttagatagacattaaaaggggttttggagggtgacgtcgcgtaagaaattatccagatgcttttgtgttatcagttctccttccttcccggtttctctttccccatctcttcccccatctcttccctctgccccccttccttgggttggctccttattgtttcttaaccctttaatatttttagaaataataattgtactactcccagagtataatttttttttttttaacgggaaatgaaaaataaattactggttttctgggccattaatttttttttcttatattagtaaaactatatggaaatgtggaccctaatttgctattggaaaaactagggctgggtgcggtggctcatgcctgtaatcccagcactttgggaggctgaggcggttggatcacctgaggtcaggagtttgagcccagcctggccaacatggtgaaaccccatctctactaaaaatacaaaaaataagtcgggcgtgatggcaggcacctgtaatcccagctacttgggaggctgaggcatgagaatcgcctgagcctgggaggcagaggttgcagtgagctgagattgcgccactatactccagcctgggtgacagagtgagaccctgtctcaaaaaagaaaagaaaaaactaggaatactgttagtattgtgtccaacaaaaagcattggcatttacataaatgagttatggttcctgctgctttttatttcccagatagcctattctttattaccctgatagtttattcaacaagtaaactcacaaatcataaacatttcccattaacttgatgaaattaattccttggaataaaagagttttatgtaaattctgttggtagattttattttttttaatgatcaggttaaatataaactaaaatctatatttgtgtactattaaaccatggaatctttctcattttccttaattgtgtggtattgaaaaactgtatagaaaaggagattttcgaaagtatactgggcaattagtgtcatgatcagaaaaagttatttaacatcgacttttactgctttaataacattttcttttctgtagcttactttattgtaagaatacggtatataacatataaaacatacaaaatatatgttgatcaactgtcaggcttccagacgacagtgggctattcgtcacattttgggagagttgaaagttacacaaggatctttgatgcagtctgtgtccctgacaaccgagccctcccttgttgtttgaggatcaactggatattgttagcgtcttttaaattttctatttacccagtcacctgtaatctcttgtcttgcttaccatttttatttctagtgtttagcatagagcccagcacatagcaataacatagtaaattgaaaaataaatgattgaatcttgtcataaggtaaaatcagttccttcatcttcactatagaaatgcataaaataactgaattttcctgaagcatcaaatgatttgggtttttacttaaataaatgtgggagacagaatacatcatatttttgagaactcacttcctggtttttgaatcccagctttgtgacttttaactgtcttcattttctcatctatgagattggaacatggccaagcatggtgactcatgcctataatcccaacactttgggatgctgtggtgggaggatcatttgaggtcaggagttcgagaccagcctgggcaacatagcaagacccctttatacaaaaaatttaaaaagtagctgggcctggtggcacatgcctatagtcccagctacttgggaggctaatgtggaaggatcgctgaggccaagaagttgagctatatgatagcaccactgtacgccagcctgggtgacagaataagaccctgtcccttaggggggaaaagaaagtttggagcattataaacccctatacttcttgtgaagattaaatgagatgatacatggagaatacttagcataatacctagcacatacatgctctgtaaaagtttgttgtttctatacaaatgctgatgataaaatgaatgcattaattcaagttggaaaaaatgtacagaaatagttccttgccaactcactgttactgttttcagagaagttgctttgacttctatgaaaatgcaacataaggctcattagtttatcattgcctaaatattttcaaaggcagatattttatcttgaaatgtacctttaatagtgaggttcataattttgtattgttgacagtttgaatagcagatgcccagttaccctgtagattaacagaaattgccagtcttttggtttggaattctcagttacgcttttcttgttcgttcagtattctgttgggtagtttagactttttaacttgttaccatggtcctgaaaaacaccaagttcagtcaggttacttcctgtctctctcagatttgcttaccttccttcatccccattgcctttacctacttcaaaccatgcttgtatcagaaccccacaactggtattccttcttctggggcctctcaaacccatctttactttgcagtctattgttacctttccctgcttaaagattttttagtggtgccttcttactctgagaaaagaatacaaaactccttagcatggcctacaaatttcttcatgatttgccatagcttacctttcaggtttcatttttttactttttgctatacctaaagcacacagtcatatgtacacatcttcctcatcctgccacagattgagttgttctgtatttatttgaatttcttaaagcttcagtcttctcacctctgggccttgtagttcattcaacaaatgttaattgaatgcctgctgtaggttagacactgtgacagctgtggaggatacaccaataataaataaaagctgaccagcaaagtgcctgccatcctgaagtttaccttctgattggggttggattactgacaatgaggaaaacaaatataggcaatattctcttttaacaaagtgctgcgaagaaaaataaagcagaataagggaatagagaactgggattagggaactgctattttatatgggctggtaagagaaggtgacatctaagaaaaaaccttagcgaaaagtgcggtggccctgaggcatgttcagagagtatccaggggtccagtgaggagcttaatgagccggctgaagagcagtaggaggtgaggtcggtggggatgggaggcactggcagatccaaggcctgtaggcatgggaaggagattgggttttagtccgagatgagaagctatttattggaggaatttgaggaaaggagggacaaagtgtaatttgtatttcaaaggatcattccagctgctggcctgagaatagactttgagggcagtggggaaagcagagattccaataaggaagtctttgcagttcaagttagagattaaagtgatttggagtagtgttgaaggtgctgagaagtagtaagatcatggatttttttgaaggtaaaactgctaggaattttgacagacttggtgtgatatgatatgtgataacttcaagcaattggagttgtcatttatttacacttttacaagagcaggtttgggaggaaagtcaaaaaattggatttgaaagtataaaagttgatagcaaatgttgaatgggcatttggttataacaggaattaggtgagaaagtggaacctagaattatgtagaattaagaattgtcattagatcaaaagctttttgagccatgagactggatgtatcatcaagaaattggatataagtatagaagaaaaattgaggactaaacctggggtgcttcaccatgtaacaggaagagagggaggatccagcaagggagagcaaagcggggagcccctggatttggaggagagctgtgagccagtcctggaagtcatgcttagaccttttaggtaggaagaggaaatcatcagccattggatttggcaagtagtggtcattggtgaccttgccagtcaatttgttttttttggaacagtggggttaaaagtgtcactggcatgggttcaagaaagaatggcacaagaggaaaaagaaccgggattttttccctcttcaagattttattatgtttataaataatccttcctgtactttggcctctcggttcttttatattgcttcacctgcagtgatcgtgtcttccactccacctcagtcatccagcctcatggtagttccttagacctttccattacccctaaaggtgccttcctaaataggcagcggcagaatgtccagtagtgaacatttcccttctcttcagtggaagagatgctgcatgaatttggcagagttaattaacttgtgcatatatacttgaagggtaagtctcttgaagtagaattactaggttaaagggtaagtgcattttaaattttattattttattcatgttaaaatttctaagttgccttccagaaaatttgtaccaatttactgtcctgccagtattgcaggaaaatgcctatttctcaacacacactcaaaccctggatattatcaaactttgatctttgctttttctaataggcttttttttaaaagccctttaatttcaaaaatgtgagtaaaatctcttggttcttataactatttgttatttaggtcagtttttatattaaggagctttgtgatacttacgtaacatgagatacttttgtaatgtaagaactttaatgttcacatcttgaactgttttttttttaaatgggaaatattccatttacattatcatataaagaatgaataagttctttttttttggaaagatagagtaagttcttttttagaaagacaaagagttttgtgtattttaatcattttgtgcccattttgttaggtgttgtatagcaaaaaacatctagtccaggcttgagggtcctagcagggtggggagtagggaggggcagactttttgcttaatataaactttcataaggaaatgtaataagtattttgtgtttttccatctgcagaaaagactaataaatctgattaaagattgtacttccttctctttgtgatgcagttctaatttttaaaataattttgaagattgtaatatttcatcagtttgcataactttacatgtaactaaatgtttagtaaatcagttcaaatcttttcaattcgtatttgggtttcaaaacaatctggtagacttctttgttttttaccaacaagcgtgcaaactcagagaagcttgagcattataagggcaattatacttgtttcttttcagagaacagttcagtattgtaattatactgcaaaagtaataagggttttgagataatcacacaccatttattagtagaatcaaataatattttacctggagaacatgtttactctgaaaatgacaccagtttagtttcagatgtttctttgattttgatgatcagtttactttattcctttttgtttcctggtgacaaaacatgaaataactaggcaggagttgtttctcaagttatatgtaggtttttatctagtctaaattggttgacttcaaatatctactttttttttcttcctgatccaatctagttctagagttttatcaattttatcaaccgttttctaagtatcagcttttggttttgttgatttttctcaattttttttctgttttattgatatctgcttttacatctttattctactaaggtttagttttacttggggacattttaaaggtagatcagtgatttgagacctgtcttttgtacttctgagacttttcttttaaggacatacattcctctctgagtaatgttttagctgtatccaacaaataatattatgctgcgtttttattatcattcagtgcaaaagttttttccaattttctttgtaatttcttctttgagccgtgttttatttccaaatgtttccaaatatttgagacttttctgtttatcatactgtagatttctaatttgttatgctcagtatgtatttgataagatggtagtcttttttaatctaataactttttgctagcccagcatatggtctgttttgatgaatgtttcacatacacttaaaagaatgtgaattctgcagtagttgcgtgtatattctgtattgtttatagatgaagatagttgaaagcactcagatcttctcctatgtctaccctttttttttttttccttttctctagttttgtctgttactgaaagaggtgtgtaaaaatctccattcattcattgtaaagatatacacaccagtgtgttcttgatggcactgaaagggcaaaagaatttggtgtacacatgtacatgcatgcatatctatgtatgtaatccgtctattatagcttatacaacctgtatgaacatggtttggcatcattaaaaagttttactctatttcatttcatatgatagtaactttttccttcttttaattttgaggtctttatttttttctccccaaataccagttatttcatgcagcatcttttctataaagatagtaccaagcagtatggcctacttgccttagagagactttgtaaaggtagtaattattttaattatgtggacatgaaaggcgcatacatgttcctccttcctctttttgcattttatgtgtttaactatgtatgggctggttacttgcaactgcatgtcatttgcaagttcaatttgtgatcccaaaaggcaccataccaggagagagtacttctgttccttccctacaaaatgtaccctgtttgctagtcatgattttgtcaatataggtttttatttacaaggaatagtagcccccccaaaaaatgaaattatataacattactaaaaaataatatatataaaactgtctctccacacaggagcacacattatgggaatgcttctcaggtatcagataccatccttcctccttccgttaatcctcattcatctagttggaaagtaatacatgatatttcttagtcaagactttatatggatacatattctatgatcttttgtgatcttctcagaagagacctaaaacacacaagaatggtgaaattggaggaatattatgctggattatgctgatattaagattgagaaagtagagatgagggatcctgtatcttgttttcactataattttcccacagttttaataggaagtggggaggtaaaaggtttccattggggagatagagtactaagcttgaaagggctagactgtaatacagaaattaagtgatttcaggcaactgaagttcattgatgttgtctcataagttaaaacagactttggcacacaatatgcctgcagacctagacatttcataaagtgttgaaataacaggtctttttctttatggtgagtaaaattgtgtgtttgttttctctgtatgtttactttataggtatttgagaacttgaatacagatcagtttttaacatatagctgatctctttatatacatggaggtcagtactataaaagtaaatgatctaatacatgacgacaaatttccacctgcgggttttgaaatttaaagttgtcatcaggattattatgacatttgaaaatattcatcaagacaaaagtaattttaattcattttcaaaaaactacatgttatagaaatttaggataataggcatctgttacaaaatgcactttttaaaagtttgcattttgtgttccccaaaggttcttttctgtctgccatatgcatttgactcataattaactgagtattaattataacctgaaaatgttaagagttaatgaatgagaaggtaacagacatcatgaccatagagatgtggtaattttatctttgatttagttctttaaccaaattgttaatgagttgatggtactgcatttatttagtccttgatcaaatattgatcattgaaatttgtggtattgttggcctccttttcattttattgggagagaaggagaggtattaaaacatatattaaaagacatctagaggtaatgtactggctccttgatagagctgtaatgggaaagaacatctctcatgtaaagaaaggtgttgttactgatttctaccttgcagagccattttaatctgaatgggaaatctgtctggggacccagagtgtggtaattagcagtctcttcagagtgtcagagcagaattaccattgtaatggtttagctgcaggataaaaggattgaatttgggactgcctgtctgccaacctaaatgagttgccatgggaattttcaaatgtgagaggcgtttacttaaagctttttggcgggtttgaataaactcataaattgtaggtttgaaagaaggcagtccttgctttctctcatataggcaaaactgtatagaaggctgatagcttcttaaattcttaatgagaatgagttgatccatgttcccatgcaggccatcagcttattcaggcttgttttttcactaagtatggtacaatgaagcacatttgaggaaagacattttgttccaagtctctagaggaaaaaagtgacaactctagatataaatttcctatcttaatttaaatatattttcagataatgctattatactgattctttgttttgctttaacaaacgttaaccagatactgactttaattttactcagtgcatgtaataaatacatatttttatctttgtcatagtttttctcacaaagtaagaacatttaaagcccttttggaaaataaataagatacttaggtttataaactggattattcaggttgcacgtaactacaacctgcatatacatgggttccgcacccatggattcaaccaatgaggaaattccacagagtttcaaagagagcaaaatttaaatttgcatccttcaagcactacattgaatccacatgaatgaagtgatatgtgggcgttgcattaggtattataaataatctagagatgatttaaagtagactggagcatgtgcgtaggttatatgcaaatactatgccattttatatcatggacttgagcattcatgggttttggtatctgtagattttggtgttctggaaccagttccccgcagataatgagggacaactgtactttcagagagagcttcagctctcccctgtctctcaaaagaattaaattttggtgtaatgactttttagtgagaaaatgttcctgcaaatgtctaaggtgatgaacatcacttacactttgcgtgccctcactcatcctcaagatatcagtaatagtagttcttacattggtggtttgtatctgcccttcagaaaaacacccgaagtacaatttaagccaaaaattttgagactgtaaaatacttttaacaaaataaacatggtctttttggaggtcttaacattgtcaagccattagggtacagtttcattaagcaaataataatttggttgttactaaccctagtggcctgaaaatgtggatgcgtctttcaaaaatgtttcaccagggaaatgtgggtattttgaggagagaacagttgttcaattcaggtgagaaagagtaaaattttttaaggtacaatacattttttgtttatatattaatctttactggtcagtatgtaatcacacatcagtataatctgattaaaatcctatagctctaagataactgttgaaccattaataaaacttgagtcatggacagataatgtcctaaaatctcatttaagtgtagaatacaaagacccatgtagtccttaccagagatctctgtaatttctgcagagctccttggaatcacagccatcacctttgtgtgctgtgtgtaaggtactctcatgggtatgtgctgctttgggaaaaatgatggcggagaaaagcactgcagaaatttaaatgtgctgattttctttcctgtgaagagggacaattctaagtaaaatccagttctatatcagggtcataatttttatattctatctccacattttaggtgtgtggcttattctgcattaggacaacaggcacattgtcctaactagaattttcacaaataattaaaagtaccatttgattcgggtgacattccatacagacagattaagaagtttgccaaggtataggttttaagacttccctcaacatcataccataattatctaaatcattgagcagctatataaatctttgcttaccgtctgtccagccgtaatgttgcctggcagtgactgtggcttcttaaacacaacagagggcttttccttaaacttggatgtttagtttgatcaggctccttggtgataaaaaaatatgtcttgtttctgggaactgaacaagctttcccaaacagagactctgtatgaataacatcctcctcttgattcttgtaaggattcgttgaggaaccgcttctttcaacacaaggttttgttcaggttgacaaaaggtttagacatcttgtaattctaaattttaggcgttgcaaatgtaaaaaaaagggaccctgggcatagaataatagggcctaggatatatttattaaattaaatatttataccctaggaaatatttttgcatttgtaaaggaagtccttttactttaactttgtattccttgcacccctcagaatttgcatatttagtttgtaacactttataattgcttgtacctattaatttaaatattaatgtaaactattttataattggtataaatatataattatatattttatataattatataaaatattaatatttatgtcccataaacttctcattggttgggataatgcattttagtgtttggggttttttaaaaatttctttattaaatgtatgatattctacacagatactgtaaaattaatttcaatacatatttttaaatatttattagaaaaataggcgagtgatttctcagtgtattttctttagttcaattattttcatacatcactttaatttgtttgcatgcccttctgatggtgggtaagtagcatcatgttccttatatataggcaaagtatttgtaatcattcactttatagtagggtgcattgaacttgaattagtaaaaacattaagaaaatcacatgtcccttactatatttaatgtgcctgtgttttaactcatatttaatttttctttaccacatttcagatgtttcagtgttttgatatttttaagtaaaattattaggagtaaccattgtgacattttaatagtatattaaatgattcagaaatcacatgtcccttactatatttactttgcttgtattttaactcatatttaatttttctttactacatttcaaatgttttagtgttttgatatttataagtaaaattaagatagtaaccattgtgacattttaatagtatattaaaagattcaaataagcattttagtattaagattatttcaggtaagcttttggtagctcattatagctttatttttggttgtatttttaataactattttggaaaatttgaaagtgactattaaattatcctgcttattcatcacaaggctcctttatgggaattaactctgaaaccatattgccaaattatataaataagtagatgtgttttgttttttaattctcttaacgtttaaaacctttgtggagaaaaacttaatctttaatgtataaataaaatataagagtatttatcaaagtatctttagttatgccttcaaactgacatggcctcagcttatttttagtaaccttctttgtagaatataatatttctgagaaagttagctaatttaggaattagcttactttgtgacagtaatttatgaattctcctgtcaatttaaataaaaatactttgattttttaatttagcatttgtggaattatacttgggaatatttctttcaagcgttgaacgactgacaaaagaaattcatctcacaaacttctattgaaaaactgcagtttacaaggctagaaaacaagacttcattatatacagagacttagatttcataatgtaaatgagaatagaacaaaattactgtgttcttaattgcttttttgatcacttgatgtctgctcttcagaactgtcatgctctcactagaattaaagtatttcatttccaatttgttcttcctggacagtctgttctgtaaccatgcctccagttaccactgcagtgctgattgtttttcagcgtgcttctaatctggaattccaaatcaaccagccattcaacacctccatgcgggtgccacataggcatctcatacataacattttgaaaactaaaatcacattcttccttgccctccccgtatcacaattcttcccttgttttctctgtagaatgatacttgttgcctaggactcatccaccttccttccacctttttctctcctgccctggctccttcccatctatatcatcaccaagttctgtctgattctacctccaaatagcacatatcttttctccatctccacagatggagtaggtctgttacccatggtgctccctcctatccattttctacttgaggccaaaactatctttttaatatatagaaatgtcatcacactccttgttgtaggttttcagtgactttctatcaccccatggtaaaaatgtatggcattcatagcttatcttcatctaacatgtgcctacttttccaactttgtttcatgtcattcctcctttacacttacacccacacatattaaataactcacagttttcagaacactgtttgtttacgtagtgtattttggcgatctccagaaagaactccgtgatttgtattctgtactaatattatagtagaatgcattgtctatgatagtggtgtagaattattagaactgaatgtttgtttgtttgtttatccccttgcccctgactgggcatttcagtgacatgcatgaagtctgtttcatcttagtatctctccctcactgccttgcacatacatagaaagtgatcagtgtttgttgaattaatgattgaatattagtcctttaacaaagcacttgttgtttgcttttcatagtaaaaatggaacctaaaaacacattcatgtaaaatcttccacaagtcacttacccctttttgcctcattttttaaatcacctcattaggttgctctgttctaaatcaattaatatctatatatgtgtgatggtcatacacatacgtaagcctacccaaaactattaaattttacactttaaacaggtaaatattgtggtatataaattatggcagtaaaactgttttttaaaagattgtaatagaacatggtcagtttggtaaggaactgaaagaaggtatgtgtgaccagagtgcagagtgagagagattgaggtgaggtacccagtgagtagacctagcatgtttgaggatattgatcttatctgaagaggactgggcactactgaagagttttaagaagtgagccaggtttattttcattttgtcaatatcactctggctacgaggtgagagaacatcttaatgggccagagtggatgtgtgaaaggagacccggaaggtgacagttgagttagaactgggcaaaataagcagttatttaagtggtaatatagactggatgtggtgaatggtgattgactagaaggtatcgtttgtaactccagaattctgacttgtataactggatggatagtgctgtattcactgtaattatagaatatggttgctgactgggtaatttataaagaaaagaggtttaattgactcatagttccacatggctggggaggccttaggcaacttacaatcatggcggaaggcatctcttcacagggcggcaggaaagagaatgagtgccgagcgaagaagatttgaccagagaaatgtgggaggagaggccagagaggttgaggggggggacatgaggttggtgatgatgaaatttgagcagagccaatgtctcattttccttagcagtcctggaggggatatgcaggaagtatggacaggaaagggtaggaaaaggcttgtgaacatcccagagaaagtgttctcctgcactccagtgctgtgaataacttaagactcagtaaaagaccaacagctagaaaacttacttcctgaaaacactgcgctgggcatggtggctcatgcctgtaatcctagcactttgggaggctgaggcgggcggatctcttgaggccaggagtttgataccagcctgggcaacatagtgaatccccatctttacgaaaaatacaaaaaattagttgggcatggtgacgcacacatgtaatctcagctactccgaaagctgaggcacaagaatcatttgaacccaggaggtggaggttgcagtgagccgagatcgtgccactgcactccagcctgggtgacacagtgagaacttgtttcaaaaaaacaaacaaaacaaaaacatactacatggtgttctttacttgtctgtggtttttaaatgaacatatattagtatgcaattgtagtaatgtttcactttgttattctctacctcttaaagaaaaaattaccttcttttacaatctaacacactacttttttaacaggtgttttaagcatctgtttgtatttgttgaacaaatatttcttaacattgtatataccaggaacctaattgtatacttttcagagttaaactatgcaatctgttcttcagtaaatgaagctttgaccgtgcagtcaaatccattaaaagttcttccatgggaaattaggagagtttcaaactcacagtgtcttagtttgatttctgttccttataacaatacctgaaactgggtaattaataaagaaaaggaatttatttctttgttatggaggctgggaagtctaaggtcaaagggtggcatctgtgagagccttcttgctggtggggactctgcagtgtcctggggcagcgcaggcactacatggtaagggggtaagtgagctagtgtgttcgcccaggtctgtcttcctcatcttatgaagccaccagttctcttcctgtaataatccattaatccactaatccattgagggactgatggcagagctctcatgatccacgttgaggattaagtttcaacatgagttttggaggggacatttaaaccatagcacatagtaacaaagctactttttcttacaggaatttcagtaatcagagatttggggggaagctatgtggctattattataaaactgagttctaacagggcaaatccagagttgaattacttctaactctggtaccacagcagttgcctttttttcaccactaacaaactttcttaaatatacgtacgaaatatttaaagcaccagccaccccaacaaagagctgcttatggctgggcgtggtggctgacgcctgtaatcccaacagtttgggaggctgaggcaggtggatcacctggtcaggagatcgagaccatcctggctaacacagtgaaaccccatctctactaaaaatacaaaaaattagccgggcatggtggtgggcgcctgtagtcccagctactcagagaggctgaggcaggagaatggcgtgaacccaggaggcggagcttgcagtgagccaagatcgtgtcactgcacttctgcctgggcgacagagcaagactctgtctcacaaaaaaaaaaaaaagctgcttctgttggaggacaggggcatcgatcaaattttaaccaataatggccagccaatgtgaatgttatctaattcattgattcctgattccatttcttatgaaaactagtatgttagaaaaataccagtgcttgcatatctgtgtgcataaggatataggaaaacacaaaatcagtttctcctactatactctcacaacaccgagtgcttctgtgatctatggtcatcaaaatttgtagggattcctcctcaccaccagcagccagtcagttctgacaccagattcctcagcagacaccagctgggtgtcctccgatttaatcctgttctgacgctgtccacctggagatagccttaggtcccacaggttgagggctccagttccacaagatgtctcccacttcaggcaccagtcacaagtagtaggtggtagcccatacttcttccttaccttactttattctagcttagcctaactctgaggttcaagattttagtcagtaatttgtgttgaagatatcattagacatctgatgaaacaacaaagaaaaagaagatgggcagcaaccaaaattaattacctcctctggtgttaccaccatgactacatctgaaaatagtttgggtataagtgaaagtagcagtcatgacataaaattgttttaaatgccaggtagttttctaccgctactcttctttgaggttgtcaaggttgtgcttgatagcttagaaatctcatgaatatctcctggtgaaaagcatttactttgaggagtcagagtcactttgaaaagtacttcattactgtgatgaatacattacacagcattaccttggaagtcttgtaagagcagttggagtgaattaacaatttaatcacatatcttcatgggtaagtttaatactcacagttaactccctaaaattgtatgcaacattttttgcttacacagttgacttttgaccatagtagggattaggggaaccacccccacgtgcagttgaaaatccacgtataattttgactccccaaaaatgcagctcctaataacctgctgttgacaggaagcattactggtaacagttgatcaacacatattttgtatgttatgtatattatatactgtattcttacaataaaataagctacagaaaagaaaatgttattaagaaaatcagaaggaagataaaatatatttgctattgaagcagaagtggatcatcataaagttcgttcgttcttttttttttttttttttttttgacagagactagctctgttgcctaggccggagtgcagtgacaagatttcagctcactgcaagctccacctcccgggttcatgccattctcctgcctcagcctcccaagtagctgggactacaggtgcccgccaccacgcctggctaattttttgtattttttgactagagacagggtttcaccgtgttagccaggatggtctcgatctcctgacctcatgatctacctacctcggcctcccgaagtgctgggattacaggcgtgagccaccgtgcccagcctcataaagttctttatcctaatcatcttcatactgagtaagcggaggaggaggaggggttggtcttgctgtttcagggctggcaggggcagaaaaatgtctgtataaaagtggacctgcatggttcaagcccatccatattgttggaaggttcagcggcgtactcatatatgttttctagagaaggaatctatagttaccgtaagattcttaaagctgttgtgattatttccctaggccttttcatttggtcttccaccgcagcctgtgcaaactcccatcataatcccagttgcacatcatttatcttgctttacctttctatctcagtgctcattctgaatatgaatgagtttaatatattttcactttcagaactttttgtcaggcaatcattacaacatcttttaggttctgcccacctctaagcctcctcaccaccactcccgccacagtgggtatacttttcttagtttttgcctctctgtcccacctctcaaaactaagagatttttagatagtcataattttcaggttcttttttttttttaatttttatttatttatttatttatttatttatttatttatttatttatttatttattttttgagatggagtttcactcttgttgcctaggctggagtgcaatggcacgatctcggctcactgcaacctgcacctcctgggttcaagcgattctcctgcctcagcctcccaagtagctaggattacaggcgtgcaccaccattgccagctaattttgtatttttagtagacatagggtttcaccatgttggtcaggcaagcctcaaactcctgacctcaagtgatccacccacctggcctcccaaagtgctgagattacaggcatgagccaccatgcccagctcaggttcctattttttatcttcttttgtagaacaaggctctattaaactcccaattggtatttatatgtcccaccttccagcccaaccatatcatctaataatatccgtctaaaataacaatcaactttggaggtgttttttttttaatctataaattgatgtggctctactaatgctagtatgtagccggagttgtgaatcatataaatccttcagaagtttatcatgcctgttaagattactattactattaataaaatcacagattgtatcgtatttagcattagaagaagtaagtacttattattgagacttggcttttgtttttctgagattgttacttttcagtggatctgtttataccttgttgaagagaggcagaacatattgtcctaaggtacaaatctttgttagttttatatagttttaatggaggaggagcatcatatttgtgtgtgtttgagtgttttaagcttttctggttaaataaagtgcctgacactttccctctaccttgctttatgtgtggaaagttgttgattggttacacaggtattgagaactgaaaaaggagaaagacaggctgtaatacagatttagagactgcaaaaaaagcatcttttaccccagggctggaataaaagagaagaaagcctgtgtaatgatgaaaccaagaccctggcttggtgtctctcagctacttcaagaacctcaggagctcagaggggagaaccctagctggctgcttctggtgtgcatggagggaaggggctgcacgatgagactggttctagaggtgctgggaaagaagcatggagccaggagacagctgcctctggcaagtgcatagctgaaaggagcgcacatgggaaagagaacatctctttccctcatccagctcttcagggtcggctgctttacacccacactatgcctcagttctgagaacctcacagaaaaccggctggcaaagaagtagtagttgtagagccctacacttaagcattggaaagcatatggcagttcagtttggaacttagtaactgccacatcatcttggagaaaaactcaagaaatatgaaagcatatttttctaccagctgtataggataagttggaataagttgatcaaccagatgaatattcagctgtgtacctgacatctccacttaggtgtttaagataagtatttcagatgtaacctttcaagagagaacttctgattccatattcctcaatttttatctcattacatggagccaccgtctactttattgcttaaatcaagaacctaaacaacattgttcaatttctccttttcccttaccctctgtgtccaactgatcatcatgccttgtcaggttaacataactcttttcatctctgttacaacctctaccccagtccagttcatcctctctgttgcctggacaatgttaaagctcatgacctatctcagtaatcacgctggcgcccccagcagtccatccacaaaatagcacagtgaggctttaaagacaaatccttttttgtcacttccctctcataaacccctttgtttaagtcaatcaaattatctgtcatcttctgtctgccaaagctgtcggagcagatcaaggtggtaattggcatcaaaattcttcataaaatgtggtcactcatcattttttcttttctctgatatttgttattcttcaattaaattagtcatgtatttttttgtttggaaaaccttttctacccattatttcaaatttatagaaaactaattcattttttaaaatatgttgagcacattcatttttgcaaggctttgggggttacaaggaacatgggtttattggttattggttagtttatggatacaattcatgataaatttctttaaaaatcaaaaaatagaaaaactgagatagcacatggctatatatgattgatcaccccaaaaataagcagcatgaatttataaaagcaagaccagtatgcgtgagagttcttagaaaagcctgcactcaggagaatcgcttgaaccagggagttggaggttgcagtgagccaagatcacgccacagcactgaagcctagcgacagagcgaaactccagctcaaaaaaaaaaaaaaaaaaaaagcctgcactctgagagaaaacgatgatctgtgttattgaggaacacataggatgcttccaataggagcctaacttggagaggaaagtaccaggtctactcggggattgtggacagatgattttgactaatgcaaaacatttgcaagcaaggttgctcatgtaaactgttcaatgccctgaatgctggagaatttgggcctttgtgataggcagtggttcgaattatttttttagttgacatagttttaatgatttggaaatacacatttgtttcagctctctggtgattactttgttgtagtttttttttaaaagtatatagatctaaaaatactaaataaacatgattttcttactttctaacatgtggtctgatgaattcaaaagatacttccacttaaaggcatcataagactggagaaggtataatgtaatggttaaacatgaggactttgaatcaggtattctgggttggaagccaggtttgcaatgtgaacttttgtggctttggataagctgcctaccctgcctgagcctcagggataatgcactgccaataccacacatttgttaggaagcgtaaatgattggataatgaagatctagtgtctaagtctagaaaagttgaacaatgtataaattacattaaacgtgacctgtttgtatccttttaacatagctgttaaacatagttgatgatggctgggcacagtggctcacgcctgtagtcccagcactttgggaggccgaggcgggtagatcacctgaggtcaggagttcgagaccagcctgaccaacatggtgaaaccgcatctctactaaatacaaaaaattagctgggcgtagtgacatatgcctgtaatcccagctacttgggaggctgaggcaggagaatcccaggaggcgaagttgcagtgagctgagattgcaccattgcactccagcctgggcaacaaaagcaaaattccacctcaaaaaaaaaaaaaaaaaaaaacaacaaacaacagaaaaggcatagttgatgacatatctatatcttaatatgcataaattaaaatatatatatttatacatacccataattggtcatccttaattgcaagcctccagaagttcagaaaactgtgtttatagttgcttcaccccacttagtgtgagtatttttctgtttgttacggactggattatgggcgtatcccccagactctgctgggtgttatagaatctgtggtgtattatctttctataaatctgaaaaactctgaaattctcaaggcacttccccgataccacaggttttagctattagcaggagtgtgttctatttttgagcttttacatttcaaaagtaaagacattctttgttgtgctttaataatctttccataatattttccatacaaatacaagggaaatattcatctgccctatgacccagcaactctactcataggtatttatccaagataaatgaaaacttatatttgcaaggaagccttatatgagaattttcagagtggctctgttcacatatccaaaaagtggaaacaatcaaatgtctgtagcagaagaatagataaataacatactactcagccattaaaacagatgaactacagcgacatgcagcaatatggatgagtctgacagctgtcatactgagggaaagaaattgaacacaaaatattatatatgccttcattatccgaaaatctagtctaggcaagttaaatcagatggatggttagggcttgaggtacaaggagactttctgggtttgtggaaatgtcctgtgtcttcaatggagtactatttagccataaaaaagaataagatcctgtcatttgcaacaacatggatgaaactggaggtcattatgttaagtgaaataagtcaggcacagaaagaatcttcacatgttctcacttttttgtgggagctaaaaaaattaagtcaattgaacttatggagatagagtgtggagcgatggttccagaggctgggaagagtggttgggagggcacagtgggaatggttgacgggtacgataatatagttagaatgagtaagatctagtgttcaatagcacaacagggtgactacagtcaacaataatttatcgtacatttaagaataattggattgtttataatacaaagaaaggataaatgcttgagttgatgggtactccatttaccctgatgtgattaatatgcattatatgcctgtatcaaaatatcacatgtactttatatatacatacacctactgtgtgcccacaaaaacttaaaaaaaaaaaaagaaatatcgtgactggatattgcacttaagatcttgggagtccactgcatgtgaattttgcttccattttttaaatgattcttgaatatagggcaaatacttaggaaaccagaagctatgagattgcggataatcacttgagttcagtattacaaaatatgattttaatgacccattttacaaatgtaaaagttagtgttctgtctctgtagagttgctcattcccgatcaaggttctgcaggatactttgtgaactatctggagttgacatgtacaacttcaggatgccctgtttgatcagttgtaatttttgagaaaaaaagaggtcagaaaaactggtctgaagactggctcatagaagctctagagcctctagactgtagaagaaacttagttttctcatctgaacttatatttgaaaaagaggtgatatataccttcaacagtgtttaggcaggtacgtactaccaaatctcattgtcaaaaccaggacagtaacattgaaataaccacttcgatgtgaaagtaattctataattaaccctgttgtctcttctttttttttctttttctttttttttttttttgagacagtctcgccctgttgcctaggctggagtgcaacggcgcgatgtcgactcactgcaacctccgccttccaagttcaagcgattctctttcctcagcctcctaagtagctgggattacaggcacctgccaccacgcccagctaatttttgtatttttagtagagacagagtttcaccatgttggccaggctggtctcgaactcctaatcttcatgatctgcccacctcagcctcccaaagtgttgggattacaggcgtgagccaccacacccggccagtgaaccctgttgtctcttaagacacacaagatcatgccctgtgaatacagagtggaggggagtggtcaggacatgagggtgaagcccatcctggactgagaccacctagaatcaaattccagctctgccaactaaatcctgtgcatttctgggaggcattagtgtaccctgccaaaatgtggctgtgatctggtgtaacataccatcacctccagcaacaccatatggcagactacaccaggatctcctcctatgccactcttatttttattctcttagggtgatctctcctgttttcattatcctgcaccctgcacattacacaagtgtgcacacacagtggtaatcacacacatttcttccatcttttttctctgtggttttctcccttgtttgacactccattgccaaataatgaatagctattttgctatccaaaaggagcagttcagtgccaacatgttttcaagcacctgcccttctgcaggaaactcgtctttcgtctttatttcctctttgttggaagtaaatttgccctcttatttgctgacattttcaaacttgtaccacttctttctcgctatggtagatgactggaggtaaacctactgctcttctttttctttttttatgtagagtataatttataatacttttggtattccatttttatatataaatttaaatttgaaacttttgataagttttaattttcaaatgactagtttttagcaaataagttgaagttttattataatggatttgattcttcttttccaatagtagcttacttatttcgtttttaacaaataatttctgtgtctttctaagatcatacttactttttgttcatctttgtacaagttgataggagtcaaattctacaggcatgccagtatccactccctgtaatcttctgcaaagtaggtttttaaaaagttggcagtagcacatcaaaacattgtctttatgtttcactcatatttttctttaattcttgtgatttactaaaagctcactgaacagttctgtttactatatattatagtataccattcaccattgtaatgccaaaaacagaattttgtgtgtcattacagctataatagaaaggagcactgagaagcctgtgtcctggtcgtccttcccgttttatgaatcagagaggaacaagactatgtcagaaaattgttgcattgtgttactttcattgtaaatatcacaaagtcatgtaaagttactgggattcgatgatacataaaagtggggggcagttagttctatctctacacagactttgatagatggaccctcatctactgcttgctttgactgtggctaaagtttatgttggactgagacatttgggatttggaaataaagttaaagacttctcataccagtcacttataagttctagtaagtaacttgggggtggccgtgggaacatggggttaggcagtggtaacaaagaaataagccctattctcatggagcttactttgggagtggtgatactcaacagactgtaatttgaagtagaagcaattaactttgtcgataggttcttggagatacaactttaaacaaaatgagtatattgcagcctcttttttcatcaatgttataatgaaaccatgttgaaagcagtggcattatttgaggacctgctgtctgtcgtttcacttaaagttagttttaaagaatgtattgaccacattaagtgaggatctactgtaatctagggatggcccctggagaaggaaggtagcatttaggttgaagtttgtggggatggggataggtaggatttggaaagagagaggggcagagagtgcgcaggggagcacttaggatggaggaagtgggaatatgcacagagatgaatggtggagagcaatctggtttgacttaagatgttacttacatacgtgtgtaaagtagtaggttaatgggcttaacttgagaggatattttgggaccagattataggcaactaaagttttttatatttttagatagtaagaaaccatgaaagtgttttgagacagaatgttgagaaacatgatgaaaattgtgatttgggcaattaatctggcctttgtgtagagattgattggagaacagacaccattagcaacatgttttagtagtttgggtgctatgccaaaaacaactggaacagtaaatggaaagagtgggaccaattcaaggtaaatggggtggccaaacattttgatgattagagactatcctgatttaggtttgaagcatggttattattagtgcccatttttgcttttaaaagttttctgctttggacaataaatcatatggtgaccctaaagatagattgctgtagcattgatagcacttgctaattagattgaaaggagacagggatggtggtgtaagagagcagaatatacggttttttagaagttattatttcactgagttttcatattttgaagaattaagcataaaatttccttacctaaattctgtaatcaaatcttgtatgtttaaaattatttgtgtgcacatgtgcacgcgcgtgtgtgtatgtgtgtgtttaacgaacacatttgagttttggaatattcagcaaaatgatagttgctggctgggtgcagtggctcacacttgtaaacttagcactttgggaggctgaagcaggaggatcacttgaagccaggagtttgagaccagcctgggctacaaaacgagaccttgtctctacaaaaaataaaaaaaattagccaggcatggtggcgcgtgcctctagtcgcagctacttcggaggctgaggtaggaggatggctcgaacctaggaattcaaggtggctgtgagctaggatcatgccacagcactccagcctgggtaacagagcaagaccctgtatctaaaaacaataaaattaattaaagtaattttaaaatgatagatgctgaagagaatatgttatgtttagtcttatctcacattttcattcatttctatttaaaagtaaagctttttaggggaactttaataaatcggtgtaactgacaaaaaatttacaaatacaatatgctgtatatcaacatgcctttactgagaaaacagagaaagcaggctccattatgttagcaccttttggttcttgatctttttttccccttattaaaacaggtgactgtagtcacatgatacttactttaaggcttgtgtgtagatatagctattatatttgtggacagtctcaaatgctttcatctcatgtgttttccatgtataggcagaaggagaagacagcctgaagaagatgcagctgatggagcttgcgattctgaatggcacctacagagatgccaacattaaatcacgtaagaatgagctctgaggcccagggttactgctgtctgcgttgttttgtctacagacttttttccttttggcaacacaataatagttcatacaaagtgaacagttgaaataactgttctgtcacttgatatggggctgacagtcctatttttaatgctttcatgaattgaggacactcttgattttattttatgtcagcatgttgaagttttaggttgataaacttacattattttaacaaaatcacaatctctaaattcaagtgtttaagaaattttctgtttggttaactacagatgtagggcttgcagcttatcttgttaaatttatgcaaaagacaacatattgaaagcttattttgaaaaagtgaatttgaagtgtatctgactgaaatgaccctctgttgagttctgtcctttcactttgcttgcatgttttccctctagtatttttccctgttgatttcatatgtgagttcacagagatcagtgggtgataactctttttccgtcctatttttgtttttatgcgtatctatgcatgtttttataagccgtaagaggatagcttttttatgtttaaaatgaaataatgtgaaatttatattttgaaacaatttaagattcatacatgtcatttatatgaacataccatgtttaaattactgattatttaaaacacatagaatttttaagttctagccagatttagaagatgtaggcaacctctagtgggtttagaagtagttactttacaaattgttgacattaatttactcatgaaaatgtgagtatatcattaataggaatttagaagtagggctttttaagattttctgtgacgttggttcctaaagatgcaggaaatgtacatatatacctagtggttacttgactaaatgcaataaaaattattctttctttactttgaaactaaagctgtactttagaaatataccaaaactgagtttctgtggactccggttacaaattattttttaacatctgttaatgcaagtgtttcattgtgcttctgcatgtactttagtcttatgaaatcttagatatatcaaatgtatgaactaaatataacctatttaatggtgtcattcatttttttacaatggctttttaatttttgcacattcttaatcacattgggaaagggaaagctgtttgcatttgattggtgtgcttttgcatttttgtgtgatcagcgcatgtactaatgatttccttttatttttcttctttcctgcttttcctttctttttcctactcccttctcatttttccgtattttatactgctgtctctatacttctttctaaatttctttgcttactgtagcagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagttttttttttttttttgtgggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagac

SEQ ID NO: 38027 - DNA, 99719 bp, Homo sapiens
aagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctctcctcgtcacctctcatacttggtccagaccctttctgggctaattaagaataatccgaattattagatatgagacccagagggagagtctccaataaccttgagggatctgtcaccacgctgagtccgcagcctgtgctgagttggccaccgcctctcccgctaagtgaaatgcaggtgtcaggggagcagaggccacaataaagccgcaaccgcaggaggcagaagggtgggggagacctgatgcaaccactcctttcagtcctcttctggcctcaggaaaaggctgggacccccaccaccgcagacctggggccgaagcccatgtgccagggcccgcgtgggattcatcctcaccacggctacctcagcccctgagaaacgccttttctgatttcaaacctcccgatcctttctttcctcagaatgactaggctagtcctagggccacgcccgctccccccgcccccccctccccggggagatgctgggatgcagaaccgcctgcgcttcgccaccagacagagcccgcctcgctaccgcccttggggccttggctgcagctctcagaaaggacaatgggaccccaagttgcggggtggggctgctgcttttagaagtcccagcctcgggagtggtagcttgaagggggtcggtgagggagacgtcagcgggtagggtcagctcctcgcccggtgctcgcaccagtggcgcgctctgcggaggccgaatagcggtacgccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgcgctctattctcctggggtggtgctgaagcgtttctccgggagacaccggttggtgggcgtggtgcagtccgcactgcggtctctacggcagcccgaggcggacaaagggcgttcacgcagccctcgttccccactccccctccccaataaaagacgaaagaaaaaccttgttttagatgaaaaaataaatgcttgtcatctgcctctgcagttggaaacggccacttgtccccagaacaaaaggctgcagggtggggactggagttgcagacctggttcttttgtttaactttaaagcacttgattttcccttttagcttaaaaaaaaaaaagaaaaaaaatgtgagcagaaagtcatagtattttattccaaaaaattcaagaacaagagatatttcagtagtgaaatgtcttatttgagcatctcaataacccttcattttcagactatataggcctttggtctaatctgttctaatttagtttatttgcacaattttctcctggaaaaattttacacatactgactttgggtgtggctattgtgggaatcaatgactttggatttttttctttaaaaaattatttgtaagtagcatttctgggaaataggaatatattaggaggtgcttttctatctacaaaatcttcataaccattcgatgtggtggtgctaggagagggatcatcaaccccgttttagagctgggggcccagagaggcaggaagggtaagagaaccggctcaaggtcacagcactcataagtgacagaagtaccagtactgcagcgtcactcgttttctgaccctgtcatgatgttagtgcagggttggctaacatcctatgatgggaggaaggtttcagtacaacagttttcagggcttgcctttgtatggccatccacttgtgggcagcgccccatgctgggagatggttcagcaatcaccttcggatcgtaattatcttcctgctttgttactcatctgatcatcctttcagcgccctattcctcagagggtttatacaagctgcatctatttatggagaaaacagacgcatccacgtactgctatgaagaagggctccctgcctttactcgtttttacactactagcacttagtgacaaaattcagatttgtcttcttgacattaattttttaaaaaattcggttgaagtattatatagagaggaaagggcacaaatcaaagatgagcagctcaacgaattttcacaaaacggacacgcctgggttacccagatcaagaaacagacattactggaaccccagaagcccccttgtgttccctttgcaatagacatcatggcttcctgattttttaattccctaatttggtcaggtttttgcatggaactccgaaatgactgtattgatcccattaagaatcaaccaagtgagtgagcagagccgtttctttacacaccgtagcagatgctgcttttcctctgaagatggctctcctgggttctggggtcttggctgcagctcaagatgcaggcccttccagcgctaagtgaaaatcctgctcccatagcttttcagacagtctgagatgacttagcaacagagcaggctggtcctgttttcctgtgcacgacaagctgctgcttcagccgccaggtctcagctgggcctcctccagaggccactgctgttgttgcttggtgcctttgggccttgttgtgtgaagcaagatggagctgctccaggggggccagctctgatgattgtgtgttgcaggctgggaaggcagttccgcatctgttactctttcttcctatttcccctcctgccttaactgagattctgggtttggagaccctggcgacttggattcttgccatccgattactgagggctctctgggaagcctagaaaataatctataaatctgtagagacatggtggtaatgcagtaaatcaacaggcctggaacgtcccaatgtggatgcttcgtaaatgcctcttgaaaccagggaagagagatggtccctcttgctttctcaactatattcggaaagcataatgaaagctttggacatgtctcctccagagtttggaacaatagtgtttcctcggactaggctagcttcatttatttagttatgcaggactttattccaaatcgttttcgctaccaccaactactactctttggcacctcctttttctcctccctaattagcccccagcatggatttagctagtggttctcattttcagcaaaaccctgcttcttggttttattttaatacatagaggacatacatccgtgtcttgcaaactgaattctagagccttgtgaacgttttcattgtttcattttttttttaaggaactaaaacatataaagaatattaagtgtctgttggatgttttcaattaccgttagattataacttttcctttagttaacactgggaatcagcaagatttgttggtgaaaagatagatgaatgtaacatctactgctctgcatttttagataaaagtttagctgattacattgttacattctgatgtcacttaactgaatgtccttcagtctaagatggtaagagaatttaaaacccaggaaagatttggggtttagttttccttttcttttaacaggggaaataagaaaccaataccatatgtggtgagaattaaatgttagagagtcttaaatttactatatttgcctatacttttcaaagtcgaagacagatggatttctgcttgcactgcttaattggtattatctacgacagctctgtgatccatgctgaaacacaaggcagtccccaaatttaaggtcattaaattgttcaccttctctaagggcttactttaaaaaaataagttataactttttagacaagcaaataattatgtcacttctcatttgcttgtgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatttagtttatgatttcaatctgatttcagaccactttttagcatagttttacaaatataatcttatgattctaggttaatgatttaggtacttggaaaaaatatccaaaagcctgtttttcagagggagcaactaaagcccataaaggaaaatcaacttgccaaaggcccaaataactgtcagatagaacccatgtgccatcaacatacaatgcatggtcatttcattttgctttcttcaatccactgtcacctttagaaatatgaattttagcttttaaatgggaggtgcttttttaaattgttggtttcattaaacaaccctgcaaaatgcttacatgattggaaaacttggaacaatctagcctgtacacaccaagagtacctgacttctcctcatttttcaccctgacttgttctttaatgacccctccctgcctccctgccccataacctattcttttctccttttctcatctgtgtatatcatgtgcatgtcagcctcccttgtgtgcactgctaccacctggggtcagagaactgagaaggaaagatcttttgttgctccctggtcccaaggagctcactttcagggctgggcaatagccacagagcaggcccagattgttctcagagatgacggatgccttttggctccagacattgaaagaatggggttcactgcctccaactgcctggagttattctgcccccacctgggtaagcccagaaggggtacagtcttagaatgctggggaaacaaagcctccaggaagagcttgacttggtgtatattggggtgaaaattagaaagagggcttccctgctccccaacagagaccaggatgacttgcttctgaaagcctctttagaacctcttcaccaacaccccaggatgccctccagccagattcagagaggggagaatatgggaagggccaaagagatatttttctgtcctgtaaactttagagggctcactgttggctccttgttaggcacaaaggggaactacataaacctactaaatgcaatatgaaccttcattaacaactactctttgcctttaccaatattatccagcaggagatacaaagtaattacaaattattttatttctaaaattggtatggaaagtggcctgattccaaaattttcctttccaactaaaatagctggcaaatccaacataacctttattttataagtggtagtagtggttgtgcattgctaagaaacaatttgggtggaaattgctctcttgaaaaaagaaccctacatttttagtttcattgggagtgtaaaaatgagaaatatttttatcagccgtttactagtataatttagaaattactaagtggatttatcatttagtactttttctattgctaaattacaaatatgtcaaaaataaaatatgtatgaaaatataaagcaaacatttaattgtgtgtgccatgacaagttaactgaagccaagggaaaatggcaagtaacaatgtaagagcaagtctgcagataaccctggatgaagtcattcaaataatgtaccaatttagacattacttagaacaaagacagaaaaattgtatgaatttaatttaaatgcatatgtctcattattaacttattgacccagcttgacagggtagaagacaaagtagagctcagacctggaacaaggagaattcagtcaacaataccaattaagcagctcagacaggaactcgatttttttgcactagactagtatatagtgtatacattgaagtaaaatattctaatgaattcagacctctcaacctgtcaagctctctgtgaaacaaaaagaacccatttatcatttctgcactaaaaagatctgcgaaatctcaacatgcctttcttgttaaaattcaaatactccattagcacaaatgcaaactgaggctattaatgtttccaggaagagccataaaattctcccttataatttgacctttccttaagcacgttaactcttccacatctgaattcttcccattgatcatatgagaaatttctgcctgtatttagtggacacacatctatttgaaaatattcctcctggttgaaaaggtctgtggtgtgtaatctaaagatattttagatgtgcagtgaactgagtttccagaatcttttttttttgtaatgtctatgtataatccaccttgattctttacaggataggaagactgaatacaatataaccaagggtaaatacaaatatgccttaaggatccagtgtgtatttaagtaacacactgctatttattccttcaagtctgtatacatgactaatgtccaacaaaaatgattacatgactgggtgttaatttagagatagttcacctgctgtgttatacctagaggttcaagcccttacctttaggaggtatgcaataaatgtctgttgttctagagatttgttcctggcaattgagaatgctgtatacaaaggtacaatgatggataccacacactggctccaccatgagcaacctattaggaaaaatgtaatatataatatgtaaacatgtaaaacacacacacacaccagagttctggggttccccaactttccctggcttactctccagacctcccttctatgatgctctctggggttccctctgggccatcccctttgggagggcaggagaaagaggacagtgggaggaggaaggaagaggctagagagtagggcatgagcacaggaagctgccctcatcccgcctcttgccctcctgttcctctcaccctggatattcctttcagcctagggaaaggaagtctgataggacttcctttccgttcagcctagggtaggaatagctgattcatgtccccaactccataaatgttttataaagtataaaaagttgccatttttctttgcctctggataagaaaattgaatacaatgaacaattgtgaataaaagagctgcctgccaagctactcaggtaacagaaaagtgcctggaaggacagacaggccaagtcttgaagattgagtggatccactctgtttatcaaagatcacataaatcttggattgatatccagggctcgataaaccaaagtcaaaaacgggattggtaaaggaaagaaattacacatgtatactaccagaacatcattttagaaacaaaggcccgtgcttgaatggcagcccccgtgtattttctttgcctttattctacattttcttgccacctacaagtggagttagtctgtctacaagctagagttagtctgttggcctcttagcttcttaagaactaacatcttcctgccctttctagtccctccctggagtacagcctgtcattttcctaacaactgttttctttgactcttccagaagaggtgcatttactttttatgaggggcagaagctcagtccacactgctaattatccctcccttgtggcctggtggagagacctccctggccctcccattttgtgggcatccactgctaagccaccaagctcttcagaaaaggagttcccacatcctccctgaaagcctgagaaatattacagtgatgttgtccaaaccactctgaaatgactaactggaagtctctcaactgtctttctttccctccctaggaatccgatcatgggacacaaacctgattgaatgcaacttggaccaagaactcaaactttttgtatctcgacactctgcaagattctctcctgaagtcccaggtgaggcttccgctcagtgttggtcagcctagaattccaaaggacaaggagcaagctagaaagctttgtctgaggcagcaaaaagactctcttattgctaaaaggatactttgtatttgttattatcaactaggttagccagcagccacagtttaggaagtcactctaggttatcactgtgtgggttatctattttgtggattcttaatgagtttttaagttctagggttgtgtatgtgtatatatatacacacacacacatcaatgatcacacaaattttgaattgatatccagggcttgagaaagagagagagagaaagagagagagatagtatagtgtgtgtatgtgtatctcactgtactctgagctcaagggactacaaactatttaaatgttaatcttactcaaatgaaattctgaatacaaattggatgctcctaggatcccagaactgtcttcctgcaaaagaaaaaggaaacatatactgcatttcaaaatgaaatatacatcatcatttcataattgcattatcacccgccattgcattaccacttatctttcttcgtgtgggtaaaagaatctgatattacaaacttctgttaaaatagcctttttttcagagatgaaaaagaatatcaaagaataattaaaggtaaggatgcaaaaatttgtcatatgtgaagatgttcccactaaccagccaccttcctggggctatgatctgacccatgcctctggcgctggagatgtattcatactgacccatctcgtcttcttcttgtgagcaataacctatattcctcccatttggtcacatttaggaattatgagacagtttctggcccataaagactccaaacctggaatatatttctccagacctttgccattgacccatcagaaacactgtattacatcttatttcttgaccatcacttgaattttacataagagaaagctattttctgcccatatgcttttgttatatgattcctaattttattggcattgatataacatcaggaatgagattcagcctattttgactggttaggtcatattccattagtcgtgtatatacattgatatttgaaatcacttttatagaatatcagtgccttcgtgaatcacatttggctgcagtaatatgcccataggactgtctcagttcttccttttgagtttaatattagaataaaatcccatacatttcagttattgaaatgcattgtagctttcaagtatggaattgagtaaatgtgctaagaaaagcttagcaagaaatggtttattaaaagttaacttcctgcaaagccacatgaaaaatcagtttttaagtaactttgctttgagaaaaaaggaatccagagactgtcagacagcatatgatttgctgaaggaaaggtacagtataaggttgtttctcttgttgttattttattgtatttttgtcttgcgatatctccgtatcttttaaaaccatctcacaaaaaaaatgagggaagtgctgttttccaaaaagtatgattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcatattgcataatgaaaggctgcaagcattgctgaagaattaaccatttctagacccaagacctagtattgctcctgtggagtaggaagatcaagttcccccaaactgtcactttagcctaatgtaccccattctcctctcctttctcctgctatcaccttcagtaaggattagttacctacctagttgtatagtgttatgctagaggctgtgtttggagattggcctttggacacacagcatctttactattcttgccaatgctagaaaggactgatattacgactttccctgtcaagcctatgagtacgctttacaggccaaggctcccctctgggaattaagcatctagaatagagccattatagtcatgctcctgtgtggggagcatgaaggtttccaaccaggactgtaaggtgataaaagcacatgtcagattcagtttcagataagtgtgttttaaagagaagagatgttagaggataagaagacatggagatcacaggatgatcactggattgggcccagggaagcctttagcttttcctgaacaaactggaaaggttttatggaaaaatttgaagtctgtttttaagtgggtccaagtctagtggtctctagctaactcatgtacttcagttcccctgaaatggaattagctgaacattttcctttagagtttcaagaatctttcattgttttttgagacagggtctcactatgttgcccaggctgctctcaaactcctgggctcaaatgaccctcccacctcagccttccaagtagctgggattacaggtacatgccaccacacctgcctaatttcaagaatcttaaattaacttagaaccaaggagcaagatgaaggatggatcccctaaaaaaaaatagagccatttttcagccaggtaaaacattgttaaaaatagcacctacaatataccaggcattatagggtgcttggtgagtgaggacactgtgaagaacaaaacaaatacagtcattacctttattacacttatattcttgtgagaggagaaggcatttaacaatcatatacagaccaacataaaatctagccccctgcatcaaatccaggcttcaaacagatttttgggaggtttgggtttaaaaaaacatagagacggggtctcactatgttgcccaggctggtcttaaactcctgggctctagcaatccacctgccttggcctcccaaagtgctaggattataggcatgagccaccatgcccagccacagttttgttttgttttaaggccagcagagttatagtaaaatatttattgccttttatgacataagtaaattaaggctcaagtcacccatatatctgtcttatgttcctgttggttatgatagcttttgttgttttttaataattggagttcacttgtaaagactgaagatagcctcaaattgcagctaacagattgtgcaaatggcacaagattgattcctttatactagtttatcccttatactagtttttaaatatggttttgagatttgatttgactatttcttcaggattgtaggtctcattcaagaccactctgaaagacttagtcatcttgaataatatcctttgagcaggaatctgaaatatgagtgctttctgtacacaaggtgggtggtgggtgcctcagttccccagaatgttagttctgtgatctttaagctctgtccaactctggcatactgtaattcttggagtggtcagtcatctgggcttatcttactattattttgccttactattgcagccttgccttgcctaaagatcactcaacaaacctttgctgtgtgcccagggcaggtctctgctgatttgccttgatgtaaagccattcctggccacatctaagctggatcaagtgagaacagtcatcttgaaagaaaaggttaggtgttcctttatgaacactctctaatcttttactcaaaggaaagttcagtagttgagtcttttcaaaatagagcaacagtcttttgttgttgttgttgttgttttgaaacagtcttagctatgtcatcgcccaggctggagtgcagtggtgcaatcttggctcactgcaacctcaacctcctgggctcaaatgatccccccacctcagcctcctgagtagctgggaccataggtgtgcaccatcacacctaggtaattttttgtatgttttgtagagattggatttccccatgttgcccaggctgatctcgaactcctgagctcaagcaatctgtctgccttggcctcaaagttctgggattataggtgtgagccactgtgcccggccagaacaacagtcttatatttctttaaagttatgattttaaatactatcataaaatttttatttacctattatatcatatgttttttgtaccctaatcatgttggatgagaatcattttggttaagtctgaccacaaaagcaaagctaggcttaccatgctgtacagggtttatttcattttccgttgccatttgcttctttcccaaatgtaactttaggactgtctatgtatagtagtaaagaaggatatctcccaggggttgtaagaagtgccccataattatctgtcgtagacagacatcattttgaaacaagcaaacaaataaaaactattctcaggacaagtgatgtcagactgaaaatcagtttcaatttttattttttcccttaattttgccacttttatctgcctattaaaataatttaaaaattttgatcatctgactcctcatcagcagcctagcataatgatgaagagtacagattctggagtcaaactgccttgtttgatcttaaccccacggtttatttgctgtgtcatcttggacaagttaactaaccgttttcagtcttcttgtttgtaaacaaggatgatcagttccacctcatagtttctttctttttttttttttttttgagatagagtcttgctctgttgcccaggctggagtgcagtggcgcaatctcggctcacagcaagctccgcctcccgggttcacaccattctcctgcttcagtctcccgagtagctgggactacaggcgcccaccaccatgcctggctatttttttttgtatttttagtagagacggggtttcactgcattagccaggatggtctcgatctcctgacctcatcatccgcccacttcagcctcccaaagcactgggattacaggcgtgagccactgcgcccggccccacctcatagtttcaatgcagatcaaatgaattaaagtgtgtaaagctcttaagacagggcttgtcacatggaaacaaatgtgaacgagtgctgtctcccttctggagtatctatttgacttgtatatttggtgattgttattatccgtgggaaataccgggtattgatatttggctagtttcctttttgtagtaattttaaatttgtattaaagatgtttctcagagaaacgactgctttcagcattctcagaaggcgcagagctgctgactatgtgtaaagggtgacaacattctatggctgagcttctaaggtcctttgggcttgagagcaaaaagccggcaatgctttaaagtgctggctggtaaagcagagcctgagagggggttggagaccatttgcaaaatggtcctgtgggtgcccacgcaagggctgtcagggaacgtgtgcacagtttgagggctggcctgcctccttgctatgataacccatccatggtcactccctccacgccgttctacactcgcttttctcttctgctctcaccaatcaacaggtgactatagacgttgccaggtttaagaaacagatttcttgtggtttattttcttagctgaatacacagtaagaccttgatatatttacattttgtcactagttttataacatctagatcacattcacaaaaatcatcataaaatgtgatggatggtgtatatgggcagttttgttttaagaaccgatgcctttttcctagaagataaacgaaccacagctgagcatctttagatttgtgctgagtgattgctaaaaacatcttgcctggagattggttttcgatggagaattagaatcagccctttgaatttcagtcatgcgaatcttctccctttgacattaatgaggcacgggttacaactaatatttaccagttgagtgataagaaaatgagaaaatactcttagaaaaggtctaagaatattttaagccatctttctctgtctagacttgtgtgtttagtctgttgtgtgtagaattatagcttaattgtatgtgcctagaatacatcaactgctctatgacagggagtaatgaatgtgttttcagccctgctccaacctttaaacaataaggcacacaaatatatgttctagcggcattcaaggggctgactcaccctcagggaacctgcaatttcagagggacagccgattctttatcctcatgttttctgtgttgtttgtgtacacgcacaggtctaggtacttgtccccatgcctgtgaggctctgctcatctttcctcattgcatcatcatacaaggttataggagaaatcgtggtatgttagaagaaaatgacaaatagagagcattatattcgttaaggtaaccagatctctgtttaatattccttgaggtcattgctgcctgcctgggaaggagagtcccattttaatgcaaatccctagcctttctcccacttgccccgtgccctgagccctcctggcccggttgcagggaacagagtgatcggcagctcctcatgctgtccgctctcaccccagtgctcccattgagactttgccgcccaagcagcagacagcccagtcacccccacctgcatccttttctagcggtgaaagagccagaccttccaaggagaagattagaattttatagtgtacgcagcataaggcataattcctgcaagctttacatcttggtcaactttcaaatttcaggattctttatatccagatcctcacatacaagggaattttttcccttggtgcaggtgtggccagcagaaaggaataaaatggcatttcactgccatgttcaggcttcctcattcctcagggtagttaataatgggctctttcagaccaccctagaaatacctattcatctcactttttttttttttttttaagagtggaaaggatgttttactctgctgactgtaatggctctcacgcagttcctaatgggcactgtggaaccactcagcatagacaggcataggcaggaaggtagcagaaaatgggctgcctgggcccaggagccattttaggagatgtcaataacccctccattaaacccaactaagtgcgttccacgacagctgctaaccaaggacagcacctcatgctgagtgtcactgcttttgtcttcatctccagagaccaaagagagctcatgatttttgttagtagagtttttttttaaaggttttttttaagtatgcagcaacagcaaaccatcaagcaagcacagtctctttgctttttctgcctgctttttggtcttcctctggggcagtttgttcagcacctatggtagcctactagaaataatggtggaagatgaagaataaagcataaactaatagatcactttaaaagtgccaagtaatgtttttgagtgcttattaataagaaagcaactgtaagggaatatttggaagaatgaagtatttcccactgtttataattttgttgggaaaataagtcattcacagctttaaaattcactgtgtttctcaacaaagaaagagagtttctttttatttttttaatctctttttgtttttgagacaggttctcccctctgtcacccaggctggagtgcagtggtgcaattacagctcactgcagtctctgcctcctgggatgaagctaccctctcgtctcagcctctgaaatagctgggactaccagcctgccactatgcccagctaatttgttttttttgttttttttttagttttttttgaagatggagtctcactctgtcgcccaggctggagtgcagtggtgcgatctcggctcactgcaagctatgcctcccaggttcacgccattctcctgcctcaggctcccgagtagctgggactacaggcgcccgccacgacgcccggctaattttttgtatttttagtagagacagggtttcactgtgttagccaggatggtctcgatctcctgacctcgtgatctgcccgcctcggcctcccaaagtgctgggattacaggcgtgagccaccgcacccggcctatgcccagctagtttttaaattattttgtagagaaggagtctcactctgttgcccagtctggtcttgaactcctggcctcaagcgatcctcctgcccccacttcccaaagtgttgagattacaggtgtgagtcaccctgcccagcgtgagagttctcttaatttgcgaactgtgtatatgtgtcagagagagagaaagagagagtgtgtgtgtctaattcctaaagaagaaaggggtgaaaatggagagtataataagcattgcattttgattgttcaaccatgggtttagtcacaatgacaaaggttacccaggtaccagcaccccactcccagctgcaacccaggactaattaaatgctacctaggcaacgatcaagtatccccagacatcatactccagggcttaccccttttgttttctcggctgtgatctaagggtaatttctattgcatgtgaagtcagatttccttggtctgagagaaacgtgagaaagtaagaggtactctggggaagcgcacttagtgcaccacagggactggagaaattaacataaatacaagacaataataatgttattttaataaactcttctaggttaaaggattgcctatagtcaggactggtgaaattgatgcttatagaaaatgcaacaagagcgtctacatgtgatttaaaaataaaagtaagtaattaggaatgaaaattgaaaagctagggtagtgttttattgaatgtggctcctctctgcagttgtaccgcacctcatttgaaacactcaagctgaggttgcctctcaaaattgctgccttgcattcctgaggggttaagacgaaatatgaacatcctgaggactgtctttgttgtcatagagggaagtcctctaaacacgcactttgccattaatctggccatttctttctcaataaaacaggttttcaatgggagctgtgagtaaacacgccactgttgagcattgtggctcaaattcagatttcttgttggcttctcacgtggatagtgcgaggaaggaacagctattcccctgagggagcaacacgtttttagtgcacctggccccaggaacactgctctacatagatgtggctttttggatcctgaagtgtatccatcaatgggaatgtcacatttggagaagttatccttattgcaataaaattaaagatcaaataagttctggaacccaggcgaacaatgcttccttagtgcagagccattttgagcagttgtctcttgtgccttttaaaaacctctcacttggaagttttgatgtgtgaaagatgtgaaaactgcctaagagaattcttcctctttttaatggagctcgatgcctgtttagggatgatgtagcaaccgcttttttatctagaattccagatagtttcccagctcaaatactaggagtttttggtggtgcaattcaattgaaagtggtatttggtgtgaagttccagcagccccacaagatgctcaagtgccttgtagttagtttagtataatgtgcatatgtgtttgtgtgtgtgtgtttgcatacatgagagaaagagagagagagaaaaccttatctgttctcatctattataaaggagacaatcctttcattttatatggtatctccttttgaaggtgtcctgttagtgtcctattatcagccaatctgtcattaaatatttatgttcctgcagcaaggcacagttcagttcctagctctgcaggccataagaagacttgtaagtaaatcctgtcttcagttgtttacaattgagtatggaaataagataactaatgaaacaagccagtctataataagtgccaaatgagaattttgcaaggaggtccttctgtaaattctatttgttcaggctattttaaaaaaatctgtgtgcataaaaaaagcattaaaataatattatccatgcaaattggggcataaatgcaacagatcctaatgcactgaatcatctttgtgaccagggaattttgaatccagcctgaattaaaatatttcctagtttggagctacattttagattaagcccattaattcaatgatgaagagttagaatcgataatttaagaattcacccttctgaaatcatgtgagaacaaaactcctgacctggatgtataagcttaatttcaagattgtctttatctttgagtgctggaaaattgtccattggcagactctgaagacactagggaagagattgtgaaagtgaaatgttttaaggaaataaatgtgaagtaattgtttcactgccctgaggctagaatgggtactttggagagtgtctgattcagctgtccctgtgttgagggaagcagggaggggacaccaattgcaagctgctttccaggacccttccccctccggagagaccaggaagcctgacctagtgcagcagctctgggccacacctgagagcattgttgcccatggtgctccctgaagagctgctgtcagtcctttccttttctgtaaaataaagggattaggctagatcaggtcatcttaactttgttctgccagccattagttctgcaaaacattaatagtcagtggaaaagaatttcatggtgacttaagtttgaaaactgtgacatactccatctaattttttgaggaggcataaattgtatgtgtataaacttgttcaattttgtctaaccatacatttccttagcctatttgactagtcacttctatcaccactctctcccatggatctagattcctgtaaaacacaatctgggaaaggatggattaaatgattgctgagtcccttccagtttttttattccattattctatgaatttttactaaattgtctcatcactcgtatgtagatgggagcttgtcttacttcattcagcttacaatggcttttaatccaggctttaaaatatcaatgaaagaatttcatttagaaaaaactgcctgtcccatccatgagtattcttaattttaggaaagatgcacagctttatgacactcaggctgatttcccagtttgggaattcttggccctggcttttcccacctgtctttaccttgcagacaaaccaaacaagacaaaatttaatcatgtttgcacaatgtcaaacacttgcatagagactatccccaaagtcagctcatgggtgttttatcttcacagtgccaaataggaaatagctacatatgtttcccattaaaatgagaatttccatgttggtatctggtgttgcattgagcttcaggttagctgcttattcactgatctttggaaggaggctgaagattgaacctcaagagttctagggattatctgcaggttgaaggtgttaaaagtcccaggcacattgtttgttatcgctaactgcggatggcctgaattttaataagcatggtcaactgtgcatatcttgtcatgtgaactaccaattagcacaccataatttagcaagttagtacatgcagatatgaacacccttgggaaggaagcaattttcgaatcagattattactgacagtgtacaatttacatgcaggtaatcattatcagaaagtcatgattatccagaaggaaaagtgatttttgtggtaatatatctttgaatggctgttgatttttaatacctttaaggtaaaaacttcaatttgttccatccctaatttgatcatatttgcaaaaaagtgttaattcactcattaaaacctaggcgtctgatgggtacagcaaaccaccatggcacgtgtatacctatgtaacaaacctccacattttgcacatgtatcccagaacttaaagtataattttaaaaaagttaaaaaaaaacctaggtgtgatattatgtgtttacaacaaagcttaccaagtattctaaaataacagaaagaaataatttatgtacaataacaacattaatgataatatatccatggataatacgttttggttaatcaaatattctagctaattgagagttgccaataatccctcgtgggattattatttttcaaagttgtagaatccaataatacagtcatttcttttacacaaacacctaaaatttatctagaattaacttagaatttcctaaaccaaatttatacattagcccaagatatacttaaattatttatagaagacatgaacttacaaatctgttgtttcttctcccacccaaatagaataatatcttcaaagacagtctttttttaaaaaaggacatattgttccccttaggtagatactggcattttattgaaatatagttcaagagacatgcattcaggcaagatgagtgcacaccgtgctacctacttggaacccaaactcagaacagtagaattgaatcttccttggaagactcaggaggaagatcatctctctgtgcctcagggtcctcatgatgaacctattggtaattatactgtaaacatgagggtgtgcggattagtagcgatttcttatcactgaatcattagtgagcaaactatttattttgaggtggtgtcctcaatactaatatgattgtgcttcaatatagaacaaggaatatccctggatgttatagtccttctgaaaaagagtcattgattgcagatattgttttaaaaaaaaaaaaaaacactcaaaactgctacagagaaaaaagaaagtgtgaaaaaagagaccatggctatcttctaggttattcgaagaaaatacctgagtttgcaagtatgcactagctcactgcatttgcactgtcctgatgtgcatacagtggggtgcacccgcctctaagtcccaaccatttttttctttctacttcctgtatccccttgcctatgaaaacataatttttattttattttattttttgagaaagggtctcactctgcgcccaggctggagtgcagtggcaccgtcatggttcactgcagccttgaatttctgggctccagtaatcttcccacctcagcttcctaagtagctagggctgtaggcacatgccaaggcaaacaactaattttatattttcatttttaaatttttgtagagacagggccttgctaagttgcccaggctggtctcaatctcctggcctcaagcagtcctcctgccttggcctcccaaagtgctgggattacagtgtgagccactgcatttggctgaaaacgtaattttttaaatagacaattgccttctctgttgcaccatctccctccaaataagctaataaacacaagaatccaaccaaaaggtaagagagatgagaagtgagattttttttaaaggcttaatcacttgtgctttaagatttatctggaatatctttagatcctaggaagagacaaggttgtctagctaattgtgtagccatttacatgtacatatgtaattgtatgtgtgtgtgtatgtgtatggctttgtttttatattgtatcaaaatgtatttcgcttttcaagaagcattagaagatccaagtaaatagggccgggtgtggtggctcacgcctgtaatcccagcactttgggaggccaaggtgggcagatcacttgagatcaggagttcaagaccagcctggccaacatggcgaaaccctgtctctactaaaaatagaaaaaattagccaggcgtggtggcaggcacctgtagtcccagctactcgggaggctgaggcaggaaaatctcttgaacctgggaggcagaggttgcagtgagccgagattgtgccactgcactctagcctagctgacagagtgagactccgtcctaaaaaaaaaaaaaagtaaatatctgttgatgaaaaaactgacacttcctatgggtttacctcctttccttccgttgttttctctttggtatccctcacgcgttttcccctctccgctgcagtcacctatttcccacttgtttttcttctctccttcttctttttcttattgtgtcctccctgccaccagtcacaggcttgtggtctacaaataatgctggtttgggtttattttaaaacatctaacatgagatcagtgcctgctttttaaagaagcattacattatgtattagttatacaaattattagacaatgtcttatctttattttattgttttacacatagaacagagactatttggagcctttggaataacattccagcgtataaatataaatgaaatagtttggcaaattaactctctccaggggtcatctagaaatatgattctgtcatcagatagaaattctattgctagagtcctttagccagcaaatggattttctatgcttggtgagcaaattcatcacaaatttgaagctagttacaaataaaataaaataaaataaattaattaaaaagaaattttaaaaatcccaacttacagtttaaaaagaagaaaagtggaaaaaaaaaaaatgaacaaacaaaaagacgaaagggcttaaattaaataatcatagggatacattgtttaatctttccgaattctaacttttcagaaatggctttttcccaatgtcaactgaatcataagaaaaaaggaatgcaattatcttttaaccatcgaaatagggaggccttaggctaattaatggcccttgataaagagccttagaatagtgccaggcatgtgggcttagtatgtgtatgacaatgaatgatgaggtgtcataggcttgagaaactaaagttagcgcttaggtttgaaaaataaactgcataagaaatctcacatcttttattaattatctatattgcaaacaatttctttgttgcagatttcctttaaacattaagatgtggtaaagtgtttatttacaaaaactatcaattacttttcagagacttggcagtctagaagctctggtaaagagccagtgtcttgaactccatggacagagcacttaaggaatggaaccgggggcagaaaatctgagctttaatcccagttctactgctaagtagatttgtgccattgtggacaagttgcctagcatttatgaacttcagttttattatctctaaggtcctatttatgttaatattctctcatacaagtgaaaaaagtcattcaaataatgttttttcaaaaaatagtttacatataaagttggcaaacatagctgatgtataaaccaagatgtgtggtttttccagaaagttttttgagattcttaggacacaattacttgcttggctgaatatactcatttcacaaatatattgtttgtctaatgggatctggtaatgtgtcagtactaaggttaataaaaataagcaaatgaagacacagtccctatacggtctcccatggagctctcagtcaaggtgaggagacagacattgatgaaatagtcacacaaatttgtattacaagctgtgctaagtaggagggaaaataatatggtgctatctaaatatgtaaaaggagaaactgatgtggtaaggggtaagtaaactttagagctgagatttatgaagagtgctttttattttacatttaagacattggacactgtatttttccctttttaaaaattaattttattattattattttcccttatgtttcctttttaatacagcattagcaattcagcctagttttataggtatagagtacgcagatttatcctggacttcatatggatcaatgtgaggttataatagcacatttctgaggaaataggaacaatccaatagaagtgattctaaaatattttcataagatattcttataaggattccactactctgctctgagttaagaataaagtaaaagaaaactatctgaatatttattggcctcttaaaaacatgggattgatgacaagttttctgggctgcaaaaattctaatgataaatagagaaaggaaagcaaccaacatttctgagatcagaatggaaaggtttgtgttgtaacataattagggctccagagtgcctatagaatcatagtttatgtccatggtacttagaggttcattcaataccttcctcccagtgtcttctctgtacttgcttatgagttcctcacctggtcattgttaggccagtcatctctcagagtgtttgctttcttcaggccaacagtacgcagccttcttgcatcacgtctgattatctttcatacaccatttactttttggttgaaatgtccacttcttttctaccatgttgattgatatctcttggtcctatgtgatgaagtatctaaaatttcaacttttgcatataaagatacttctattacttggaggatattactgaagcaaataacctgtatattatttagaaccaatggcccttgttggaaaaaataaagcctgccttcaccattaaatctaatgaagaacagattttcttgttctatgtagtattttacttgaaggtgttcataattcagttgcgaagtaattttctcagtagcgtgtgcacaaatctcagctgatctgaatctatctgaaattaaaatacggtgtaaggaaatgttgagatacaagtatttttcattaatttttttctgaaatgctctgaaccctttcagcctggagacttttttccgctagcaaagttctttcccatgtgctcttatcattgtttctcttcctgttctgatttcagccttaagaatatgtataattcttaaaatggaacttcttagatctcatcctccaactcatcatttcctcttcgatcttcttctgtgtattctaggagaacatttcacatttgtcctgtacatcactgggtcaatattctgcaggatttgttctgctcttgagtgccttaaatgcagatttaaattctgctattgcattttgtatttccttgaattcttttgttcattccactggggacttctttctaaatctctgcctgtcattcagcccaccctgtttttattgttctctgtcgtttcatagtggcaacgtctgcatcttttataggagccaagtgtcattttctaaaattttattttgttcctatggaaagtcatttttagagatatattttttccaccaaatctcaagacagtgctcatttttccttgtgctgcagagtcttttcaaaggtcccatttagagctctgtttgtttcctccttcctgtataagaaggaggttcaggaatccctgaaactccctgtccaggttcagcatttgccagcagagggttgtagggactccttagcaaggctgcccacttgggagctggcaattttacccgctcatctagaacctggaagtcaggttcaggtgtataacctccaccctgggtccatggtccctgagcagccatgcatctggcgtgggatgctagcctgggaagaaatagtctgtctttactgtccaagtttctgcctgtaatcctagagaattagatagaacttgcatttcttctttgtacaaatattacagaccatgaccagcatgcactcctctccaggatcctcctgcctctgcctgtacttacaggtgtttttcctgagacaactgtccagctcaggctgtaacgcagaacagctctctcctctacccccagctctgttgggatctgaggtgaggcgctggaggcgggatggagagcagtggaaaaggaggtatctgataccctgcagtaagcttctttttcctgtcttgcatcctaggattaggggcaggtatttgaagagtgtgtcaaaaactttccaaccttctttgagtccagcagaatggtaaagcgtgggggcccaggagctacagtggccaagttcaaatatgggcttcacctcatgcacaaggtctctgtgcctcagtttccttatctatgaacctactttacagaggatttatgaaaattcagtagctataaggcatgtaaagtgtagaaatacatttttaagagatgtttaaataacaatgcttttacaaaatacaaagacagtcttaataatgattaatgcttttaacttgccattcaaggaaatgaataagaaatgttggtaaagcaggaaaagctgattcatcttgactcagtgttcaaaccaactgtaccattataaagtctacagtattattcagccataattggttcaggattatggtttctttgtagcattatcagttctctatacttgaagttcccaagagccaaacatttccatttttctttaatcagaatctgtcacatttcaaaactccctttcttctttatggatattgtggaaaatcccttcctgcaacctccagcttccgccaaaagtgtcacatgcattcttattgtcactatgtgaacaccttatgaatgagggctttcttttttaactttagttttcacatgtttgtgagtgagagttttgtgtgtgtacatgttgtcttttgtgacaccacagtttgatttgattgaaaaagaaaaatgcaattttatttaaattgctacttggggatataaactttgtatcagaacatcaagcctgaatccatggtcagtgaagtcctttgatttctgctccttttagtattgtcgcagcaagactccctcactgcattagtgggttccattgtatttccaaggagggcccagtgagaagggcttgcctgcacctcacggccacctcccttcttctgcagggtaagccttgtaattatagcagacattacatttgtctccagcttctaggggatgatgtcattgcatgtcaaacaggggattagcatgaggagagaagtcctattgacattttcattttcattaagaagaatttggttttgcttcattttgttaacggaagctgttgtcttaccacataggagaattttttttttttaaagaaaacttgaaaacgtagaagcaggcatgtgctgactgcatgaataaaaatatactctgtagtggcactctatcaattagtgaaagcgtctgggacacaaagcatgcctgggaaatctcctccttttcttacaaaagcagaatatcattcttctcaaagctcacaatggcctgggccctgctgcagaaaatgttcctgaaaaaggaaggcagagacttggccactgctgagtagaaaaggaaggcaggcggctggtcccatcagacctctgaaatattttgctttttcgtgatggcattgatctagtatgtcttaaagtctcattccttatgtctcagggtaaggctcttagttcccttcccatatgaaaaaattaatcaggagcgaggtggaatcctgatgtttcagatgctttgagcccagagctgagttggtggaagagtataatttttatcagtcatttccagcccctcccgcaataggaagaaaatcattgtcagacttggggtagggagttgtggcctcctttcaagcaatctaacaataaccctgagtcagaaaatctaggttcaaataccagctctggcttttactgggctatgtaactgtaggcagcttatgggattgctccgagccttaactttctcatctgtccaatggcattaattggcaatagtacttgcatctcaaagggttatgcctggtacctatcaaccattgtttttcacctctaaaaattatttcctttcaaaacatgggccagtgttctgaggtgaccttattacttgagtgagtaaaggtggtggttttctttttttctctctctctctcatttgtgtcagtgttttgcaagtacaggtcaggtagccaactcttaccagtcttgatttcctccttgtggagtagacccagtagctatgagattgagggtcacctggattagactggctttggaatttcaggttttttgaattttcccaaagcactggaagaaaaagagtccttgtgaatttttcttgggagtttttagaaacccttacaatagttctcagttctccatatttggatcccagaatgttcctagcatctagtttccctggaacagagtcatcctgtgaaaaaggatgaatccaatccagatcagaccctcttgtgaggtgataattttccatccagatttccctgggacctttccatttgcattcttgttttgccttgaaaggcagctggtgagctatttctttttcctcattggacttttcatgtccaattacctagatgattattgctcctgtaggactgatattttagaaagaatttggaataacactgggttttgaggtgtagcccaacaggatttgaccaggagtctccatttacagttcttcaaggccagtgcatttggtgagctggttggaaggaaactttggagtgttctagaaagaactagaccatctgaatcacctgtcctgatgcccttgtgtggaataaaggagaaggcactgccttgtgctgagtacttaagtgtgctgagcacctaggtactaagtaaagtgctagttactgtactaaacatacccatgggcatgtgctatcccctgagtttctcctgaacctatggaatattgccctcatttcctctattcccacccccagcactccttgaactatctgacatacaggacagctctcttaccacaagctacctgaatgtaaatataattcaaaggaaggacattacaaacaggaaatcagcaattgactatggaagctgaaattgctgtctggagatggccagatactcttttcctgggtggctcaaggagtagtcgggtcatcttcccagggcctcaattgtgtcctctccaagctgtcagtatggccctgtcatccaagacttgtcctcatctctgggttcagttctctgggataatttaaaacctacctccttctccccaagacctcataatctagatggaaggaaaagggggacattctcagttgtttttcataatcattttactactaccctctgtcagatcctgccccaagtcacacctagcctaatgttttgtaccttgactcaattgttggccagccactccctttccctccaattagggtgtgtccttgagttgttttgtatcctcttctgattataaactataaacatatacattttgactactgaccccaagccaaactacaaggaaaatattgtccagagggtgctaatatgggtgcttaaataatatgtgaattattattattttttgccaagcccataccaagatttattttgttattaaaaatgtgtgaacttggttttgagtattttacatttggtcattttgagttgcagggagattctgatttctgcatcttcttccaccctatgggccaagtgcccttcactgctactgaaggcttgtttatggcacatgaaattggctaggttattagcatgatttgcatttttgtttatgtcagaactgtaggctgagtaataattcacagtacaaaaaagtcagttcagtttattcataaggatggcttatgacaaagcagcaattccatttttatcttcctaggcatgtcagaccatttgctgatagatcctgtagactggtgttgacctccacatatatgagtgaattcaatgacctattggccctattgctatagtcaatcatcttgacagcctaaatttctgtagaaccttgagtgtattattttcttagactagtctacaagggatgataggcaataaatatgttccatgactattgttttatgtaagccacaaattaaatcatattttctagttgaattacataaaaagcttatgatctttaactgctgagatccatcttcattcagaattaaatggcaggagcttcccttaatttacctggccaaatcaagcaaatattgattttaaatgatctgtataggtctgaagctctggtttgaagatgtctgtttgaaaataccttttgtgaaaataaataataaagttactcctccctgtttatctgattgttaaattttgtcaataattatgattccttaaaacaaagtacaggctcctatgcccagaattgacaacagaaatggctttgagatgattcagaactatactttctcttattaacatctaatatgtatcaaagccttttctccccgtttaagtagagaagtaaccttaaaaatatttaaatgtgatcaaaggatcttggtcataggattcatgtgtaagaaatgtcataaatagcctcaatcaattactcatttttcatttccaaagttttaaaatagttgacatggaaaaagtattaatatgcatcgtatcttggaaacatgaagaattatcaactattctgtttctttaccagcaggtggcatgacttgttgctctgctggtgacaatataaaacctaacccaccctatcactttaaattgttacataattaaaagagattcctaaagtacttgccccaaatataaaagttgaaagtttaatatccttatgatataaagagttcttacaaataaataagtaaaactttaacatttcagtagaaaaataggtgtaggatatgaacattcaatttacatacacacagaaggtgggtggagaaagacacacatatacacataccaaatggccaataaacgtatgaaaaatgttcaacctctttataaattaaggaatacaaatgaacccaggaagatacacatttttacctccaagttgcaaggttttaacaaatgataccactgatcactggcaaagaggacaagataggcaccttcatattctgctatttggatataaacaaccttctgaaatgaaatttttcaatatatatgaagagtcatagaaatgctcacgtacttcacccagtaattccctaccaggaatttattctatggaaataagcagagatatgcacaaaaaatgttatgtaaaaaaatgcttattgctacgttatttctctatgtgaaaaactggaaaaaaacctgaagttctcaacaatagggcatgtataatcagtaatgattaatcaatagaattcagtatttggcctgcattattataaaccatatcttcgaagaatctttactgatgtgtaatgttgagtgacaagggaagggttcatgaaggtatttttcaatttgatcacaatttgataccaaaataatttttgtcttttccttgacacccaatttcaatgacacccaaattgtaatatgggttatcactgagcagtaggtgaacaggttattttaattttcttccttatctttttctgtgttttttacattttatgcagtgggcacatagtattttacagtcaggaaaaagtatacacattttcaaaaatggtaagccaagcattggagacatgaatcactatcgcttttgtattcctcatggaaatgagattcaatagtaagttacgtgtctggggaaaatagagctcatttgagtcagaggttggaaagctcttatgaatactaacctcagaaacctcaaaatagtatgtggtagaataatgacatggcacgaaaagccacggatgtcagtctgagttaaggttagagtagatacatacaacagtcataagagaaaaaaacttactaatctatgatctccagttctggtaacctctagggtcggtctgtgcctccatatcaaacctttatcacagtgcagtgtactggggctgctgcaacttggaagcctgggttctcgttctggctgctctgcaaatatattttgtacttaaccttgggcaagtcaccaactctctgaactgagagttttcttccagggctggatcgttattcatttttggagtttggcattctgatgcactttctagccctgcaaggtaagatgtaagtctccggggtgtctggccaatgctgaagcagattgaggctccttttgggccaacccttggatcagaggtgtccgaagtcatcttggttcagtcgttttttaataataagttgccgtgacataagttattggaaaggaccacagttgagggtaagaaaggcagtttgattctcttgtggaggttataaaatgaaagcagagatctgtccctgaatatgaggaaacctcgtatatagtttaacaatgtatttttttcttacataaaaatctaagtttgaaattaccatcagactaaatttcatcccatctgtggtagagatggttttaaaattgagactttagaggcagcagatctttatcctgtacacctgatacataagaaaagcccagttcagaggactttagtttttaaccttaaagacaaacatattcagacatatattgtataaggatgtattacaaactttttttttttttgagacagggtcttgttctgtcacccaggctggagtgcagtggcgcggtctcagctcactgcaacctccgcctccagaggctcaaacagtcctcctgcctcagcctcccaagtagctaggactacaggtgcatgccaccatgcccagctaatttttgtattttttgtagagacgaggttttcccatgttgcccaggctggtcttgaactcctgggctcaagcaatctgccctcctcagcctcccaaagtgctgggattataggcaagagccacaggacctgtcctacaaacttcttttaccttaaccatggtatagaaaatacaggctgatccatgcatacatctaaaattgaaacaaaagtttaacaaaacaatgcctatccttattatctgcaatgcattatgacattttctagtctgttttattctatactattaagaaacactggctttgaccatttcatgctacagtaaagtattgcagccttcatttgaagaacactggtatagaggtttttgaagaggtgcgcataagggagagaaaaacagctgcatgtcctgacaactattaagtatcactcataaatttattttcagcaacatgggaaaggaaaatagatcctttctttattaagttaattgtgacagaaactgggacaaaaataacgtgggaggaacatgttaaaagaggagatttacacatatccagtgttttccagcaagaagaatgcatctgaaagaggtaaaactgtgattatcgaagcaatcctattacacctatgcagatgaatgaaatcaccaactttaggcaacatgaaaaaataaaagggccaagatcaaagtggacctggtattatttctagcgtccatcttggatttttctttttttgtctgaatccccatctcagggtatgagtcgttatgaatcaaaggatcaccgcccaataaaaccattctagacagaaaccttttggggttgggggtgcaccattctcctcttctacagcttccagaccactcattgcccatggatacccaccagcctcccacgttcacacgactccatctgctttttttggtgtctgtgtcttctggagcattgaccaggccagtatagggtaccgttccctgcacccagagtttcactcccacctcaaactcttttacctcctggggtacatgtccacgctttactcctctcctgccctccagcttctttctttctttcctcccatttctcctctcttcccctcccttttgcctttgctctgcagagacactggtgccgtgacacacatctgagcatggctggtggggctgaccagtggtcaccagtgcaggatttaagtggttggagcttaatagtagctacaagtctttaatttcttcagcaggtttttaatggcctttgatgcacgttagaaaagacatggaaagtcctgaattcagagccttcatgctgggtattgtatagtcagaccagccctgtctctggactgaatgggtctcttgaaatcataaatgcattgcttagggatcagtagcctcggagtgacctttctcactcatggctttcctgaggctcagaaaggccaggccttgtcctgggtgagccagcctctcagtaccctgatggcatgactcagaaagctggacaatgccctagaatgactttctccattaagcccaagaaatattgcatagaatcagtctgtctggaaattccttatatggagaggttctgagacgattgtatgtttggtttgcaagaggatcatggtttaaaaaaagaaaaaaaagcctaaggcagtgatatcatattacttacaggcttggttaaaaaagatagagaaaatactccttcaaacgtttccaccctaattctggattacactggggacgacagcaaatcccattccactggttctggctgaccttccctgcatcttggagcaaggaactctcactgtctgcctgtttctcccagcacagcactgcagagaggcccagaggctataaagccctgccacgtgtttctccaaatgggtggtttttattatttctggaatgcagtccccagccccaaatcctaatatgctgacaaggcaaaagcaaaagagacctgtggaaccccacccagtgacagtttggtgtccctccccatctgggcttggtgcccaccctgtgaccctcactcttcctacttcccccaaggtggctgggagtggaaggcgaattggagcacattcaaagccagagtggaagggagtgatttaagatcttcctgtgagatggagtcctgggcggtcgcttattgtgcagactggattgtgctatgggatctgctctgcctgtggagggggactgtgtttctacatccacctcatttcatcaggcaaggaggaggggcaggtagtctgcaaaattccgctatgtggtttaacacagtgaagacctgaaacctccttgatcaccaggaaagagatggggaaactgtacctaggcgtttctaagccaggagaccggagctcgctgaggaataattatgtggaaacaaatgtaaagttaaaccttaaaaagacaatttaaaatatatttacataaagttatatacttctcattttaaaagatgatttaaggagatttgggcctaagtaaggagacatgaaataaaagaaaaaagggattttttttcaggaaaaaaagtgctccccaagtagaacaagaaaaattctccagcataagtttcaattaaaaaaaaaaaaagtaaattgactctagcacatggtatggggctaaataatagagtggagcagaactgttatgggtcatttttatataggccgtagtgcgtaaacattttcgactgtgttttttattctatttcttaatagatgaggggtggcattgaggcatagagtttttaagtgatttgaagtcaagatataatcattcttggcccagcttcatagttcattctccaaaaataagattttctagttgttgtgtgaaatccatagtgaaaagtctgattgcataggtgtccatatgctggagttctaatcatagattcttctgttgtgttctcttgtgtgtgtgtgagtgtgtgcgtgagtgtgtgcagttgctatagaaagacaaataccaactaagtgtagaaacatctttgcacgtatcatagagaagctgtataattttatcaggattcccagagaagaaaatgtgaaatgttagtcccaataatttagtaacaaaagaatacactgccgtgttgagatgccaaatagaaaagataatatttagtgcaatccaagtggcaaacaaatacatttcctttttagggctatggggtgaggcagtacagtgaggccttgtttaagtaccctcaacagaatccagccttttaaaaaccaattcaaggtcatcattatgaacgtcatccacaattgaattatgtctttatatttgcagtgtcttcttggagaggacgtatcggtttgccaccagacagaatgatgccagctctggttttttaattcatatgtcttttaaaaaacatatctgtcttggtatcctccctcgatatcacactgccagtagtttttttctaaactaccttcagtgtgcttgtttctaagtactcttctatgttagttccccagggctgccataacaaagtatcatcaactgggtggcgtaagtaacagaaatgtattgtctcacattccaagaggccgaaggctggttccttctgggggtactgagggagaatctgttccatacctttctcctcatttctagtgatttctgccatcctccctccttagcctcccaagtagctagaaccacaggtgtgcaccatcatgcccagctaatttatttattttttttgtaaagacaaggtcttgttttgttgcctaggtaggtcttgaactcctaggctcaatacttggcgtacttggcttgtagatgtatcattccattatctacctccagtgtcacgtggcgtgttctccctgtttgtctctgtgttttctcttcttattcagtcattgaataagattcccaccctaatccagtgtgacctcattttaactaatgacttctataaagaccctttttccaaatgaggtcacattctgaggtttccacgtggacatttgtggggaatactgttcaatctagtacaccttccttctatgttgttgttctgaatctgctgtggattggaaaatctagtcactaagcttgttagacctcctctctaaagaagaaaaagagagagagagacttgatcccgaatcttccctaaggagtcttccgtcgtataaagtctttgagctgtaagtgctttgacttagtggtatctattttgcctgctcagaggctttccctcgctctaccttttaatgtttttttactgaattcaaagctaaattttaagttttcttttcagagacaggatggtgcagggatgcgatcatggctcactgcagccttgaactcctgggctcaagagatcctccctccttagcctacaaagtagctaggaccacaggtgtccaccatcacgcccagctaattttttaatttttttgtagagacgaggtcttgctatgtttcccaggccggtcttgaactcctagcctcaagcgatccccccacctcagcttcccaaaagtactaggattacaggcatgagccaccatgccaggcccacgctgaatttctcacagctgatgctgctggataaagaacttctgacacatgaagtgttacgcttgggtcttttaaacagttttttagagtgttggggagaaaattagctaagtaatgcttctgagaggtagtctaggccatgactagaaaggcatgagaagaggctgcgtgggagaggtactagaatgcactccttcttataactgaaacacagatccttctcttcccctggccatctgagttgtaggagactgttgttgcttgtgtgagattctagagggccccatccctgcctatctctggtgctgcctgtgaattatactctgttttggtgaaaatcacgctctgtccagctgtggggagcactgtctgggacaaattcccttctcagttcagtttgttaatagtttttaagaactacctttgtgcagatttgttccctggactgttgaaagggagggcactagtctttaaagacagtgatagaaaccctagtggaaaatgctcaccaacacagtatgaaatgatagaaagatactattgggaatttgggatctctggcttcaacctttttatttctctgccaaaagaaaatacgaaacctcagaggaacacaaagaaagagaatgatattaagcacagaatgattttaatctttggcagcaacccatatgcttaaaaaaaaaaaagagggaaccgtgtttccattgtcatgcacctgtcattacactgaatgagttctttttctctcttgatggatggtggtcttaaaagcttgctgtttttcattagcaaagtgaaatggggtgccagtgctaatgctttgtcattctgatggagaataatacatgaatcagtgtaattattcagtgtttgcataatcagcaagattttgaaggggaatgttgcacaactcagaagtggcctaatttcacctgacaatattccattcagactccaagcatctccttcaagaagcagtgaagtgttggtggatttccttaaggccccatacaatgatgatgggaaattgagttgtcctaaatcactagttaattatgatatgcccagcggtcacttggaggttcttgctctagatctcagtttatattcatccctattgttttagaaatgtcatttatttatcatgcatgaagcatgacatattgttccacgtgggttcagtaacgaaccaccagccaaatccattaaatttcattgaggagtgaagtaagacccagaaatgtgggcaatttgagaggaatccccccaggatggctcaagttggataaagagataggtcaaagaagagacgcattgggagtgattttggaaagctaggtaattttaatttacactctttttttaaagagagtctcttttacaagaaagtagcctattagttgagatgttttagggacctttgcaatgccagttggaaggagggagactgaattttttattaactcttttaaatcaatttattccagcccagcatgacaccagaaccaaaaaatctgaacaatgccccagggctggatcttacagtgacccagctcatctaatttggactagattgcttttttcattaaagctaaaaataatgtcaggcaggccacctttctagtgatttctgtgggtgaatcatgtcctatggaggaggccttgcctttctcagacgtagccagtgccatttgagtccgggtttgctccccttttctctgtgaagccagcctgcgttgatcttcatgaggggagtgaacaataatcgtagataacgtttactaaatgcttcccatgtgccaggtgctgctctaagcactttctgtgtatgcgccaatgtaatcctcatagccttccaagagggaggccctattattatcctcatgccaccacgaggaacctgaggcacagcatggttaaacagcatgcccaaggtcacacagccagtgagtaatggagatggggttcagatcccagcaatctggtcctcagagcttactgctcaattctgaagaccctcaaataccactgggaagttctttaactcaggaacttctgttttccaaggcaggactcctaagaaccttataggcttgaggcaaatgcattccatgtacaggaagtatgtgcttttgacacatagcatcagcctctttctggggcaactgaaaactttttcaaaagcagcacctccttggctatgggatgcaaggatactgtcattcacgtctgatggaaaaatacattttatccaaatcttcttttttttttttttttttgagacagatcttgttctgtggcccaggctggagtgcagtggcatgatcttggctcactgcaacctctgactcccaggttcaagcaattctcctgcctcagcctcccaagtagctgggactaagggactacaggcctgcgccaccacgactggctaatttttgtatttttagtagagacaaggtttcaccgtgttggctaggctggtctcgaactcctgacctcaagtgatccactcacctcggcctcccaaagtgctgggattacaggcgtgagccactgtttctggcccaaaatcttcttaaaaaacaaaagaaaatggcaaagcctagaaccaagatgtcacctttctcggtaaagctgaatcagaaaggcccatctttgttgctggggcaatatcttgaaggttacctgtgcctcatcacttgctctgtaactatttgtattccaggtaatatgcgtcactggatgaatcctttttagtgattaaaaaaaaaaagaaaggggtctctacccttatggggtagtgagacattaagcagataatcacaaaatgcagagaaagaaaggcaagcccctggcatagatgcttggtccctggaagcccagggcaaggcctgcgaggacacgccccagctgtgcatctgctgggtgatcaattggccagtattcctgtgccctcccagggactacccatcctctcctccagtacagacagaaggtgagtggtgtgctgatggccagctgggagggaggtcttgagagacatgtcaggggaaaaaattggttactatttgatggagtgggcttggtggtttgttgcctgggaaacttgctgactataaaatgaaccagaggaggatccagtttgctgtctgcactgacagatttacagacaggaaaacaaagccttcttaccggatccaagttaacatgaaaattaaaaggagtctatgcaaagcggagttcaggacagtggtttctaaagtttcttttacttacacaggaaagaaaatcacccaaactaggtgaatggtaagtttctctaaatgtcagaacaatcgattataaggcattactcagtttatagccaattatctacattgattaagtataaatttcatgatagttatgagagatattaagattttaaaaatggaaattattttataaaatacttttaaaaacccatcttttgcactgcacttatggaaccaaagaacagcttagtcaagccacttctgaaactgtcttccatgaaaatttcaccctgaggctgcacagggctccttaacatcccctctccttcctgtcttctgagaattaggggaacagtccctcagcccctctgttcatggagaccagctgagacccacagaagggcccatacccagggagatctttgctgagagcatctaggaaatcagccacctgtccttgatgttaccctgccagttttgaatatccttcttttcaaattaattgcagaaagaccaggctagctaaaacattcatcagaaccacttggtagggcaggggttgcacttatgaatgtacagttttcagagggtcttccagggtaggacctgggaatctgcattttgaacaagctcacaagatgattcttctgttcatcagacttggagagccactgccctaggacgtggatccacttgccacgcaccgaggagatgttgaggtgggaaaaggaaacaggaacgggaaggaggtgtgtttgcagtaatgcaggagaagactccttgctctttaatgctcttcgaaatagcccagaccatgtgtttggactgtgtacaaagggagcagccacactgtggtgtgctcagggagaggagttaggagatggcagcctaactctccaacttggagcattcacatggctgatctttctccttgaacttactgaggttcttccctactcatttcacttagctaagaattactactccctcttcaggacccagccttccccttcacctggattaatttaggtcccctgttatgtaccctgcagcttgtgattatctgcttactacctcaccctccatgagagtagagaccatgtcttattcattgctgtatccaccagcacctagcacaatgctggcacatagtggctgcccattaaagattatcttatttttaaaaaaattgaatatagtactctcatgtaaatccctgcacagttttctgctctttctagattttagaaaactactagtttggtgcaaaagtaattgccgtttttgccatttaatgtagtagaccacctctgaggtcttaagcctcattgttccctcaaactaacttggaaagaaatttcctgtttctaactaaatgatttattccctttcgggaaaatgtactaattaagcctgtttaaacttaggaggggcggtaagcaaaatctcgtttttctttttccacaatagacatttgtttcactgtatggtctcatcatctatcagatgaggactgaattttataagacacgtttggtgatttgttggctttattgaaaagatcactagctcattagtaagactctggcccagccttctaaggctggagaagaacttgatttttaaacagtttgttgagcgtctccaggacaccctctggacagagtctgtttgctcagtggggatactgctatcctcttctgtcacccctctgtgcttttattcagaaccatagagatagtgggctgatgggttggaagagaaaatgggacggggatgagggcaggaggtgagggcaaaagggaagaacttctcttcattttctacttccagatacaccctatatccaggagggaggaagtgggacaaatgaaatagaaataagaatttaagtgtattcctcaaagctggcttctctatgcatatttggtttttcttcctgaatattgatgtagccacttgagtgcgccactgggaggaaaatccttagcaggattaagtttattttaggatttggctgtgtgtatgtgtctgagtgggtatatcatgtgggatctcattttccagaataagagctaggcctaggccatttccgcatcttttacatacctaggtttttacccattttttgaaattgggctgatattaagtcccatttagcttttacaaaaataaatatgttgacttggtgtgcaatataaacagaatggcccatttaaaacagcaccatagtttcctaggtcttgatatctgctatttttactttattagatatgaattactgactcagaatccatttaatattttataccgttattactcagaaaacctaatttgcattcttgtctctcatgttttaaatttttctctggtggtaactggcatgtattaatattttaagcatcaccgactggctgcaagccgaaatgaccccaaacattctggaactacctgttctgcctaatttgccagtgagggataacttaagcccagagagggctgcatataggacagattttttccttaagcacccataactttcttttttaacttttattttaagttcagggtacaaatgcaggtttgttacataggtaaatgtgtgtcatgggggtttgttgtacagattatttcatcacccaggtgttaagcctagtacccattagttatttttcctgatcctctgcctcctcccaccctccaccctccgataggccccagtgcgtgttgttcccctcgatgtgtccatgtattttcatcatttagctcccacttgtaagtgagaacatacagtatttggtgttctgttcctgcattagtttgctaaggataatggcctccagctccatccatgtccctgcaaaggacatgatctcactcttttttatgaagcagccataattttcttgcatcctaatagtgcagcagttggtgtctgggtaggtcagctgtggaggtgatgcacagcagagttagcgggcagctgttgagtgccatgtttacaaagctttggataaatgggggtgtcttggtccattttgtgttgctataaaggaatacctgaggctggattgtttatgtaaaaaaagagggggtttggctcatggatctgcaggctgtacaagaagcctggcgttggcatctgcttggcttctggtgggggcttttgtgtttcatcaagacatggaggcaaaggtcaaagtgaaagtgggcatatttgaagagggaccaaacagaaggaagaatcttgctttataacaacccactctcctgggaactaatcccatcttgccagaaccaggacaaactcacttcatgagaacagcaccaagccattcatgagggatctgcccccatgacccagacccctcccactaggcctcacctcagacaccctcacattggggatcaaatttcaacatgagatttggcaagaacaaacaagtcatgtccaaagcattgcagtggggaagtcattgatcatagaacataaagtgaagaaaacaggaccaaaatattgtgtttccactgtgccctcaactatgtaaaaaaatggctatgtggaaaaagtactggaaggaaacatggtcaaagatgaacaaggatgattgtctctgggtaaagtgattagacacctctgcttgctgcttcttcatttgtggcatccatattgtccacaatgggtgtggatttgttttcataattttttagagggttttaaagaaaaactgtctctgtgagactgaaataggtgtggtcccaaactggcagtgctgagctgggctcacccaggggccagcctctctctctgtgttttttacagttccctccctgttctttagatagtaaataatcattgtgtcatcactgggttgtgtttttaatcacttttgacatttcacagtgattcctttttctaaacacatttttatttttagataactttagatttacagaccagttgcagagatagtacagagagttcttgtttccccttcaccctgcttcccctactgttagcaacttacataaccgtgctactttttatcaaaactaagaaattaacatcctgttagttaaactacatggcagattttttcctgatctctccaggttttccactgaatgtccttttaccatgccatgatccaatgcggtatcccacattgtatttagattgtggttctttctaaaggtgcacaccagaacagcattctagcagggtgtgttcctaaattatcctatctatggatatgtttttttttacgtaaaaagtagatgtttttttcctccaggagtggagagagggacacagtgaagcaattggcctctagctctttgaaataaatgggattccttgttctgcaaaacctggggtcggaccccgttcactccccttcctaccctgagcattatgtggactgacaccaggtctgtgaaggaaaaactgaagaataaagaaagcatttggaaaatcccatggttgttttattttattttattttattagacagagtctcactctgtcactcaggctggagtgcagtggcgcaatctcggcccactgcaacctccacctcctgggttcaagcaattctcctgcctcagcctcctgagtagctgggattataggcacccgccaacacgcgcagccagtttctgtatttttagtagagatggggttttactatgttggccaggatagtcttgaactcctgacctcgagtgattcacccagaatgctgggattacaggcatgagccaccgtgcctggccccatggtatttttatagcatttcttataaatcaaccaagtttcttgaaaacaataatttttgttcagaagtactgttgtgagtgaggagaacattgtgcagctcagcctgtggacatacagtggctgcagcgtgggccccaggctgctctcatgctcgctgggcctgctgggtctgctgggcctgctggaacaggaagcagcaacgcaattccaccagaggaaccacagggaaaccaaggctgactgaagtctgagaagaaagcctgtctagagtcacaggagtgaaaataagaaaacaaaatttagtcaggaaattgcaccatggaaatgtctggcgtcaggttctataaattccgacccgactatagtcaagtatttgccgagccacctcgtgtttgcttcagatctgtgtttgctgcttctttttgcacagatttgtcttttgtttccttcccattaaaaacaggaggcagcgggttagctgtgctgggttacacagcagcagatggtgttgcccaccatgggcagagatctcacatgagagagcggggagggagggtggacatgtcacacccatgccattttcctgctggaaactctacctcacacatgcagggaccacaatggatttgacaagaaccactcatataaaggcagaaagtcttttaattacataaaatctgaaactatgtgttagaagcagtggtctcttgccatttctgtggatacccatcttccatatagtcttactcaaagttaattgaagacaagcagaagtgaggcctggagtcagtgtgggggtgatttgtaatgacaagttggaattgaatcctggtgggacatcacagagctgggtgatatgtggcgtgtggtggtggtggtggtggtgaagaagacgggttcttaagaatacaaacccttgaacatgtcagatttagtctactttcccttcttgattctctgggttccccttctgttagtcttcaatcaagtcctttttggaaagattcctttccctttgtttagagaacattggtcaactttgaataacaaatgagaatagaaatgacaaaaacgtctccaggtctcagctgtgggaccttatgagcagtgttgcacaaagacattccccccaaagcctgctactgttacttttaggatgttcatttaaaaaaaaaatctcttttccctaggtcgggaagatgaccttcaccatataatttcggactaaaatctgcagattgtaaccatagttaggaggcagttcttcattaaaataccctgcatttaatctttcacatattgtacaaaagtaaaaccaaaacaaaataatactgaatggtaaagtaatattatttttttattttgctaaaattccatggggtgttcattttctttatgactcgtctcttattcctagctcattctcgtgtgtctatcacagtgaagttgctgtagacaccctcagatttctagaaatagtatctgaagtgttcccagagggaataggatttagggccaaggaattaggatggtcccactctgtgcccatgtataatgccacacagactgagtgactttcctccaaatggatatcgggctggcatattttgggacctattgaatgtttttggtcccattccagtttactgttaacagcctcatctatttgtgaacagacacaggagtagtatctatatgacacaaagggatgtttgacaacttttagctaatttggccactacagatggccatgggcaggtgagagccagaacaaagtgttggagcactgaggtttatcattcagcggtccccggcttcctgcccagctgagctcatgacctttgccaaccagagttttcctgaataaacaaacacaggtcccctaccagatggagaggtgcttaatagaaccaggctgccaggcctagcaattgtgccactagttgtgaccaggcttgggaaatttagaagctgtgtcttgtttgctggggcctctttccccagatctgctagttctggagattccagtaggcactgagcatctcactggttcctctgtgtgcatttttccttgtgctgtgaaccagcatcctggtaattcctgttaatctctgcacttcttcagagtgtcttctaaaccaggaatcctttatctggggaacttttaccctgataaatgctggtgcactgcaaattattgaatgtcattagggtgccccagaagctagattattctagactccagattgaacaatggcttatgtatttttctgaggagggcatatcctgcgaagggaagcccagacgttctggtgagttggaggtgcattgttaccgtgtccttacacactgtgtccattcactggtttagcacttgattgtaacagcatatattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcctgagctatggaccaacttaataaaaacagtaattgagaatgtgattcatcgagactgtgttggcacaaaaatggaggttatagttttatgtattcccgtccctggaagtttctgatagttatactaacaataagaatatgtgacagattaaatgaaaaatatagcaggatgtttaagtctacacaaaggtaaggtccttcattgtgacaatatgcagttttgcacatacaaccatatttggagcctgtctacaccatgttcccagcatcagtggagtcaggagagtggtgatgttctgactggtaggggctgtttttgaaatattttctaaaatctcttcatttgttaacagtttcctctctagtcttgagtagcctttctgtagaaaatctgaaagcgtacaagaggtaattgattgattgattttcttttcttttttttttttttttttgagacggagtctcactctgttgcccaggctggagtacagtggcgcaatctcatcttagtgcaatctctgcctttcaggttcaagcgattctcctgccttagcctcccaagtagctgggattacaggggcctgccaccatgcctggctaatttttgtatttttagtagagacagggttttaccacattggtcaggttggtcttgaactcctgacctcaggtgatccacccgccttggcctcccaaagtgatgggattacaggtgtgagccactgcgcccagcttgattttcattttgaacatgcatatggccccccaagcttgcatccctgccctctcttcctgcttctcacctcctctccttcagaaacactggttttcctttatggcacccaccaccacacttgctactcctggctgccactgcatgaaggcaacaggaaagcccagcctggtaccctacacctgtgtaccaaccacctctgctcctcaacctcacttccttatgtactgaatttcttaagccctctcttgggataaacattaaaggtagcagcaaaaaatagaaacctgtctgactaagtgagcaagaagacgataggcgaaagcaggaaattttttaatctcatcctcttaaaacgtaaacaaaaacaaggcaacttgaaaatgaaatagcatggccacaaaataagagctatggtgtgcaaactgagcagtaaaagcataagatatgatagagatgcttaaggacagtagaaagatgagctatccacttctgacctcagatttcatggacgtttgtgataactcagattcggacagtgctttccaatgcagttcccatatgttaccccatttaaatctcagagcaaccctgagataagaattgtcgttgttcccattttgcaaaccaggacttggtaagatttagggactcaaacatgattcttctggttccagcttctgttgccgtgcacaatatgggaagcagtgtttcctctgacccacacagggacacagagcaagaccaaagtaccccagaggtccaactgagtatcagagcagaaaagagctctcaagagtagccagtccaaactcactccccattccccactgcccttttacagatgaggaaacagactcacaaagaccttgtaagtcacgagtcagaactgagtagtagcatcattacgggctggaagatgttaaaccttcccagttcctaatccttgtaggtttatttgtagaaggcaataaattataagtcagctcctcacagcagcccaagtggccagtgaccagcacttagtcagtgcttagaaaatgtgtgttaaacagatggaggaatgattcactgactttaattgtaaccgtatgcaaatcagtgcatttcttttatatctgtcttgacctacttttcctacccaaagatgttgtttttcactcagtttggaatgagagggtaatgtttgtagaaatcccaagacaatcagctgagaggccctgtaagtgcataaagtaccattagtggtattattgagttgcttttctatggtactgtgggttaatcaaaggcctttgtcattgttgttttaaacacaaatctccaatttattatttagttcgttgcttttattaacttatttgaaatgcaaatagcagcaaacacaggtcaacagctgcagctgtgggatgcagccagtgagagccaagggacaagatggagatgggattcccggggacagggagccatgggcttccccaccctccctggggactgactggggaggacacctttgattacagggatcggggagggtctcaggggcaagtgggcagcagaatctaaaaggaatgattgatctcagtccctggaagtggagaaaaatgactagacagcctgtaccttcctgataagtttcccctaatagattcttgctgtaaaagcaaagcccaaaaccttccagtaattgcttctggactgtgggaaatgacagtgctgaaggaaataatacaggcaaagcagtttcagtaatgccttgcacatagaaagcagttactaaatgctagcctttatcactctttcttgctctgtcacccaggctggaatgcaatggcacgatcttggctcactgcaacctcagcctcccgggtccaagcgattctcctgcctcagcctcccaagtagctgggattacaggcatctgctactacacctggctaatttttttttttttttttttttgagatggagtctcgcgttcgcccaggctggagtgcagtggcacgatctcagctcactgcaggctccgccccccggggttcacgccattctcctgcctcagcctcccgagtagctgggacttcaggtgcctgccacctcgcccggctaattttttgtatttttagtagagatggggtttcactatattgtccagggtggtctcgaaatcctgaccttgtgatccgctcacctcagcctcccaaagtgctgggattataggcataagccaccgtgcctggcctatcccccgattcttatgatagcccttgtaatctgatgtattagtaagagatagtgggaaactctaaacgatgcaaacctaaatgaaccttaaatcttgtctcacttcatacaacgatttaggtgattaaagcagttggagaaaagaaagaggagaggtgtttgggaaaatgtgaatggattcctttaaacacagcacaagggagctgccctatggttgaaggggaaggaagttttcaatggtgtttgaattatgtgatttgagtatgactaatttggagaggaccactgatgtattgattggtaaagtaatgacaacttgaaattttggtgatttcctaatgagacccaaatcctgggctcagtggaaatgaatatggaaggcgacaggtaggattgatgtaataaaaagctggtgcccttattgttctaagactcgtatgtggtgaggcagtttgggtataagtgctcatgggcagaagacatttgaatggagcataactagagacaagaatctgggcccagagaggttttatgtaaatgcatataatttgatgttgaaagggttcacttatgcagaaagttagagatttgggcaacatggcctaatcactagtgattatagcaacacccatttcttgagtatccacatgccaggcttcttacctgtaagacctcacttaatcctcacaacagccatatggggtgtgagtactgttattcccatgtacgattgaggaacctgagggtcagagagattaaataatcagcccaaggtcatagttagcaagttgtagggctgggatttgaacttatgtttgccagtctccaaagcctctttcagagcctctagaagagaaggaaccttgtgcaatcaagactggaagaaaaaaaacagtcctagatgaaagattgtaaaaaggctgcttttggaactcacagaagggtactgaaaaaaaactgtagaaaggtgatctttctttgaagaagagtgtttagattagtacagtatgttactactctgttgtccctacatttggacttatttcttaggagtccttggtgattctttggaatttctctgaagagagcaaaaatgtctggtgtctggaagctactaaaaaggcagatagatagtgtatgttaacataatgaaaaatatcactagatgcctacttcctgtggactagcaagtaaacactgggccatcttcaagcttggctgtgtatgtacaaatatctgtttaagttgaccatctgctgttgtattgttgataaacaccattataccagtgatttaacttatgccctggaggaagaagtgccttctagaatctcttaatggccataaaacattggcgttgatagattttagaggcaggcagccttcaaggcattcaatgatgaaaataaagaaacatttgtgaaaattcagtgaagatttcagaggccctacaggaactaggagcttcataccaagttcacatttgagtctgagttcagttttaaaggaaatgactttccatgacagaatagtgtgagatccaggccttactcatggttgttgagtacatgcagcctccagccacacgaaataatacgttcacctggtaaagagtgggggcttcatcagaatcacacccaactagctccttctctatgccttgtcttcctccagcgtcttgtagagctaaaatgtgatgactcttttagtttgtatggaggagggtaaaaatgtgttttcaaactgagcaagggaagaagtttcagccattcctttatcttcttcccctttttttgtatttccattttcactttgagcataaatgggaatcagaaggtaggagggaggatgttattatggatcagggaccgagaataaagggcagttttcagctgtatgttggaaacttaaaaaaaaaaaaaaatccaaaccaaaaaaactttctgtattcattccgttttggaaaagactctgaaaaaggaatcacatctttgatcaagagcaatggtattaggtcttttactacaaattatacttttctgtgagcctgtatttattttgccaggcttgaaatagctgatgttatttaaacaactgtgtgactattgtctaggaaatgagtgtaggctgggaatagcctggctgattacattgtttagaaatgagccttattttttgcagtccctttaggtgggagggttcatgaatgttcctgtggttggttgttccatggtgtcttctgtttatatcaagtcagtagcctcatgatgtcatcattttattctaccgtatatcattttaagcctactgaagaatgaacagagctagttccattccttgagacagatatataggcaacatcaaagaagactaatctttgattagtctttgaaatctcctaatctacagaaagtagagactagggcaaacagtggggctcccaccctctccacctcagggaccagaatcctcattgtgatttgctacaggcttctttgtctctggagagcttcaagagcaagctagactgaccatggaaataagtgacagttcattggtcaggggcctcaaagtgttacctggatgaatgagagggtctagacttaggcccagagagagctggggatttcataggctagaaagaccccagaacatagtacaattcagttgcctaactccagtgtacaccatttacatcatatgactagtgaatggtacccctgggcctggggagaacatgttgtttctccttaagattctggtacatccaccttcaaagatcccaggccaggggactgagaagagtgcaaccctgagtcagccagggtgtttgactcagtggtactcaggggacagagagagaagatgagcctccatgccagatgcatgtgggtttgagtcacaactttggcactcacaagccacctggctttggatcaatcacttaatctctctataccctggttttccatgtgtacagtgaagtcagtcatacagctgccattgagaaatggaatcaatgtcataataatactcaaacaatacataataagcagtcaatacatggtggctattgtggctcatatgaataatagtactagtgctggtgtgccaatgaaaggacaaacaaatgaaaaatactgctctctgtgagactcttttcaacccaaagggcatcttgccctgcatggccaggattctgcagatagatggacagggaagttgcagttggtgaagagtcacagtggcattcctgacttcctctgcctgtcttttctatcccaagggacttctgctccctcagctcacacttaggttctgctgatggtgtgctgaaaacataggtgttgaaaaaaagcagagctggctcagcgcagtggctcacacctgtaatcccagcactttgggaggctgaggcgggcagatcacttgaggtcaggagttccagaccagcctggccaacatgatgaaaccctgcctctactaaaaatacaaaaattagccaggcatagtagtgggcgtctgtaatcccagctattctggaggctgaggcaggagaattgcttgaacccgggaggcggaggttgcagtgagccgagatcgcgccactacactacagcctgggtgacaaagcgaaattccgtctcaaaaaaaaaaaaaaaaaaaagaaagaaagaaagaaagaaaagaaaaaaacagaattgacagccagttcagaaaccttatgaagagctagtactaagttatcatcaccagagagtgaaaaggaccttcaagtccaagacagcactgcagacacatcacgccatgccaggcaggggactgaactcagtgctgcgtgcaacctaacattctgtgatgaaggattaagtcatgccactagcaaagtgggtgtgattggcgagagatgagtgtctgagctggggagaaaggaaagaaccaaaataatggcagaaatatttttatcctgtaaaagtaaaagtcactgtcagtgtgacaattgaaagaccttttcattccctctgagatattttcaaagtgattaacttgaaaaatcttcgatgtaagggctgtaacatgactgggggggcatcttttttttttctccttcttctcttacttcttggaggaaagatgaaataaaatggttttaagaaaacgaaagacatcctgaaaaagaaagttaacaaaaacacaaaaggaaaaagctccctataaaaagcttactacctgctccctgcagttacaggtatcattttatgttagcgcttatgaaatatttctaaaaaaaaataaagatgttcacatgggttttgcttccttgcttaaattctgtcacctcggtggagtccagggtctttgctgcttacacacattgtgcgggacccaacatagtagggacttggtaaatgttaaaccatcatcattaaaaaaacactttctcttccactttgagtcctttaagttttatgaatgcatgcgggcagaatattaattccagcacagtgagtgttgctcaggagtgattatgccacctggcttgaagccttccagtgcacttgtggggattttcatttcactcatcatttaaagtttgtcatgaggggtctctgtgaaagaaaaatatagaggagcctcggctgggtgtgggggctcacgcctgtaatcccagcactttgggaggctgaggtgggcagatcacgaagtcaggagatcgagaccagcctggccaacatagtgacaccctgtctgtcctaaaaatacaaaaattagctgggcatggtggtgcgtgcctatagtcccagctacttgggagactgaggcaggagaattgcttgaacctgggaggtggaggttgtggtgagccaatatcacgccactgaactccagcctgggtgacagaatgagactccatctcaaaaaaaaaaaaaaaaaaaaagaaagaaaaatatagagaaacctaaggagagaagactcactggacatactgtgtgaagagttctctgactctagatagctttgtaaataaggcagttatgtttcctagtctatttcttttccaaaagaagggaggatgtgtgattgcctctagcccaacatttgtagccaactggatgagattccatgcttttaccatcattgacccaaataggtaacctaagaattgagcttaaactgcttctcttgcagcccatctgtgcttccaataaggaatctgagtcatgtctagattaggaatcagatactttttttgccacttgagatgagctcatttaatagaatgcttccatttggtgtgggataaagtatggatataggaaggaggtgtcgggatcatagagctgtaagggcatgaggtcctgtgggagcaacctcagcctcttgctttggggagggtgaatgtgtggatacctgcacattactcctggctctgccattatcttgctgtgtgacttcggacaagtcacttagcctttctgaaccttaatgtcttcatctgtaaaacagaggtttggaatagatccatataaattcatatttctgtaaccctgtgttacaggctatatgacttttttcttttttcttttctttctttctctctctctctttttttttttttctttttttttttttttttttttgagacagggtcttgctctgtcacccagactggagtacagtggcacaatcagggctaactgcagccttgacctccaggctcaagtgatcctcccacctcaacatcccaagtagctaggacaagtacttgggacatgtaccaccacacctggctaattttttgtagaggcagagtcttgttatgttgcccaggctggtcttgagctcctgggttcaagtgatcctcctgtcttggcctctcaaactgctgggattacaggcatgagctgccacgcccagcctgctataagacttctaattggactgcatcatttcatcccagagacctggttcccagggttttcacaaggtaggaggcattgtttcatagttcaggtgagggtgttgataatctaggccaggactgtgacaagggtgacatcatctgtggtatgaaatttatttttagcatcagaattttgggggcatcttgagttgaagagcagtggttccttcattgaatgacactaatttggctattctctgggtctcttcttacagtttaaaaaggggctgatgatgggctggatgggaactgtttccctggtaatgttgccaactcatctctttgctggtgccagctttcttgtctgagttgtagagctcatgcctgatatgacagtggcaaaggatcatggaaatcatgtgcagggtaaccagggaaccagcgcagttgccttcagtaattaactaagacatccattctgaggtgggtgggacctcagttccagctcctctgcatatcctcagggacagggtaaggcttgtggtcttaaacagaagagctctcagtccgctgggtgaacattgctttccctgcgtgtttttacttgcaagggtattttgttcaaacaattttaatatttatttgttagggggttttatctctattcataggtgatatttacccatgaatgagtatttttcttggaagagtctctttcctttcttccttgtttttttccctcttttcaactgggtttacctgttagcaattggacatatatgtcttgtatgatacagtgccctactgttgctattttaataccatgagaactttgaaaggctaaaaccaaagtacaggacccactgaagcctacactttacaaataaaaggtaattttgtcagctaatttgtagtggattccttgaccttaatctttcttggtcccctggtcaaaatatagtcacccaatttgctttttttcacatgtccatattttaattctttgccaatcattgtctgataattgtcttaattatttgtttatttttgctcctctgcccctactagaatggaagtcttgctgaccactatctccaggacctggcatataggaagttcctaatatatatttgtcaaatcaatgaatgaatgaatagatacttaagtcatagaatatacgtcaagtccacagacccagaatctaaaataaatcggaatttaaaatgttgtacatcagttggttaaaacgctaatagaatagagatgttacttaggggattcaatggtccgaaggagtctgtggccaggaggaagaaccaagaacaaccaacagtcctgttcctggccaaaaaccaggaacaggaccttgggcaagtcacatgacctcttgggctcagttttcccatccactaaataagaggatgggatgtaatgatcattagttcacttagccatttattgaacaggactatatcactaccctagatgaaaaagcagtgccatataaccataaacatattcattacatataaaatatgcattactattaaaatgtgaaaaagctcataagtgtatcaccccaatcttgcatactgccagtagaacatgtactgcatgttgggagacaccgtgatagagcatgctatgtgctgtgacagagcaagctacaaagcctaactgtagaaccagatagactagaagggagaaatcctagtgatagcaaacatttcagtagctctgagatcccatcatgttctaccctcacaacaactcttagggtaggcattattattatccccatttaatagacagggctcagtgttacttgctccaaatgacactagtggcaagaggacttaaacccaggtcttctggctgcaagtcccaggccctgaaattttaccctgtaatatgctagctgtggtttggcaaatgtaggagaaactacatcatgtacaaggtatatcccagcactttaagcctcagagagttttctcaacattttctcctagagtaatagcttctgtggcttgtacagagcctccctaagcagcactgatttcatgatcgtcaacagaatccagggaggtaagggcagtgtgcagacccctttccagcctctggggagagaaagaagtggccactggaaccttggtggagaggagtattccaggatcccggtacacgatgggcatctgtttgtaaaaatgcatgtaaatttggcctccaaaatattccgtgtagtctagttctcactgaactgtggcccactgataacagcagtgttcactccctagagaggtcgagacagcagcttcccagcactcagaggtgtcttcctgattctccccctggctctgtgagataactccctttagccctttttttgtctgcagccagcaagacctggtgataatgtgaggcccgaggccgagctaatcctccctgtagaaatccaacagtgaagcgtcttgtctttatgactattcgccgaggatgtgtaaagggaaatgcaagccccaggcagcagtagctggctgggttccagagtcaaaactgaattaaaaactcattaagtagtactttgagctcgcaagctgactggcgcgcagtgctgggaaagctgatggtggaggaagggaagggctggcttcttcccgttggcaaatggcagactgtgggcaggacggggcagtccaggaaacaagatgaaacacagcccacttgtctgtcatgcagacatgtttgtgagtatagcttttggtacagccacataatgtatgctaattgctatattccttcttttttttttttttttccacgggaaatggctcggtgagaaagctctgaaaccaaagaggcaatgcagaaatgccaaaatgcagacattacaaaagagagaggaggaacaaagggaaacaggggatccaaatttacatcatggtttagcgttctgctaaatcagcacctccctggtccatgcaagtcatatggaaaataattgagcagaatttcctatttgggttgattttcactgcatctatctcataggttgcaatttgttaattggattttttttaaaacaagaagcaaaaattttacccccaaggactagaaagttagcaagttaagttgaaactccaaagtaattatcagagcttccagaaaatattaataagacagtatgagctggttctctctctactactgttctgaacaagacacttctcagttgaccacaagactcagatgcaaactggggaaagcacacaactgagcccacttaaaagaatcatccatctgtaagaaaactcattcagaatattttgtatgtgccaagctgtgtacctctagtgttccgttagatatccttttgcaactgtcattctttaaatcaaataaaaacagaccaagatattaaaggaatgctttgtctaatgaagcaagagtgcacagacattttatattgaaagagaatggaccagaaatgagaaatatattttactttgtcattggagtcaaaagaagtattgataagtagactttctttcccccagtaacccttcattttttttaaataaaaaagtaacattctttagagcagttttgtagttacgaaacaggaacttttataatgaatttgattagatgtgacggaaggaaatgcaagtatttttcagaacgatgtagataacacattaaggcatcatcttctgtcatttaagaattatgagaataaagagaactggagtcgggaatgtggttagactctcctctggagggatagctgacgcacggaaagcactgctcctccacttggctcttgcccctgtccagctcctgtcgcttggccaaggccctgagctgaggagggcctcaggcttgctcacctcctgcctttccaatccttaactttgaagccttgcattttccagatatctgagtttacactgagcagtggtgccctcggcaaccttagggtgctccatctcaccttccagcttctccagcaacagcctctgctccaaaataaatgaggtgttcagtgttgctttctgggcaggaatcagatgttctttctttcagttaaactccagagctctggcagagcttgatttggtccatttttctctagggccggcttacctgttggcatttttacagagacaaaatatgctcccaatttatactattttatttacgaaagagcaaagagtaatacattctaagaactttgattagcatacatatggatcattgcatatattccaagtgtatataaatacataaaaaatacccaatggagaataatgcaagacaggaatgtagaaagtgattttatgcatgctgcctttcttaagagaacttgttacttctcatggaaattaaaatctggggatttgctcaagggcaattttccccaaagtccccagattatttccctccctccttggactcattttaaactaaaatttcagtcttttaaaaagaagatagaagaggacagaatttatttgactaccttgtttgacttgctctttgtcatgggtttcagacctgtttctcaggagagctacgtctgttggttcagagtacatttatcaatgccttgaaaatgcccattggccagatttggttgaattgcctcagaaacaaatctctgtttgttaagtaaaccattaattaaatatatggcccagaacttaattcctttggtttactacatcacattttcctaaataagcagatgtattctttcaattataatatcccagaggtcaacggtactcatcttaaaacaaataaaaaataggttgttaaggtaagaaatcaaccttcagcaaaaaatatggtttgggggcatactgtggcaccccattaatagtgaccttgtgaagaccttgtcgttgaatataaaatcaaaatgaaatctaacgatgcctcattttaattccttaagagatcttaaggggtggcagaatgaccacaggcaaaatccaatgcgcgtgtgagaaaaccaaacacacaaacaactcctgacactttggggcagtttttggccctaatcacttgaaaagagctaggcaatgtcttctttttaattatttatgcatggcagtgggtttcttctaatgatggcccaggtgtatatttttcagatcctgaaggtagatcacctgatttgcttacttctaaagacaaagtaagcaaatcacactttgattgtttactttgcttgttaaatccctctgagtgggatttaacataatagtgtggattgaatcacacacacatttcaacccacactatgatgttaaatcccattcagaagtggagtgagtgtttgtgtgtaactatgggtatctatatttttagttgtccttttttgcaaaagattgtcatcacctaaatccctataggtggaaggctcggatctaggctttgtgagatttacatagaaattgccaccttcacaggaagttcaatgagaggtacatgaaagtatgtaaaagcattttgttaactagagtcttataagttggttggaggcaatagctcatataaatactatgtacatcctctaattgagctatatagtatagagactgttaactgctataccagaatttggggataagagacaactctgggaattgaagtggacagagagatactccctgaggaaataaaaatatgagctgaacatgtaagaaatggattagatttaagtaggtatgatgccttattttatggcacagtaaattctatcaccaaacaacactctttatttaaaacaaccttcaagcaaagtatcccactagggcaaaaaatgaatgcagtgaccaactggcatgaatatctgatttactaaaaatttagattcctgttagtggaaattaaatgaacacatcagcattgtaaattaccagtctatttcatgtaagctttagtagtatggctctttaagttgaatgctattaggtgaaatggaaaactcaatggctaatttaaaagccaagggcctgcatcctatccgtcaaagtatgattctccataggcctgagtcagcagcaagctgggtttcacatctctttatctgctctaaaaacaatggtatgaagggaagcttttacaagaaggtcagctctctgtatgatgtttccaagagagtactcaatagttcgtgcaagcatttaccctttactaaatgttttatttagccttttaataaatcttttactgctgaaatacagggtttggatttggttgaaggagaagtggtgaaaggtttagttggagaaagttcttttattaaatttctcctccttctgcccaccgagaggagctgggactatcccatacacagtggctcagtatcccctgtggcagagcctctgaagaggtgatcagaacagttaacctgccaagaccttgttgcgtggtcctctttgatgtttaatatagccagacgcggttgttcacgcctgtaatcccagcactctgggaggctgaggtgggtggatcacctgaggtcaggagttcgagaccagtgaaaccctgtttctactaaaaatacaaaaaatgatccagatgtggtagcaggtcactgtaatcccagctagtcgggaggctgaggcaggaaagtagcttgaacccaggaggcagaggttgcagtaagccgagatcgtgccactgcactccagcctgggcaacaagagcaaaactccatctcaaaaataaaataaaataacataaaataatgtttaatatatagggctagaatatctatccaaagctttatgttcatgtagcttatcaagccttcaaaagtgacacccttctcttgctgctgcgtgtcaggacaacatagagtaggaaagggtaaagtgaaagggggaaaagactgaagtcttccctgctcagaataaggaaaaagggtaaagaggaaaacatgagcaaatatggtggcttttcgggggacatttttgagataaacatagcaaaggatagtgcctgaagatgcagtcgaggtcttgaaagaccatctgtgggccaagagtttaaagaaaaggcatttaacagtgtaagaaggacagctgcagtggctcacacttgtaatcccagcactttgggaggctgaggtgggaggatcacttgagcccaagagtttgagaccagcctgggcaacatagtgagaccccatctctacaaaaaacagaagaaattagctgggcatggtggcacacacctgtagtgttagctacttggggatgctgagttgggaggatcacttgagcccaggaggtcgaggctgcagggggccatgttcatgccactgcactccagcctgggtgatagagtgagaccctccctcaaaaaaaattttttttttaaagtggaagaaacgtgtttgggattcaatcaaacccaaatgggagaagttgagaactaggctttaaatgagacatcattttggtttcccagacagggcctgtaactaaggataaagaacaggaaagtagaatcaggactgtgcccctggtgtgccgagaatcacccttcaggtctggaagagggaagaaccaaggtcactgggaaccgggtgtgctgttctgggcagctaggcatccagccatgactgaacaacacaggcaccgtgcaaagaggaaatgcgtaggtgctgattctgtcgtcacttacgaatgatccatctccacctcaccctttgaaatgatgcagtggagttttgaaatgatgcagtggaggaataaacacaattcatacaaacaacaaaaatcacaggtcccttgggttgggctaaggctttatgtcaaatcctgtaatgatatgaccagatttattcatcctggctggggtgcaggacctgagtgtccacctgtacattacttattacagatggtggcagctgaggcaccacttcagccaggaccagagctcaggtcttgaacctcatcctttttggtcaggatcttgaccttaagaagtcccttcctggccaatcaccaagctggttgctgtggcccagcctgatgctgccactaccaatgatattgtccccctcgcagttttactggggaaaaatcaactcatactatttctccctggcctagagctaacaactttctgagggatggaaatcagtagattctaggtttaatatgtgttatgtcggccatttgcattttttctttttttttggttttcttttcaatagccaaataccaaaaaagactaattagatttttgtttttaaaaggcagctggttttgagaccgaataatagtttgatgatttggtttgataataacagatgagggtgaaaggtcaaccatttccctggatttgatcaatggcagtagtttgatggcaaattaaatatcagataaacctgtcaagtgactccaagaatcaatatttactgggaaaagttgtttgagcctttaatgattacatttgctcccaagggaaataatgctagaaatatgttcaggtattaggataggaatacataaaaatcatgtgaggatgattttaaaggaggtcacttattatgttgttattgatcaataaggtattcatcatctgtgtttctggccaagcctagcgccaagcatgagagccacatttctgcctcttattggacagagccatctggagatcctacagggacctcaaactcagcatgcctccaagcaaactctctgtcatctgtcttcctgcttccctttagaatagcttattagttgaaagcttggactttggatactgaacacctggtctccatcccagttccgctactaactaatgcagaccgttgggctgttgctccactgccctgtgccgcctttgcctcctgtgtgcaatggggatagtggcttcctcatagcattaatgtgcacattacatcagatcacagacataaagagcttaggtcaggtcttgaatataccttagccatttttcttattcagccctttatgcaatattgattgcgcatctgctgtgtatcagaccctccttatgacttacgattcctgatttagaaactgtaaaaacactgtctcctgtttaaaccgtatttcttcaggataggggtagcatctcattcatgttttaatctcagtgctcagtttatgaacgtagcactaatttgcctgaattaacctccagaaaaccatgtcttctataagtaattcacattgttttaacaaataggaaatacaaaagcaggagaagaccatgaagatttttttaaaaaggtgtctgaaacctactctagtctcaagaaagtcaggtctaattaaccatgtgaaagtggcttttttgtggtaaaaatagctgatatcggtaatcttttggttttacctaatactgcacagggcacctggcacaccacagggtttcatcacaacaaaaataattcccagatccatatctcaaatgctgggattattctataacattctgaggataatgtacctcagatcttattcttaaagattaaggatctggacctcgtaaacacttaaaacaatctgagaagcagtgagggacagtgaaaagagagtggggatcacgagtcctgtggactggatttaaaacctagttcctgctgggcgtggtggctcaagctgtaatcacagtactttgggaggccaaggcaggaggattgcttcagcccagtagttcgagaccagcctgggcaacatggcaaaacctcatctctacaaaaagtacaaaaaaattagccagccatggcggcctgtgcctgtggtcccagctattcaggaggctgaggtgaaagaatcacttcagcccgggaggttaaggctgcagtgagccatgtttgtaccactgcactccagcctgggtgacagagcgagaaacctcgtctcaaaataaataaacaaataaacagataaatcctagttcagtagcttattttgtctctctgatgctggacaagacagctaactcttattgaggaacctgtcccaatagcttctatttgtccatctataaaatagcaagaatgataaacattgacctttgtgatatgcaaatgaggtaatatgaaaataaaaaattgtataaaccataaagtccatcacaaatgaagggtagtgttactattttagtacccactctccaatagaactgaccacaatatgcataggaaatgcctatgacaggccactcctcgtctttgagattcagttttctcttctgtaaaacaagaggaagagagaggggacgaaattgtcgccaggactccttcaggtcctcccattctgtgaggtgaggaaattctgatttcttacactgtatgagtgacaaatcctgctaggcttgcgggggccacatttccttcttggctgctggaccccttacattttacatgcagaggaggagactcctttcttgtgcgttgaggggcatgtgtattttcctttgtctgcagcaggttttgcttagagaacagggcactcacagatcccaccttgtctcagcctggaggaaaccaaatcagagacttggaaccctgtcattagagcttaagtaagtggacacagaagaaagtgctttggaaatggtgaagcaaacaccaacacaaataggcattgaactctgcttcctttcttccttccttccttccttccctccctccctccttccttccctccttccccctttcccccttcccccttcccctctttggcccttccttccttcccgccttccctccttccctccctccttccttccttccctccctcccttccttccctccctccctcccttccctccctccctccttccttctatctttcctccttttccttcttttgacaggatttcactctgttgcccaggctggagtgcagtggtgtgatctcggctcactacagcctcaacctcctgggctcaagtgatcctcccacctcagcctcccgagtagctgagatcacaggcgtgcaccaccatgcctgacgaatttttgtattttttgtagagatggagtttcaccatattgcccaggctggtcactgtatttaaagagacctggagttggctcacctgacaggttaccccatcacccttcactccatgtgccttttttatttttatttttaatctgtagcttctgtactttgttgaagatgtaacccttaggctattttatcaaccacagctggtgccaggattgggctttgctggttctacttaggtgccctccagggagcccaagtttcaacaccatctacgttatttatttctacttctttcagccagaggataaaacagagaaaaagggagcaaacttcttccttccactgtctttcaccttaacccttgatatccttgattctcatccctttgccttgagaatttttaatagggagaagaaaaaaaggaagaggaaaacctaagagaatgggactgggtaggagagaaacaccgaagagaggatttagaaagcaggtcaaatgagaatcctgcacatggaaaaccaaaccaaaaccactgacaacaaaaagaaaactaacaaccacaaggtccaggaagtatagagaaaattaggtatagactcaaattaggtaataactaaattccctgtaacacaaaagatatccaaggtaaaaaaatgttgtctaactcacaagcaatgatcaatttatttaaactaaagaacattatttgcgaagtctcctgaacttgagtttttttattctcttaagaaaacaagtgttcaaaatttggagagccatagattcaggaacattttcagagatgaaacagatacataaacaaaaatttatttcccacagaaaagaaatgtcatttctaggaatattaggggaaggtgggaaagaacttggctgatggttcagcagaaaccaagaaggaattgccctcagggcgtgtgtgggaggccatagtgccctgctgggtccacacacacgtgtgtgcacgcacacactcacacacacttaggcaattcagcaggcgttggctgaccagcagccaaccctggctgcacacttacctcttacaaaggagaatcttggcatcacagcttgaaaatctttattttggatgggagtggatcaggaaaaggagaaaggaatagtgtcacagcactgaccttggccttgagtggcctcatggagcgtgacaagggtccccaggcctgttcttccacactgtcaagtcagtaaacctcagctctttcgtccatgaagagaagataatatttgccccactacttcataaaaatgctgtgagacaaaacaaagaactacctgaaggacaaaatgctttggcaactctaaggcactctacacatgcaagattttattgctgtgttctggtgatggactctctggtgatcaaaggattagattttgtcactacccatttctatgtattagccttgtattcagtcatttttggacccaggagggatggcacctggcacatagaacgtgctccaatgtgtgcatgaccttaaaaccagcacgcacattgaattatgcttttgccacctttttgttcatgttccctgttgcctctgagacacccagcctagaaaaagttcttttccaagcctcaggctgagatgtgcaagagcggatgaatgcgaaaagatgaatgagttgattgggggagttaatttgatgcagaggacccctgagaaatccagctacctccagggctaggagttttacttccctggagacagattctgtgtaatttcctggtaacaggtggccttctgttttctgtgctgatgctattggtctttggggatccgtggaattagaaccaagtctcctaccacctttgttttctaacagcacctctgtggcaggggtgagggttttgtgtctcaccctgctttgggatcatgtcctccctcagggctgaggtaggtttttgctccaggggagccgaggaagtcttctgttaggctgggttgcctcgatccttctcctggaccctctccggagctctaagctggggcacctgggatggagagccgctcattgtagcttctcagagcatggttactgggtaaactatgttcacctctttctcttcctctctgtttttcgtgcttagaaatgatgtggtgggatggaggggcacagggagaaccacctgggggctgcttgtgaggcttccttatttgctggtacctttcctccctctgaaaaggaagttttggggattccttccggccaggcctctgggccccagcgttagttgccagggatagagaagacttctgtgaggggctctggaagaaaaggttcactacaaaactctgctgcttcaggcgtctcccctcctgcctcaccagctcccattctcttcaaatcaaccacacatttgctttacctgccatgtgggtttctgcagaaaggaggcctggagctggaaatgatttcacaccataagctgctattacaagcttctgggagacctgttggttagttattaattcttagttcctgtaccaagcacctttcatttcttgctcttagccatttagctaaattttactctcaagagtgttttttgcacgaggggttagaggttagaggtttccgctcaaaaaaatttactttggtaaagaggttgagttgaataactctgactctatcattttctcttccttcccttcctccctctcttttttccttccttccctccttccttcctcccttccctccttctcttcttccttctaatgaaaagagacttcattttttattttttgaggcggagtctcactctgttgcccaggccggagtgcaatggcatgatctcagctcactgcaacctctgcctcccgggttcaagtgatcctcgtgcctcagcctcccaagtagctgggattacaggcatgcaccaccatgcctggctaatttttgtgtttttagtagagacagcgtttcaccatgttggccaggctggtctcaaactcctgacctcaagtgatccacctgcctcggcctcccaaagtcctgggattacaggcatgagccaccgtgcctggcctgaaaaacagactttaaaatcaagacatttagtgcttgtggtctttcttgatcgaccaaactttacttttagctaaatcaacccagtccttttttatctcacacatttttctctctaactccagaatcttcacattgtaagttactccagtgttgaacctgggcagggggctggaagtagttggtaggtgaagagagggcagcagtgggagctgacagagcagggaggcagagatggggacaggacggcttttctcctggctaaagcccctgcccatgccctgcccctcagtcctggttaccaatagttcaggaccctcctcatcatctccctttcatactgagtagaaatcagaggcttgctttattcttcaactaccatttctatttccttcttccaaaaccagggtgaagcctctgaggggtgtgtgtgtgtgtgtgtgtgtgtgtgtgtgtgtgtgtgtgtgtgtagatgaatgctaaactctgtggagaagagatcccgcaagcatcctagaaatttacatacatagaaaataatattttgctttaggagatttcagaatcagctgaatgtagcaaaacataagctactaaaaaagccaaaccttataagacacataggttcaattaatctgtcacattttcaaaaaggaataaaatcccaacaacagccaaaaaatgcaggcttccttttgagttccaaacccagctttgggagagcacaaacaaaagtctcattgtctgcaaggcccctcctgcttcgagggtccttagactgtcctcttttgattctgaggtggcgcggaccccttttgtcacacacaatcttctccactgcccccgccccgccacccaggtcgaggcttcacaatcatgctgagttttgtggggaagccctcaaagactttttcttatgaagcgataagtgacacaatcattccaggtcgagcccccgcttttgctgccctcagaccgatgccggggaaagttaacaattcatggggctgcctaagggtttccctgtgaggtgtcgaatggagaatgcggactacaatggtggagagagaggctggaacccggctgcctttctttcctgggaacttcttttctgaggcaactgaatgagacctttacaagccagggtggtggcctcccttcagaatgcctggcccgtttcccagtgtgaaacattccccaaatatgcaactttgtgagcatcccagccgcctgcgctgagaacccgcccgcctgccgcaggaaagctggcacccacgggtatgccaggggtgggggcgcgtcagggcccctctgccaggcttggccagatgctggggcggcccagccccaggttacgtcgtccccagaaagaatctggccaacagtctggccgtgacaagagctggaagcttctctctctccctttaaatcccctccttcattcaaatccgatcctataaaaaggcttttgttgaaggagcagccatggcatcttggtgcacgtctgtgccattcctctcaatatttccaaagatggacaaaagagaacatcgttagttgaattcctgggcaaactggtctgaagattgacttggaaggagtggaggtaaatggcaactgtcacgtggcatttgttttgtttgcaactgatgaagccaaagaggaaaggaactgccggtggatggtaagaaggctcctgccaggggccacctcggcagcaggcgagctcactgtgtgtttggggaagagcgtgctgtggaggcaggtggactgtgcaggctgctgtcgcctggacatgggtgttgaagggtgcagctagcgggctcagggcgttgtgtaggatcacttcagaaagaaagaggctgggatttcattaccatcacttgtggagggagccactttatgtaccttgctcaagtctacttgtatggattcctgcagaatacagacgtgatgacagtcatacccggacactgcactggctgatgctctgggtgcccacaacaaaattgtgaccaaagaaatgactattccttctccttggtcttaagcttttgcttaatttcatctcaacctagtgcctttgaagctcttgaaatctttgtttcaagaagaccactgatggaaagacctagaaagaggatagtttcatgtgtcttgccaattttcattttatcattttcttatttaatttgattttcttttgctttaaatgcacatggttgtcaaaaccaaaaacaaccaaaaagccgaaaagcaatgtccaataaattacagtatttagcattcataataaatgaactttctttcctgtggtttattcttcttaagcctccgttctttgtctgctcaaactgtgggactttgttctgttttggagtttatttttaggcttttggagtaagacatcacatattttctcttaattttaacttcttttatgtggggtattctgccaccgttgcctttttttggccaatattctcttaatattttctgccttcctgcttttgtaagctcatctctgattttatttctttggacctttccctaactgtcttttggcatttggtgtctgtgccttgtctgttttaacaaattttagttccagtaaccaaccccatagggcagtgaagcagaaggactctagatccaggtgacccgggtccaaatcctggcttgaccacttactagttgtgtgactttgggcaggttaattctcttctgtagactcattgctttcgacagtaaagggggataatcatagtagctatgtcacagaactcttctgaggattaaacgaagccatgtatgtgaagtcttagaacggtgcctgacatcatcattgttctgtttaggcttctgtctgtgatgtggggtttgttggtaaatgttagctgttactgaaagtaggatggtgggggagaatgggcttggtaacagtgatggtggttggtggtgagtatttcaacatgttgctgtttctgtagtacttctggtccttcctgatataaaggaaaaagaaccagtgtatcctgaactgctttatgttttttattttctaattgctttattgagatctagtttgcataccatacaatttacccatttatagtgtactagtgaatgttttttggtatattattaatttttaagtcgcgataaaatataacatttgccgttttaactatttttaaatgtacaacttggtttcattaattacattcacaaggttgtacaaccatcccctctttttttattttatcaagtttttgagacagagtcttgctctgttacccaggctagggtgcaatgacatgttcttggctcactgcagcctcgaccttctgggctccattgattctcctgcctcagcctcccatgtagctgggaccacagatgtgtgccaccacacccagctattttttttttttttttgagacggagtctcgcactgttgtcggggctggagtgcaatagtgcaatctcggctcactgcaacctctgcctcctgggttcacgcgattctcctcttgtctcagcctcccaagtagctgggattacaggtgcacatcatcacacctggctaattttttgtatttttagtagagacggggtttcattatgttggccagactggtctcgaactcctgacctcgtgatccacctgccttggcctccccaagtgctgggattacaggcatgagccaccgcacctggcctttttttttttttttttttttggagacacggggtctcactttgttgcccaggctggttttgaactcctgggttcaagcaatcctcctgcctcagcctcccaaagtgctgggattataggcataagctactgcatccggccttcatcacctctattttaaaaacattttcatcactccaaacagaaactgtacccactaagcaataactccccattccccttcccttagtccctggaaccttctaatctactctctaactctataaagttgcctattctagagatttcatgtaattggaatcaccatgtttatccttttgtgtctggcttatttcatttagcataatgtttcctaggttcatccatgttttggcattatcagaacttcattcatttttatgtttgaataatcttccattgtattgatataccacattttacccaatcatcaatagatggacatgtgggttgtcttaccatttggccattgtgaataatgctacaattaacattggcatacaagcatctgttcgggttcctgctttcaaatccacctggaagtgggcttgctgggtcatacagtaattctattttagctttttgaagaactggccaactatttttctagaaaacagttgcttttggtcattctctcctcttgtatttctctcctctggtgtctgcctctctcagattcttttccatttcctcctgctgcctgagagtcattgtacttccaagcagcagacatgtttgtgtctaccctcccaaccatgcgtctccctcccacatttcggagagaacacccacttccctgtccttagcagctgcccaagcatgtatcaccaactgggccacacatctgcctgatcatttcatcccattgtccagggagggggagtcttcatagaaggtcatgcacaggtctccatccactttggctggagggctggttcagccaccgaatgaccctaggacctgtgagcagggggagtcagcgttgtggagccacagccccgcagggtttcagccctccttagacaggcggtcatcacaccaacgccttgctttgttgttctctgtccactgtgcatgtttttaggaggcagtttggccaccctgtttcatgggagggttgttctccacttttcatttgcttacggtgtctccagtttcctatgagcaagtgaattaattaatgaatactccaacagactgtaagcctgcctcagacagccattctggttgttgggctaattgttagctggggtttctggatgtcattcatttcacaataaggctcctaattaatctcagtgcagttctcaccagaagaaaggctgatacggagaaacatccccaattaccatgagaaaggaaatgtcaagagccccgttgagttttcctggcacccacccttgtctcagatgaaaaccgccattaccgcaaggaggctgcctagaccgaccctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcaggacaaaagatccttcatcaccgaagtgacgttttagaaacagtggtcctgatcaacccttctgatgaagcagtcagcaccgaggtaagcattcagctctgtagaatctggggccgggccccacacactggatagggacccagtggattagaagggctgggcaaatgggggcaggagagggacacaacagagagaagttctgggttaagaggtctttctcaacccccattaagtggctggttccctgcatcggtaccatccagaccactcctcctgataaggacaaagaagaagatagtagctggaactgtaagattttgtccaggcaagggagtatgaatttggggtatttatgctgggggtggtggggagtgctgctgggatggagtctgatagggatgtattagggaaaagagacgcaagccctcaggccgcgacatacagggcaaacctggagaagaatggcatctcaagaatggcatctcaatgcaagccccattcagagctctcctgcacactcctatcgctgtggaaaggcaggctagcatagtggtcaggagcatgggctggcaccaggtcacctgggttcataatcccacatctgcctcttactaggtgggagcctcaagcaagttatttactgtctttgtctccgtttgcacctctgtaaaatgggggtcataatagtttctacatttaatgttcatatttaatgttgtgcttagaagtgccaagtgcttagaacagagcatggcacataatgactgaaatgtaaatattagctgtgattgttattattaccaccatatgaaactgttgctatggagagtcactgggtattttggagcccagtgtgacataagaacttggttgaagccaagagtccctggtcacccaggccagaggagttgctatcactccactttccacttcctttattatagttgagcgcttttgagatagagttgcttctcggacatgaaagcagccaaagtccctgggaaccttcattgtttgcagcgtcccttctacccacactttgagcatctctgtgactgtatcctgtttttgtaaatggagatataattcaaggaccataaaattcatccctttaaagtgtgtaatttggtggtttttagtgtatttacaaagttttgcaaccatcacccttatctaattctagaatacgtctatcacgccccaaaagccctgagctcatcagcagtcggtctccattcttccccgatgccgacaactgcgaacctgcctgtcctgatttgccaattctggacatttcatataaatataatgatatactatgtggccttgcgtgtctggcttattttagcctaacagtttcaaggttcatccatgtcgtagcatgtgtcagtactgcattcgtttccaggctgaacagtgccagtgtatggatagcccacatctgtgtatccattcctcagttgacggacacttgagttgcttccactttttggctgttgtgatgtcacctgtcatgactgacttctgcctgctttagatcagcaggacctctgacaatccatgaaggtgtgaagctgaggaaagtgatgggatagcaatctctgttactaacagaatcgggaagtaattacagcttgaaaaaagctggagaattacagcctgggcaacatggtaaaaccctgtctctaccaaaaatacaaaaaattagccgggcatggtgttgcatgcctgtggtcccagctactcaggaggctgagatggaggattgtttgaacccaggaggcagaggttgcagtgagccgagatggcgccactgcacactgcactccagcctgagcaacagagtgagaccctgtctcaaaaggagaaaaaaaaaaaaaaaagctggaaaattaatatatgtccaggcaaactgcccggaagagttgtgagaaaggaaaaatatggaattttataaaaggaatccaggcttgcctgtggagcagatggggctgaaacaattacttaggtacatgtgttttttgcatgattacactgtggggttcttgggtaaggggtcatggtctgtttacttttgtatcctcccctcagtgcctaacatgatgcctggcaagtaggatgtgctgaacattcatgaactgggctcagaatggataccttggtgcttagagtggtgtttgctgaaggacagctggcttcctgccactgaaaagtgcacagagagttccttagcgcaaaccatgtgcaattatctcaaagattgctatttaggggcagccttttctttatattcaatgtcaagcaccttactgatgccactggagactgccgtggagctgtgtgtgtgcttgctgcacgccttggaagggcatatgggaggggttggtttgggaccctagtttggaacaccgtgcttactgaggaggccactggggaacctggactgtacatggtgattcagcctgtgagatagttccgtcttccctggtttcgcagaccacgtgctgctagcagacatttctaacagctgtggaacaaatgattaccagctgtgaagactgctttgaaaaagaggaggaaactagggggagaaagtcaactatcgctactgtcgtgattgtagagaaactttgaaaatggcattcttgggcaaactgataactacacttattggctttgtggatgatcctacagccagggatccattcaaccctcccgtgctcttctggcctccaggagaaattagacctttggggaatgaatgctttttgctggtaataaactcccatggctccgaaggctagccctgtcctgaaggtgggatggcagcactgcccatggctcagggcctacgttctgtgctttatttcaggtgcgcttaatgatcactgatgctgcccgacacaagctgctcgtgctgaccgggcagtgctttgaaaataccggagagctcattctccagtccggctctttctccttccagaacttcatagagattttcaccgatcaagaggtaggttcgtgtctgagaatatctgtgcttctagtggcttggttgccttaggttcctctttgagagcactgggggagacaaaagaagaagggagggaacctcacagctctcctgaaataagcaaaactgcatgatccaaaatactttatttctatggctcattgccaaaagaatttagagcactcatttacaattaattggaatcattcttaatgtgcctgagatatagatgggaggggttggaacagtcaacactttacagatggtaaaaatgatggagaaacttgaaatgtcagagcccaaaagaaaacctgcgtttcctgttttctgaaataatactccaaagatatctggggcttttggcacctcgttttccaggcctaattatttcagatttcttttactttaatgcctggccccagtgtttgaacttgggctgtttgaacagcccacaaaagagagagggctttacaaaaggagccacgtaggaaaatggggcacgtctgtgacccaagaaaaagatggctaaagtagctggactgaagctggatcattcatatttctaatgcgtatcttattcaaagatgacacatataaagtgttgaaaactgtgtgaagttagtcgtattttgtaaaatgagatcaaagattttgatatgcttatttctgcttgggaatttatcctggctgggaaactttccaaagtaatgcaccttgtttatctagcttacatgtttatagcaattacagaaacaattcagacccatccccatagcaggttggggcctgcctgtggccgatagcagatttctacatggagggactgagggatgttctgataagaagagtccccacatctgtttaaaactgtctttctgaggtggtggcttgtctgtctcatgtgtactgtgaagggccacgtgtccttctgcacttaattttccttggccctgaggttcagagaaagctctgtttgtacttttcatcactggcaagaactgtaagcacactgcccaacttcatctgagtcacctggaggcttctttaaaaacactgatcagaaggcataataatgttcactctccagccactggggtggggagaatgtaaaactgtgaaaaggaacatttttgaagccacagctgtcagaaggtgtggcgtcatctgcatcttgaaacacataccaggatgggatcccccaggcaggcagctcctttctcagaggcttcagagctcactcacagttggttcatctttaccacttcaaaatgcaagctttggctgtgtcttcttccaaggccgctagagttcacgcatcttgcctcattcatctcggtatccattgcacctgcacatagtaaaggcctagtaagccgctgttcaattgcattgaaattccaaagctagggctacaattctcactctgcctactgtcctgaagttgttgtttgatcactataatgtcagaatgttttgcaagattatgtccccatgtgcatgttgtacccggaggcaggtgggcatttgtctagtagctctggggtcacacacattattagcatcttgcctcagggaagagagaaagctgcagaaggctggaagtggcccaatgacatggtgagcagttaagtggcctgcttatagctcatttgcatgcacatgggcactttccacattcctgtgcagttctgtagttattttctagtggttggtttctacccaagtcattggtttgtcttttttgccgaaaaaccagacaaaggaaatatgtaaagaaaagtgtcattgccaagattttcaataaggaagtaacacgatttggcatatttgcatctcaaataatatccctccttccccttctttaaataaggttgttatgaatattgctgcttaatcatttttactagattatggaagcaaaattttagcaccatggactgtgcacgtgtcagattttgccactaattacagaaaaaaaaatttgccctaactgaagaactcgagttccgtggaagggcagattccccagggtttatacttattggggtaggttctggaggacacatattttgattatactcaggcaggtatcattatggtcagagaccatgtcatattctcttctgccacccacaaagaaaggatgccacagctaaagtgaattgaaaaccactggactggaccagtggttatcagccttttggagctaggattgcccattgttgccttggaaaaatggttgagtaactgaataacaaacggaccttgaagaccacttgttgtccagctcttttccttttatccagtccttgaaacatactagttaactccagggaaaccaaaaccacaatttgggacaaacaaaaatgatactttttaaaaaatataagaacagctaaaaataaatggactgaaaaaatagaactatcagtacactttgagcttcaggttttggagtcttaatcactggagatcaattaacaaaaccagaactaacagacggtacaattgtctggctaaccccactcctccctgaaatccagggatggtgaaatcatcatctcctggggacatttttcagtctctgtgttggaaagtttttccttatttgtctcattgtatcttcaaggaagtgatgtgatccctttcccacctacagtgtcttagttacccttcaccaacactgccgattttttccctttcagattaatcatcttcagttttacccacagttcttcataaccctgctcactgtccttcaaacttgttcctctgtcaagaaagggaggtgaaggccaggtgctatggcccatgcctgtaatcccagtactttgggaggccagagtgggaggatcacgtgcggctaggagttctaggttgcactcagttataatctgcactgcactccaacctgggcaacagagcaagattctgtctcttaaaaaaaaaaaaactatacttaaaacattaaaaaaataaaataaaaagaagaggagatgggatgggtatggggggaattcaggagtttagtcctggtcatgttttagtgccttgaaatcagacagttggatttatgagaacagagctcagggaactcagagtcgggctggagatactaatttgaaatccattagcatattagaggtatttgaagcccagaagacacatgatgtgacctagagtgagaaacattttaagaagagaaagggcccaggtccagtgttgacaggtcataaggccaagaggaaggagccagtaagggagacttgtttcaggtttttgcttgttggtctaatttctctaaaatgtcatgactcaaactggacaccctattcaggagtcatttgaccaggttaggattgtgagagttgataatgtctatagttttcaataccatcttctattaaagaagtctaaaagtgacttttgaccatcaccatacaccattaatggtcaatggggaagtcaatggggaagagatgcaggctttgaggggctcgacaatttatataatttaagggctcttttttaagaaaaatgaaacaattattaatatacagttaagtacagggccatgccaatgaggtaccttgaagtttaagcttctttggcttcatgataaatccatttgactgtcaactaaaatccctgagtcttttccatggatattattgttaagccacatctcccaatcctgtagtttaccctgctggtttattgaaccttacatttatccctttagaatgccatcctgttagaattgacttagccaccatcatcccaatgtcaagagcttttataaataccttaattctgccattccacattttgctgtgtctcccattttcataccatgcacaaatatgatatgcatgccttcgccatttttatccaagtgaatacaggccagaaaatgagacttgaggcagcccatcatagacctccctccaggttgacattaagcagcactatttatatggctggctggaaatccacctaattctactatcacactgttcaggggtcctattaaatgtctggctaaaacccagagatacactgtctactgtatttcctcatcagccaagcaagtaacctaatcaaaaaggaaatgtagttcgtaggccatggtttagaaattcaaatcttgtttcattaatctcatctgcagtaaaaccatttatttcttacatcttccttcctcttccagtatgcctgcatttaatcagaaaaagtaattaacaaaaaagattatctttgtcccaaagcatattcctccttgttgcatctgtcatccaactttgtaagaaccagggtagcactcagtgtggttacatctgaagtacccactccaggaagataacatgtgttgaactggccaagtttggcacacagatcaacaaacatctactgagcctgattatgtattgaggaaacaaagataactaagatacaaagatacagaagatatatttcctgctatcagaaatgtttagagtagtgggttataatagttaccatttatcatggtgatgatttcccaatttgttcagaagaagcctcagtttccaagtctaagaactagtcacaagcttccttgccactgctaacattgttggatcctccttatggttctcatctattcattgaataagcttggtcaggtgctgccgtgggctggccactcttaagaccctgtctttgcccttgaggcactctctactgtgcttgttggcccacaggtctggaaagaggctgtgggggaaaacacgggcttcattctgttgtgtagttccaaggatgtaggagttgttcttcctcctcctccctctgcccaattccatctgtctgttttatgactgagggctctgtccagccctgtctctgcattcttgtctcatcattcagaatgtgctgctgtttcttcagagggaccagattttccttctctggaaagaaacctgtcaaagcaatgctggctttcttttctgctttgccttgtacatcacggttgttcattcaccagtgtctcttggctatctttcatgacctctgacttctcagaattctgtgcaatcttgttttgttttggggtcatttcctgcatttcatagaaattctctggatagaggtgaaaagacggaaagtaggaagatattccttaagtctttctaccttctgcttcaacctggtaattacatactttacataaaaagagccagtgattgaatgccccctactcacagctggattatacccttggctgccacacctctcagctagggtggaatttcaaaaattaaaatgaactaaacttaatttttaagtttcactattaaagatacagcagttattctagatttgccccctaaaacatattataaaacatgaatagtttgcatgtgctttgtgtgaaaattgggatctagagacttttaattgtgctatagtgattgtgatgagagtctctgctaactattgtacaaaaaaccatatttgatgccctatgtttgctttggccagcaaatcatttgagcaaagatgcctgtcccctctacccaaagatggtattaccatttgctttttcacttttcttagctcccaaaaacaggagttgattcttatcctttttacagaaaattgtgaagtcacagaaaaacagcaaagttttattattttgttattttgcggccctttacataaaatgttatgcttaggactaatatgctaacaaaacaaaaatgactattttactgcaatattgcagtcgaatataggaaaactcagattctataaattattcttacacacattcataatagtagcctcagaatgctgatagtcaggagatagaggaaactaatctaatactagaaggtaagagttcagacctgctggctcagggatgcctggaccaaatgaaaccttggctttaccccttgatcatttgtcatccagaatacagagcccttttcagtcgaaactctgagctgatttgtgagctttactgagacggaaagaatattggagttgatggcatgattctccatcactaatttgctaggctaagaccatgaaatatatggccataatatggagtgagagagacaagtagtgtttttattaaaccacaatttctgttttggtcctgatttgcttttctatgtttacatccttgggaagtactaaacaatgtgttgaaaaatgtttcagccacatttgatcttagctgctcacacccaacttgccctgaaaagaatgggagcagtaagagaacagagtggctcactgtggagttaaacatgagcaaatggggaacgaacttggccaaaccactttaatgtcatggctttaataaaaaagtatttgtatctgcagagaatatgctgggtgacccactcatgtttcaatcagcgtgcactgatgccagaaaccagtaattttttgtagtaataggcaatccgtaacttcttgtctcctatggggaaaaacccaccaaggttttttcttttttacatgccagatcctgaaaggaggccacaacaagtgccctgttaatctgaatttctttaaggtatccatcaggccttttttttttttttttttgccaagtctagtggaataaaagaaaatattttttattagtggtgaaatgacccagacagctttctcttgtgatagtttaacgtttttttttaaagggcatctttgcctttattctaggggtaatattcaaagtgtttcataaccactgcagcacaatcctcagttgcccaggtggtcactggtgttagaactggagcagagtactggcattcccctgctgggcaggaatagatggtggaggggttgttggggaggtgccagggcgagtgggtactggttgaggtagaagccagtagcagcggggctcaggacaaaggctgttcaccttccagtagggaagtatttcagcatttaagcaaccaacatcactatgagagtgcatgtctgaaactggtcctatgtgcatcctgtgatcctgtaacacatagttatagctggagatgatggatcagtgatgataatcacttacaccttttctttctttctttctttctttaaaacccagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggtaggttgagaaggctgggcattggatatatgtcacaaccattctacttgcgtttacagcctttatatttccctgtttggctttgtactgggaagatgagggagcacaattgatgctttaccttccctgtactcttctcctctgcccaaaggtatatatctcagtccagtgtggccttaaggcttggaaatagctcagtgtatggttcaaagcagctgtgattcatcactgggattcctgattttgtgccgttttcgaacacagcaactacagccctgttctaaatcttcagaaccaaggatgtgtctttcaggtgcttctggaagactggtttcagccatactggcctcagaatccagcagggtaacacaggccaggagctcccaaaggcctaaggagaaccagaggtttcacatcaagactggatcaaccagtctagacccaagatttagagtccttttttaaaaaaaattttttttaaattaaaaatgtttacatttttatttaaaacatcaccaggttggagataaatcctcattaaaggcagtgttccattttcttatcagccaaaaaatactataatttcagttgaccagtgagtgtccggtgaaaattgagagaaaaacattgatggctctgctcttacccttctcttaccccatggcctcattagtagagactcaatgctatttcagattaaaattccactgggaagctagatgcatggcctcatgcctgtaatttcagcactttgggaggctgagatggaaggttagcttcagcccaggaagttgagaccagcctgtgcaacatagcaagaccctgtctccacaaaaaaaaaaaaatgttttttaattagctgggtgtggtggcacgtgcttatagtcttagctacttgggaggctgaggcaggaggatcacttcagcccaagagatcaaggctgcagtgagccagaattgtatgtatcactgcatgccaagcctgggtgacagagcaagaccctgtctctcaaaaataaataaataagcaaatgaaatgccacttggcaagagcaggtatccctgatttttgatcattcatgtttttggtcatgattctcagatttatcaggttctcagcaatgacctgggcttttgatggaactggtctatggcagtactgcttcattttgttgcttcacatcaatcacaaggattggcattcatacattttatttgctttaggtaattattcagagatttttagatcacaattcacaaagtaatgtaaatggacccaaacatgtaaggcacaacataatttaaataacattgccctgatttattagggaaaatctgatagagtaatctttggagctctccaattaagtacactttaggatacatttgttaaaactgcaaatttttactttaaacaatatggagtatcaattttaaggctcagttctcagcacatttggcctttctacatgcacatagaaaataatcggaattttttcatgtttaaaatgaatgaaaaaccaccagataattaaccctttcatctgaaagagttgacaactgacctgcacttaggagaaaacatgaaatccatttaaacagataaaaccaactgcaaatttgccagaacatatacatcctagcccacacaatttttaaaaaaactttttttggacatttaaagaggtaatttaaaggcaaagtaataagtgaaaatgagttaattttcatttattttggagatgcttttagatgtctaaaaaggcaaagttgcagtactaattgacttttaaagcaaacctgggcagttctgtcagtttgtgcttctgtgagcaatattcatttgatgttgatggtagtgatttagagtagagggcgaaattggcagacatgtttaattactggaagaactgtaactcacaaacttctagtacaagtcagaattctttaggaattctttggatattttgagggctttcggctcagattcattaaaataaactattgatctattcatagaatgaattagcttatccaattattactttggctgattctcaccactccctaacctctctaaaaataaaactgtacagttgatagaattagctggtggttttcaatctgggatgatagtctttaaatatcctatggagaaagaggattaagcatgtaaaatctagctggtgttttaattggctttacagcaatgaaaccagctgcatattagaatcgcctggggtgcttttaaaagacagtagttccaggccccaacccaagcccacttaagtcagactctagagaatgaggcctgggtgtcagtattaagcatccgaggtgattctgattatatagtcaggctgaagaaccactgcctcaaaatgctagttctattaacatttcaaaagctttaaacttcctaactggaacaagttagttttcccagacctttgtgatttgactgggggttttggttgcagtctgatatgtcctgattagctagagaaagcctagtctttctgaaccttcctttgcccaagtttggcatccagccttgtctagggaaagaagtatcacttttcagaatactgtgctaaggagagaatatggtgtttcatcagtttatgaatgagatggaggtgctgagggccttggaaatcatatggggttaagatcaaaactatttgctaggtagaatgttagggtataatatccagctgtggacaaaattgctatcaatgagaccctaaaatagagcactaagatcacttagctatgttttgccaaatacagacgttttcttttgacttttaaaatctacttcttagatcacttatcaaataaagaaacacattaacaacttctttaggaggagtattatatctagtgccatcttgggaaaggccttcaaactcttcttgcttcctaatattggttgtccacaaagggaaactatcccattcttcatttctcctattgaggtggtaaacaaccatgttatgttttgtcacattgctagcgtaaatgcccttgacagattaccagggagatggaaatgctgtcaccactttgcatgtctcagaggacctacttgtgattgaatagggaaggtgtgattgagtggggaacatgtgctggatgtatggtctcttcaccttgctatgaccttgctttgtctttgtttatttacccaaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgagaactcctcgacagtgtctgcactgccgattgagctgtgtccagaggcaatgggaaggaaccatgtttaaagaggcacctcatgtggctgatcgtggatccacatgaggtgcctcctgtgtctgtcacacacgaaatatcctgagaacaaagtcagtttaacacacagtaggtagtctgaaataatattcttggcaccaccaccaaccacggccttggaggaaagacaccttaactaaagcagaaaccatttatctgcaaaatgggcctaagattaattgcccttcctccagtatgccaagagtcttgtgtgtgtgaatcaaagcggtcatatttccatatgagagctcctgaggaattgcctttcttcctttgtgttttatgagtagactgcggctaggaatatggccatttagaaaaacagctctccatgtgaaattccacagcaggagcattgctgaatatagtccctcacaggacactcccaactcccaaacatcatgcctgaccacaaaccatcccttatttatttaatgacagggtctccctatgttgcccaggctggtctcgaactcctggccttaaatgattcttagaaccagctattattaattcagctgtgatctttgcttatcaagttttatttgtggttctgtacaaaattacctagtaaattgtgcttgtatcatattatatagaattacttgttatttaatcatatgaaatctaatgagaggcacccagtggctccctactgaatgctagatggaatttatactattcaggacattacttacccaccccatacctccatccccaaccacacacataaagtaaaggtgcagatctttgttctcaggacaaaatgttagttactcacaatgagtgggcttttgagggctttgaagtgcgcgataaaatccttggattaaatatgcaatatcttttatgcaaaacttaccagttgtgttaaaggaaatacaaaaaattgtaccctaacggaagcacttctcttaacagtaaagaactgagaaactgattaattgctttttggttccagccttcagtttcccttagaaacaatagcttttctttgcagctttattctggttcctggaaaatatacattgaaaaatcctttgcatttcttgaggaaaatagaaaagttttctctcatttcccttcttcttccagtggtctaataccttgctattcaatttttttcatatggtttctgtttctgcccttaaatagctattttttttttctctccctgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgga

SEQ ID NO: 38028 - DNA, 227020 bp, Homo sapiens; identical to SEQ ID NO: 37002

SEQ ID NO: 38029 - DNA, 2028 bp, Homo sapiens
gttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttg

SEQ ID NO: 38030 - DNA, 59258 bp, Homo sapiens; identical to SEQ ID NO: 36289

SEQ ID NO: 38031 - DNA, 17264 bp, Homo sapiens; identical to SEQ ID NO: 35725

SEQ ID NO: 38032 - DNA, 142781 bp, Homo sapiens; identical to SEQ ID NO: 37647

SEQ ID NO: 38033 - DNA, 71406 bp, Homo sapiens; identical to SEQ ID NO: 37772

SEQ ID NO: 38034 - DNA, 44628 bp, Homo sapiens
ggcgcagcctgcgccgccgggagcctccctcccagtgggagatgggttgagatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctaggctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatggtgagctgaagccactctggctttggaagtggggggcctgggtgggaacaggggcagggctggaggatgctgttggccggagacaggcggggtggtgggagcattatgttgggaggaccggctgctgaccaggggttatcactataaaatacggtgggcgtaggaagtggagccagcatggggggaggatgagtagcccttgcgcctgccagggtctttggtgggggagggcacttcatgaggatatagaactcttccttattgcctattacccgtttaaaaaaattaatttgagtgggatttggaagtatctttgctgcaggattgcttgtctgataaattaagatagaagagctattagacctgtgggaattaagaaatgtatcagccagacctgatcagtcattctctgacctcagagaggattatgatgctaagtaggggattgtttataaaataggacttttaagctaatcagggaggagcctgtcatatacataattaattagcattaaaatatttttttctgacctggggcagaggatataatgcatattccttgtccatgaggtacttctttagggaggcagcagggtgcctgctctgacatgtgcctcgggagtttcctgcctgaggtcctttatctctccacttggccatcgagtttcatggtctcacctctcggtggcctcacattggcagcctcaattcaagaaagagaaatgttgttttcctttggctgctctgccactcccccagcggggatggatatccagacatccgcctccttctgcccttatatgggagataactcttaggaaggagaaggagctgagcatgcgtctgtgcttttaggaaagcagttttctagcatcctaggttcacactgcaccctcctccccgattttgtctcacacttaccaactgtggtccagcaaagtcagaggatggaacatgtcatccatagcaccttgtcagatgagaaagtgttttcttgtttctcaaagatgagcagctcttgcaggccgctttctacacttggattcccatttctgtaagaaggtaaatgctgaggcctgagcaggcacaaatctattctccttgtgaatgacatagtacacttggatgagagcttttcaagcagctaattcatgttggcctggaagtcaagattgcctaagcggtgaaagatgaataagaaagttctagaaagcaattgctatttcggaatatcacttcttgccactccctacccctcctgcctgtttggttatagatctatagatatggttaagcaactttctttaatttgatatttcaatttaaaagctttaaaatgttttctgtggttctaagaaggaagagaatgtatttctagttgaggtcattcccagcaaagcccctaaaatacggacagtgaggaggatgagacactagtcctcaggctgcctcactgcttttgacgtgcctggctacctccaccatgcctggctcttgttttttactggattctaggaggacaaaatgttaactcctgatcgtggttgtgaggattcgcctgggagacttcaggggcacattaagtgggtcagtgaatcctagccactttcactgttgtctgggtgatagatttggaaagaattcctgagagggggctgggcccggagacccctcagcccctgagattctttcagtgctgatgttctcaaggtgcagtgcaaagagagatggctcgagactccttttccctgtcacatggaagcaccagcctcacattcccatcttgtcttgtagatttgctgtttttttggagatttaaaattccacttccctgaaaaatctgcatagttccttccaaggctagtagttatatcagaacttaagggccaggtacggtggcccacgcctgtaatcccagtacagaggctgaggagagaggatcacttgagcccaggagtttgagaccagcctgggtaacacggggagaacttgttctacaaaatgatttaaaaattagcttggcatcatatgcacctgtagtcctagctgctcaggaggctgaggcaggagatttgctcaagcccatgagcttgaggctgccatgagttatgatggagccactgcactccaacctgggcaacagagtgagaccctgtctcaaaaaaataaaacaaaacaaaatcttaagaattgttgagaagattctgaggacaatttgaaagtattgtgtcagaaatataaataactttttgataggaataaatcaagtaaacccttactccactattcctagcaggtctttccccttttgacatattatcttccccttgtcatgctctagctcaattactgatatataaccgctcctctgcccagcctggcaatgtacgccctccagcaacttttccccttgaaccacccccaccctgtactctcctttgtgatcagctcagagctgatctgccatgataacttggctggtattgcctgtatctgtgagagatcagtgttttggaaataaaatttccttctagctccaaaagctactagacacagactggcatcagtctttgaacgtgggcccagggatggtgatggaggaggtggtgggaggtaaaacaaagcaaaacttggagttctttgaatgctagattacccatcattttggtaaatctcttctcaatgaattaggcttaaaggcatccttgttgtgggagagactttgtaggactgggtcattcctttattcaatattaatttcattcattcaaaaagttaatcattaaataaatattttattttctgtgggccaagtactgtgttacccatggaggagtaagatgaataagaacatgtccctgttctcaggaataaattatgaaagctgctttctgaacaactcttcataataatcgtttttcttcctttttcttcaatcacagcctgacttcacccagtccaatccacagtgcaaagagcgagtccattataacccagtcagaagagaaggcagattttgtgattattcccgctgaaggaatagagaacagaacaggtactatctctacgcctgcctgggctggttcaaggaacagtcagcttgaagaatttagaggtccccatcaccaataagctccctggccttccccatctccatggtctgtgcgtgcagggtcagcactagagggctctaatgactttgagccaattaatgtggttatcctcttgcagaatgccatttctgatatcctagctgtcaaaaatcttgcagcagcatagataggccctttctcagctggctgcctatgaattaggaaatgactttggggcagtcaaaagccttactcaagtaaacacttttattattcctatcttatacaaataattgcaggacttacataacttaaattgggaccagaaatgcattgtatgagctgaggtgtctgtgagggcacagagaatagagagcaggtctatatcaggcttggtatgaagctacagaaaggaccacaaagagttccctttgtttagacttccatactctgtctcagttgctctttattttttcttacatagagagaaaaacatgcaagaagcaaagtgcaagacttagaattgtatttacccacaagagttgtaatgaaacacaggccctcagaagaaaaactggaattgaattcttctgtattctgctccccatctaaccctggcattagtaccaaagagtcagtcatgttactgagtcaaaactcctgaggccttagagagagagggagagcatttactgagtgccgctctgggccaggcaccagcaggccctgcacataagttacctcatttaatctttgcagcaacccagaggggttattatattcgtctcttgaatgaagaaactcactgaaagagtttatgcctttctgaattctagaatgcattttaaatggctgtacatacaattagatagtataaaatagacaaggaaaccagagcaaagagaccttaaagctaggaaaataaaagtgatattaaacagtttgtgcaggtatgtttttattggtttgtttgctgtgtgactcacacagtattctacatgaaagtggtccacttatgagtgagtgctgaaaggaatattgaattgaagtctcccctctaaagcttcagagtaaccagtaagattttgttttcattgcatctgacagctcctctttttgtacctggcaaagtcaggctcttggaatgccagttctaagaattaagggtgaagtctgtgtggcgcataccaaggctcccgtggagggaatcttaatacttcctaagagttttaaaagaggatagattgttctagcaccaagtgagcctgaggcctgagctcacagccaattctttaggcctcacaaccccacctggtggagagtccagtctgtgctatgagaacaggttcagaacgcaggtgacctgaacctgtgaacgctaccctgtgaacgctgtctgctggaaatcagttttcttcaacatgaactgtactccctcttttcattttttagaagggacagattctccattatctcgagactggcggccagggagcctggaacctatctggagacctcatgggaagaacagctgttggaacaacaagaatatttagaaaaagaaatggaggaagcaaagaaaatgatatcaggactacaggtagctctctcccttgtagtttgcccttgttataccaattgattattaagtcagtattatcaatggaaaataaactgattttagttttctaggaggtcagaactgaatgaggagtttagatatagggaatagcacagaaagagcagaaaattccttatatttgaatactttaaatggactttgtgggctaccgttcatagcacagcgcttaagatttcagcaagcccaggagccattactgacccttatcaagtccttattgttgactctgtgctacataggtgggcttctaccctgtatgtggctgcagacctgcaattgcagctttcaccaaagaatggcactgtgaatagtctgggattttcttctaggaattctctagcaggaagagtgtaagagccagtaatgctgccaggtttccatttgaatttagctaagggatttagctcactcctaatacatgtgcaaatggatgccaaggcataatggtcaggtagaagaggtttactttgagcaacaaagcccttcagtttttcctatacctgtagtgccagctcggcaaatctacccgagactgacccacttgacatagttcccaccctgagtgaccccctcattcttgtctttgtgtgtctgtctctgtttgggggagcgcttatagtgtgctgatgaccctgaaattgcctaggaatattcctttctgtttgtgctgggaactgcagtgcttctgaattgtcaaatatttatggacacgtaaacaaagcccacattatgtgtgtggctctggcagccggcaggcggtggagggcgtgctcccagctagcctgcaacagggtggggacacaaaagattcctaaagaagaaaggagattggtgctgtggcaaagcaatttgcataacgtatgccccaggaactgagaagtgtgggaggaatgttgcctgcgtaaacattcccaaagaaagttgttggttttccttcatttgctctgtatttttaaaatggctggcttatgaggccttttagatctcttttctgccactccattaacaaataccttaatggaatgtttttgtgtgtgttttacttgcataggaagtatgtcatggagaactttgagattatacccaaccaggttgttcccaggataatttgcattatatgaacatagatattcatcagtttggctcaaagtttgtttgcattttcttagtctgggagaaattcgatggcagattagacagaaaaagaagagaaatgacaggcagaaagtcagcatcttaatatttcctgcaaacagaagagttttaattcacagccacatgatcacaatgagaatttggttccattgtagaatacaaaagggctcacagcatccactgggcttcttaactcttttcagtgattaacaagttgcttgctaagccacatccaagatttctgacttattagtattccttagttagaaccctttgaacagtttgctgttatagttgatatttccataatgttgaatgcccttagctccccgcggccctggcttcttatatatgtctgtacctgttgccatgactggtgagatagcaaaattcatttgacttactcaaattttattataaaatggggtcacatttttcagtctttcactgacctgatagatactcacctgcagggacagatccaagttttgtgagtcctcacatatataatttgtgtgtgtgcaggggggcttcttaaagaataagattacaaaattatgaatataataattaggtataggcaacgcatggtgggccacacctgtaaccccagcactttgggaggctgaggcgggtggattgcttgaactcacaggtttgagaccagcctgggcaatatggcaaaacccttgtctttactaaaaatacaaaaattagccgggtgtggtggcgcatgcctctaatcccagctactaggaggctgagacatgagacttgcttgaaccctggattgcagtgagccaaaatcgggccaccgcactccaacctgggtgacaaagtgagactctgtctccaaatattataataataacaataataattaggtataggaccttgggagaggcaatgcatgcggggggcctacagctggagctttcttagcttcatggtaaatctgcctccctattccacctacgtatattctaatgaaaaccacctgggtcaggagctgaaatgaatgaggacatctctctgcaaatgtgttttccttcttgttcaatagaggttgctttagggagtaaaaatgcagaatcagtaaaacaaagaaaaatcaaacaaacccaagtgagtgctccaaatgtattccaaataattcattataatactcatttctaagccgtgatgattctacactgcttttagatcattttctccctggtaaaattgagtttgagcagctccagtttgaaatgtgttgtgtctcttttgaaaaaaaggtttgtttttagattttcttctggggccaaggcaccttgaagcagagcagtcaggtgtccagagagctgaaagagccagagcatggacctaacgaaaggaactagtcccagggtgagcaatgggaagtatctaaggagcaaaaattaccaacgaaatgtcttgaggaggctgagttgtgattttaacttggggtgagcttaccaagttcaactctggactaagtcatctgaaggagagttaagtttctttctgcctttgtggttattcaggccttactgctcaatggatccttacctgaagatgaacaggagaggcccttggccctctgtgaaccaggtgtcaatcccgaggaacaactggtgagctccatcttttgtgattggacactaaatctgtatgtattttacttgtatttagcatttgacactgctgttcatgccttcttgaaatgctgtcttccttgaccagttctggttttcctcctacatttttgaccattgtttccttcttcattcatttaataaacaaatatttattgagtgctgactatatgccagaccctatttcaacatgctggagatatggtagtaacaaaacagatctaagacccgacccttatggagtttacattcaaggtctctttgaagcttctcgttttctgcttgtgcctttaatgttggtgttcctcagcattccagtctaggccctcatgtgtcttaaacattaacctgggcggtagtatctgcctccagttcttcactcacttccctcttgcttctcatgtatttatttccagctcagctcttgctatggatttctagatttatgtatgcaatatgcaactgcctacttattatctccacttgtaagtcccataagcatctcaatttcagtgagtcctaaattaaagtgtttctgtcctctgcccaaccaccaaagctacttgtccttttggatatctgttttggataccaaaatgcgccaaacagaaatctgaatgttgtccttgaatcctttccctctacatacttccctgtacatccagtcagtcaccaagttttaccagtttacatttctaatttctttatccagttttctccattctcacagccacttgaaaatcaagcctccatccagtattctaacagccttctcactggttttcctgattcctctcctgtcttcccctaattaagtttttgtaaaacagcaagaataatttgccttaaagacaaacttcattttgtaacccttctgcatacaacttttcattgattccccattgccctcactggcctttcttgatctcgccctgatatttctctccaaattcatctcttgccatttcttcttccctttaccccaccccctcccctgcacccaacccccaccccatacttattctttttttttttttttgagacagagtcttgctctgttgccccaggctggagtgcagtggcacgatcttggctcactgcaacctctgcctcccgggttcaagtgattctcctgcctcagcctcccaagcagctgggattacaggtgtgcaccaccacacctggctaatttttgtgtttttagtagagatgggtttcaccatgttggccaggctggtctctaacacctgacctcaagtgatctgcctgcctcggcctcccaaagtgctgggattacagatgtgagccaccacgcctggcccacccatacttattctaagctttatccatatagatctacttgctacttgatgcatatacttacatcagagagcaggaactgtttcctgttctttgtatccacagtacagagctggcatctagtagtgctcaataaatatttgttgaatgagtggctctgtacttcacagcataggtgcttagccatctctgtttgtcttatattcagattataatccaaagtcgtctggatcagagtatggaggagaatcaggacttaaaggtatgtcaagacatgtacattttaccccttaaaaacattatgggggccaggcacggtggctcgcgcctgtaatcccagcactttgagaggccgaggcgggcagatcacaaggtcaggagatcgagaccatcctggctaacatggtgaaaccccgtctctaccaaaaatacgaaaaattagctggatgtgctggcacacgtctgtagtcccagctactcgggaggctgaggcaggagaattgcttgaacctgggaggaggaggttgcagtgagcagagatcgtgccactacaccccagcctgggcaacaaagtgagactccatctcaaaaaaaaaaaacaccattatgggactattacacaacttcaagagggaaagggatttcagaattggaatctttcctgtatctgtattatgtctttacttgaaagagagagatacatcccaaatatgtcaggaaggtaataactttttaatcctggtggtaggtaatagaatttcggtgtcattattggttgtaccattctatatgtttgaaatatttcatggtttttattctttaattaaaagaaaaaatgtatctaataccagtacagtctttttttataaatacttctcagaattcttttaggtcagtgattcctagcttttcttttggtcataagtctatgagtaaagacattaaccctctccctagaagtatgcatgtatgtttgcactcatactcatagacatgaatttttttttttttttttgagacagagtttggctctgtcacccaggccggagtgcaatggtgcagcctcagctcactgcaacctctgcctcctgggttcaagcgattctcctgcctcagcctcccaagtagctgggactacaggcgcccgccaccatacctggctaatttttgtatttttagtagagatggggtttcactatgttggccaggcttgtcttgaacggctgacttcgtggtccgcctgccttggcctcccaaagtgctgggattacagcgtgagccactgtgcctggccgacatgaatttttaatagagcaacttttatttatttgttttgttttgtttgtttgttttttgagacagagtctcactctgtcacccaggctgagtgccatggcacgatcatggctaactgcagcttcgaccccccagtctcaagcgatcctcccacctcagcctccctagtagctggggcttcaggaacacaccaccatacctggctaatttttgtgttttttgtatagattgctctcgccttgttgcctaggctggtcttgaactcctggacccaagtgattctcccatcttggcctcccaaagtgctgggattataggcatgaaccactgtgcccagcctaatagagcaacttttgagcccatctgtggagtccaagttacagatccccattttagatatgttaattgcaaaatcttgatgtgatacaataggaagagaagagattggggtctgtgttatggttgttccccttctaaaatctatttcctagtgacaatcgtatacatatattttatctattgtaagggaatgttaattactcagtatttcattattaggctaaatgtgtttttgtttggcccacaaagaacaataccctcttggatcagaaacactccaaccctttgctaaacattaaaaatagggataattatttaatgacattgggggtaggcatatttagatatgatcatatattcagtgagaaggatttagattattataattaggttttcctgttggtgaagattgctaaatatagaaatgagagcctatgggaattatggggtatcttctttcttggcaactcttctctacctgagcagttaagcctgggtgccaacagggaagaacggaatggttctcttcttgtttctgtggatcagcctgtactgctcactgaaccagagctgttttctgccttagtagagggttaatttttcacggaatgatcaactgggttttgtcctcttgccgacagaatgaggtaatgcattctgaagcaacccagatgtcaccatctgatctaactatatttggtttgcagaaggaactgctgaaatgtaaacaagaagccagaaacttacaggggataaaggtaaaaaagaagacatttaattctttaaataaagtctctgcaatgtaaagtagtctgttggtgagtggtgagagttggaattttctgtggacctttaatagctctgtgctattggtaaagaaagggctttgtgggagggaagtgagacatgtcgaggaatatacctttgttttgctgaggcttatttctagtagttatgattcatgttgctaccatttccatctgttccaccctgattgtctctatatgtaaaagaatcctcttcagtgtgaaagaatgtcctctagggccgggcgcggtggctcacgcctgtaatcccagcactttgggaggccgaggcaggcggatcacgaggtcaggagttcgagaccagcctggccaacatggtgaaaccccatctctactaaaaatacaaaaaattagtcgggcgtggtggcaggcacctgtaatcccagctacttgggaggctgaggcaggagaatcgcttgaacccaggaggcagaggttgcagtgagctgagatcatgccattgcactccagcctaggtgacagggtgagactccgtctcggaaaaaaaaaaaaaaaaggaatgtcctttaaaaaaattgttatttactttgtttttgaatagttaactaacattcaaatcattttaaaggtataaaaagataaaccatgaagtgtctgcctgccagccctgtcccatcagtcatctagttctctttcctagaggcatcttttttttttttttgaaacggagtctcgctctgttgcccaggctggagtgcagtggcgcaatcttggctcactgcaagctctgcctcctgggttcatgccattctcctgcctcagcctcccaagtagctgggtctacaggtgcccgccaccacgcccggctaattttttgtatttttttagtagagacggggtttcaccgtgttagccaggatggtctccatctcctgaccttgtgatctgcccgccttggcctcccaaagtgctgggattacaggtgtgagccaccgcgcccggcctttttttttttttaatgttgacatggagtctcactctgtcgcccaagctggagtgcagtggcgtgatcttggcttactgcaatctccgcctcctgggttcaagcgattctcctgcctcagcctcccgagtagctgggattacaggtgcgcaccatcacacccagctaatttttgtattttgagtagagactgggttttagcatgttggccaggctggtcttgaactcctgacctcaggtgatccacctgcctcggcctctctaagtgctgggattacaggtgtgagccaccacgcccgacctcctagaggcatcttaacagttatcagcacatttgtgtctacatcgctttcccccacggttttacccaaatggtaatatactagaaataaaacttgacaccttgctttttttcacttagtagtatatcttcgagctcattctatgtcagtagtacataaagactttcctaggtcttttttatggctgcatagtattccattgtattccactgtatacatacatatatatgctaaatgatttattatacatgataatttctagtcttttgctaatataaacaatgatctaacagccttgaatatatggtttttttgtgttgttttgttttttctgagatggagtcttgctctgtcgcccagagctggagtgcaatggtatgatctcagctcactgcaacctccacctcccgagttcaagcaattctcctgactcagcctcccgagtagctaggattacaggcgtgtgccaccatgcccagctaatttttgtgtttttggtagagacggggtttcaccatgttggccaggctggtctcgaactcctgacctcgtgatccgcctgccttggcctccaaaagtgctgggattacaggtgtgagccaccatgccgagcctgaatatatgttatttcacccaaatgggagtatatctgtgcaataatacctagaagtagaagaggatgtttttaagtggctgcttttcccctcttccttgcacatccgttcatgggctagactattcactcagcaacattttccaaggtatattccgtaggcttagtacttttgaaacactttaaaaaacaaatgtgttccacggtcagataagtttgagaaatgctctgctgtcctgaagactcactgtgaataataacatgtaaaggatctgaaaaggtctgtcataaagaggttggcctaaaaatgatttagaattaataaccacagaagtgtcttttctcccatgtaacatcatgtggcacattaatgtcccatggagcacattttgggaaatattcctttgaactactgatgccaagggcatcttagacttcctttaccatgtactgtcatggcagagtgtataattaagaatgggctcccacattcttcagagtctgtaccctttctttgcagtctgtaaagagagaaaagtcaggacaaatatattagaatgcagccctagtccattagttccatttgaagtcaccatggttgatggaatatgtcataactgtccttataagcaaggatatccagctcaccttttgttaggcttgataggaaccaagagggttcaagctgagggaaagaaagcctaatgctattaagatcataggaaattgggaagagggatcatgaatcaaagaacagttatgctcagtggaaatataattctaatcctggtccagactaggcattggaagccattggaagcaggatagcagcaaggctctggaagccagcatgggagtgatttcagggattctttaacaacagagtggcgggcatgaatagggcccatctctccaggaaatggggactgggcagagaggtagaaggaaaaacagctaatctagattgagtatttatatgcccaagatataaatgagaaagcccaggtgggagaaagtagagtgcattgtccaaggctgacatcacaaaagtagtaagtggtaggtttataatttgaatctacgtctatctgatcccaaagtccagtctttctctctcgaatacaccatgctgtcaggattgagggtggggacaaatagtaagcagagaaaaaaaatcaggcttcagtaagtttcatagaacagtggataggattttgctctggatgctagtttcctagagggggacagaaaaacccctcctcagcaactcgtggcaagaccctttaccccatttgtcttccagtctgccataacgaatgctggaaacacattaaaggctttagtaatttgtaataataactggctgattgatgaactgagacaacaataattagtatgctttttcccctaggatgccttgcagcagagattgactcagcaggacacatctgttcttcagctcaaacaagagctactgagggcaaatatggacaaagatgagctgcacaaccagaatgtgagttaaatgaatgagccttgacctcagtgagccccattagcagaacaggctactgcacgaagaactattagactggccatcctaatctcttatcttgcttctgggatgcctgccttaagtgtctgcagttatttttattccccattagactcatctctgttcctaggtgaaagcccacatcatactgggcaggaaggtccttgatctcctcttcaactttgaggacactgagatacagaggcaaaattgtggttctacagtctaattacttcactaaaaatgtggagagcagctgtgtatttttaccatcataccctctctgtgctgcatactgtaactgccaacattaactggttactaagtagctggtttccttgagggttagcaggcagtacctgcgtgccatgaattctttcttattcttgcaggtggatctgcagaggaagctagatgagaggaaccggctcttgggagaatataaagtaagaatgaatatcagtttggaaatgacttccactgacttttcatgaacagcccgttattgttgctcaaaaagcacttaagtattctattttcatcctttttgatttttttttatccttgctttttagaaggaagcatttttctgtgtcccctgatgcactagctctgaagaatagatggcacagctaggagaaggagtacaggactaggggtctagaaacttcagttctagtcttacctttatctctgactagtatgaatggctcatagtggtcctcctacaaatgccagttcccttcttcattactcttgaagaatcctttgcactatgtaagattattatggtgtgtaaagtcttcctggtatatttgaggaaaggactttttttcctgaggctctactttacttgagtggaagttacactgcagagggtgaacttttcagtgtccctggttttgccgctcatcttaaagctctatctttattgcagaaagagctggggcagaaggatcgccttcttcagcagcaccaggccaagttagaagaagcactccggaaactctctgatgtcagttaccaccaggtcagaacatattcagccactgacttccctgcctctttggcccaaagaaatcattttctgatttagtgtctattttgcaggtggatctagagcgagagctagaacacaaagatgtcctcttggctcactgtatgaaaagagaggcagatgaggtaacctagaccccgtgttctccctcccacatttatgaagcaaacggggagattgtgtttctgactcagagctgaaccaaggccacaggcttgtttgttaggaggctctatgatgagctagttaaaagtgcaggttccagaataagaaaatctggtttcacgttccacctttatcactcctacattctgtggccttcagttgcttatcttctgagccttagaaatagggcttatttggaaaatggaaataatagtgattcagtctgtcattatgaagagtatatgagataatccacataaataactaaacacagttctgttggagccacttggcatagagtcaggctcaaaaaatattcaccatggcctggcacagtggctcacatctgtaatcctagcactttgggaggccaaggcaggtggctaacttgaggtcaggagtttgagaccagcctggccaatgtggtgaaacctcgtctctactaaaaattacaaaaattagccaggcgtggtggtggatgcctgtagtcccagctactcaggaggctgaggcaggagaatagcttgaacccggtgggtagaggttgccatgagctgagatcatgccactgcactccagcctgggtgacagatcaaaaaacaaaacaaaacaaaacatacatatatatatatattcatacatacatatatatacactcacacatatatatacatacacacatatacacatatatacatatatatacacacacatatatacatacatatataaccatacatatatatgtatatgtgtgtatatgtatatgtatgtatatatgtatatgtatgtatgtatgtgtatattatgtatgtatatgtatgtatgtatatgtatgtgtatatatatgtatgaatatatatatatgtgtgtgtgtatatatatatattcaccattatttttaaattactgaagcaaagccaggcagtgctggagcagcattctgaggctctccagtgctgtggcagaggctaggttggggcctccaggtggaggttagcatttcctttattcacatccaacaatgcgtactaagtgtcaagtgctgggcatacagcagtgaccaaaaggggaaaaaaaatctatacttaagaaagatacattctaataaagagagccattaaacagacaattatatacttcatcaggaagtgataaatgtaaagaagaaaaataagatagcacatctggtttacaattctccctttaacaagcaacatttcttcatgctgctgtaggcgaccaactacaacagtcacaactctcaaagcaatggttttctccttccaacggcaggaaaaggagctacttcagtcagcaacagaggggtacgtacctggagttttgatggagtcctgccacttctcactgaaaccagaagagtgccaaagccatggccagtggatgaggccttttatattccagttccctaattcctggatctgtggagtgtgtaaagatgtgaggcacttgctatccaaaattaagaattagtgggcaaaccataggcctgcttctgtgggggaaaaatcttctggaaacttctctcctatatccttttaagcccagtggttgggaagtggcaccgtgccatgccagcaacaccttatttttgcccacagaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggtaaccctcttgctgtggtatctctcttaggcaagctcctgagaaagctgggttttaagaattttaattgagatgaaggcagtgtgaagagatacaagaccctgttaaaggttagagttgtttttctctattgttttttctctcagtggaactgactattcatcatggtatgacaatccagagaagaagttcatggtcatacttgctcccagcaactgtagctgtgtaaagattgtggctcttgaccccacagggtctccctttacgcttcttcccctcccacctacccctgattgagcttggccttggatgagaaaatatacggaaaatgcactggaaaccagaaagcctttcatatatattattattgttaggataaatatattagattttatatgttgtggaagagatggtagaaaagtatgtagtattttaagcacacttttatgatttaaatttcttggttaagttctctcattgatcataactcttgtgatttttgtgtggctccccaggttcgggtcaagtcacccagaactcaagtaggtagtgaataccgggagtcctggccccctaactcaagtaagtacccatttttgctcagtagggactcctagcatattagaccagaaatttagtatttttcacactacattttggggatgtaatttttcttgtagtacttcacttttatactattttgtttctgtagcaatactgcaattgagttagttctaagactatgaagacatatgccatcaccacccccagtgccatttagccacgtgcaggcaggatgctgttgactcagagaggctaaaatatctttgaagaacacagaagctcaaaagatttatgctgaaaaagcaaaatataaaacaacaaaaacacatacatacgtaaatttttctacactcccaaacagcacaaaaaaaatttccacttcttccttgaagcaaggcgtttaatttctttggagatattcttaaaactttgagtgctcaggccgggcgcggtggctcacgcctgtaatcccagcactttgggaggctgaggtgggtggatcacctgaggtcaggagttcaagaccagcctggccaacatggtgaaccccatctctattaaaaatacaaaaattagccaggtgtggtggcacacgcctgtaatcccagctactcatgaggctgaggcaagagaatcacttgaacccaggaggtggaggttgtggtgaacccagattgcgccattgcactccagcgtgggtgacagagtaagactccatctcaaaataaaataaaaactttgagtgcttaaggcgtttagtttaagtcctgcaaaatgtttgcaccatctaatggccatggctaggaagtgtattttaacctgctccgtgcccactctatattttttcccatttgttcaaacttgttggaaagctaccctgcctggtaatttctattttagtttgtattttgccttttgtggcttagtaatgttcatgttttcttatcttttaatcaggcctaatcaaaaggtatctaataatttataaaaaccaaatagtaaaaagctgactagaaacagttttgtatgttacatataaatttttaaaagcacattaagaaacctaaagtaaaaatctgaaaatacttgcaaaaatatgaaatgtaaaatttttttgtggagtaaataaaatagcatttcaaacctctgatcccagatatcttttcctcttggatgaggttatctatgctgggaatgaaacaaattttttttttttagcggcgggggatggagtttcactcttgttgcccaggctggagtgcagtggcgcaatctctgttcactgcaacctctgtctcccgggttcaagcaattcttctgcctcaggctccccagtagctgggattacagacgtgcactaccacgcctggctaatttttgtatttttagtagagatggggtttcgccatgttggcaatgaattattttattaccagaattagtttcagtttccttttctagcagtgtttcaaaatagtcatttctattgtttgtagaggattattattattattttattcattgatttcttcagattagtgtaaactgccaatataaataggtgtaaatacttagaaatttcttttttaagtacaataaattcccccccaaaaaattactttgtgcatatatagtatttatttaaagtactacaaataaatctatagctgcttgaaaactaagatgttaatctaatgcttccagtgataactgtattcacaaataagctgaaatatctcttatctgaaaatacaaaaatctgtgtaacttctgccagctctctagctactgacttatttctcttactcctgtacatcaaaattcttaaaagaagagtctatatttgctctcttttcttcctcacttcctgttcactactcagcccactacagtcttttatctgttactttgcttagtgttcttcttgttgggtctctgttgactttcttgtcgcctaatcaagtggttactttttaaaccttatctttcattgtcttttcaaaagcatttactattctctaaaagtctcctggaaactttcttcttcttcagtttcagtgtcattcagatattcatttaacatatttactaagcatccattattcaccatcaatgttagatgctggagatatagagatgaagaggttagacttggcacttgcaggtagtgaagtaaatacctgagttttccttctagtccctcttgaatctccttttattctgctctaattcttgaatgttgatgtgtcctgggattccatccaattgaagcctaaacctaagccttttcatattgtctttggcgtcaggtgacctcttccactcccctggctttaactacacttgtgtgccgataatttttatgttttatctcaaatctcagttattttctgagcttcagtactattttttatttttatttttatttactttgagacagagtctcgctctgttgcccaggctggagtgcaatggcgtgatctcgactcactgcaagctctgcctccagggttcaagtgattctcctgcctcagcctcctgattacaggcgcccgccaccacgcccggctaattttttgtattttagtagagacagggtttcactgtgttgcccaggctggtcttgaactcttgagctcaggcaatccacccaccccggcctcccaaagtgctgggattacaggcgtgagccaccgcgcctggcctagtactatatttttaaatgtaaactagatatctctctctgtaggtcccaaggcactgtaaagtcatgtccaaaactggacacaaaacaatagagagggaaaaatacagaatatacaatcaaacagatctagggtacaatttgggctgcaccattcagcacagtgtgtgaccatgggcaagaatgttaatgtcactgaatcttagtttccttttttatggaaccaaagtaatattgaagaatttgagcattaaatgaaatacatagaaatcatctagtgtactgtggagcatatgagagatgcaaggcaaatgtttctcattcccctctggctgtgccctttctctttcaatataattaaatttcctgaaagagtattgtactttctgaacccacttcctttcttgccatttactcttaagggaaaacaataattatttcagatttaaaataaaacagtagattagtgaaatcaaattgagagttcagataaaaacccatataaccagagaatgttcttttcaaccaatggtgcttgggacaactggatatttccatgaaatgggaccccctacttcacaccatatacaaaagttaactcagactatagatcagtgacttaaatgtaagagcttaaagctataaagttcttagaagaaaacatagagaaaaatattcatgaccttggatttggcagtggattcttaggacatcaaaagcatgagcaacaaaagaaaaaagataaaattgggctgggcgcagtgccttatgcctgtaatcccagcactttgggaggctgatgtgggtgtatcacctgaggttgggagtttgagaccagcctggccaacatggtgaaaccctgtctctgctaaaaatacaaaaattaggtgggcgtgatagtgggcacctgtaatcccagctacttgggaggctgaggcaggagaatcacttgaaaccgggaggcagaagttgcggtgagctgctccagcctgggtgatagagtgaaactccatctcaaaaaaataaataggccaggttcacgcctgtaatcccagcactttgggaggctgaagcaggcggatcacctgaggtcaggagttcgaaaccagcctggccaacctggcgaaaccctgtctctactaaaaatacaaaaattagctgggggtggtggcaggagtctgtaatcccagctactcgggggctgaggcacaagaatcacttgaacctgggaggtggaggttgcagctagctgagattgcgccactgcactccagcctaggctacagagggagacttcgtctcaaaaataataataataaaataaaataaataaatagataaaagataaaattggacttcatcaaaattaaaaacttttgtgtataaaagaacactatcgagaaagtaagtagacaacctacagaataggagaaaatatttgcaaatcatattgtctgataagggtctaggatccagaatatataaagaactcttacaactcaacagcaaaaggacaaacaacccaagagaaaataggcaaaatacttgaatagacatttctccaaagaagataaagaaatggccagccaggtgcggtggctcacacttgtaatcttagtactttgggaggctgaggtgggcagatcatgaggtcaggagatcgagaccaccctggccaatgtggtgaaaccccgtctctactagaaatacaaaaattagctgggcgtggtggtacgcacctgtagtcccagctactcggggggctgaggcagaagaatcacttgaatctgggaggcggaggttgcagtgagctgagattgtgccattgcactccagcctggcaccagggcaagattctgtctaaaaaaaaaaaaaagggccaataaacccaagaaaagatgcccaaaatcattagtcattaggggaatgcaaatcaaaaccacagtgagataccactttacacctactaaatggtgtcaaaaatggagaataataagtattggtgagaatgtggagaagttggaactgtcatacattgctctggggatgtgaatggtgcagctgctgtggaagacagtttggcacttcctcaaaaagttaaacatggagttaccatatgacccaaaagaattgaaaacaggagttcaaaaaaacttgtacatctatgttcctagcagccatattcacaatattcgaaaggtagaaacaccccagatgtccatcaactgatgaatggatagacaaattctggtatatgcatacagtggaatattattcacctataaagaggaatgaagcactgatccatgctacaacgtggatgaacttggaaaacattatgctaagtggaagatgccagacacaaaagggcacatattgtgtaagtccatttatataaaatgtccagaataggcaaatccatagagaccaaaagtagagtgggttagccagatgccagggtcaggagcgagggaggaatagggaataaccactcagtgcatacaggttttcttttgggatgatgacagtgttctggaactggataatggtggttgtttgcacatcattttaaatgtactaaatgccattgaattgcacaccttaaaatggttaaaatggtgaattttactacaatttttaaaaagtgagattttgtaaaaaatagcagttctgccttctgcctaggatgtagaaagccagaaagagccttgcttctacccaaaaaacaagaaaaagttggataatctaaaaaatcgtaactttcttgaacccatcagagagatgaaatcatagtgcagtcaactagcctgaaaaagaaacaggcacctacaaggagagataggatacaagtactggctcacttgtggtagaccctgggaggaagatggggccactatacaacagataagaattcagctgagatttttttttttttttttttgagacggagtcttggttttgttgcccaggctggagtgcaatgacacgatctcagctcactgcagcctctgcctcccaggttcaagcaattctcctgcctcagcctcccaagtagctgggattatacatgcccaccaccacacctggctaatttttgtatttttggtagagacgggttttcaccatgttggccagactggtctcgaactcctgaccttaggtgatctgcccgcctcggcctcccaaagtgttgggattacaggggtgagccactgcgcctggcttgagatttttaattatttgctaaaggctgagaagacagtataggaaccttgggagccacagacacgaggaatttgcacccacttgcagacactttttcatgactaccaggtgcttatgaaaatgttggttgtgacagtgagatatcatcttaccccagttaaaatgccttttatcagaaagacatttgacacagcaggcatgtgaaaaaaaaaaaaaggatgctagcaaggatgcagagaaaggggaatgcttattatgcaccattggtgggcatgtaaatgagtatagttaaatagaaaacaatgtggacattcctcaaaaaaatacaaatagagctaccatgtgatccagcaattccactgctgggtatgtatccaaaagaaaggaaatcagtatatcaaagaggtatctgcattctcatgtttattgcagtactatttccaatagccaaggctggtcacagtggctcgtgcctgtaatcccagcactttgggaggctgaggcaggaagatcgcttgagctcaggagttcgagatcagcctgggcaacagagcaagaccttgtctctactaaaaataaaattaggtggacatggtggcacacacttgtagtcccagctattcagggggctgcggtggaaggacagctttagcctgggagataaaggctgtggtgagctgtgattgtgccactgcattccagagtgagatcctgtctcaaaaacaaaacaaaacaccaaataaacaaaaacacaatagccaagatatggaattcatcgaagtgtccatcaacagatgagtgggtatagaaaaaaatatatatatgcaaaggaatattattattcagctataacgaagcataaaatcctttcttttgcagcaacatggatggagctggatattattatgtgaagtgaaataagccaggcacagaaagacaagtaccacatgttctctaccagtatgtgggagctaaaaaaaatgttatctcatggagatagagagttgattggtggtaaccagaggctgggaaggcttggggagggtgacagagaggttggttaatggatacaaaaatacagttagatagaaggagtaagatctagtgtttgataagaagtagggtgactatagtagaatttattgtatagtttgaaatagctaggctgggcgtggtggctcatgcctgtaatcccagcactttgggaggctgaggtgggcaaaaccttgtctctactaaaaatacaaaaattagcgggcgggtggcaagtacctgtaatcccagccacttgaggcacaagaatagcttgaacccaggaggcagaggttgcagtgagctgagatcgcaccactgcactccagcctgggagacagagtgagactgtctcaaaaaggaaaaacaaaaaaataaaatagctagaagaattgggatgttttaacgtaaagaaaagataaatgtaggacaggcgcagtggctcacgtctgaaatcccagcatgttgggaggccaaggcaggtggatcacctgaggttaggggttcaagaccagcctgaccaacatggagaaaccctgtctctactaaaagtacaaaaattagccaggcgtggtggtgcatgcctgtaatccagctactcgggaggctgaggcaggagaatcgcttgaacccgggaggtggaggttgcggtgagccgagatcatgccattgcactccagcctgggaaacaagagtgaagctctgtctcaaaaaaaaaggagaaaagataaatgtttgaggtgatggatatcccagttactctgacttgatcattacacattgtatgcacgtatcaaaataacacgagccaggcatggtgggcttatgcctgtaatctcaactacttgggaggctgatgtgggagtattacttgtgtccagggatttgagaccagcctgggcaacataaaaaaaccccatcttaaaaaaaaaaaaattatatatatatatatatatatatgtatgtatatatatgtgtatatatatgtgtgtgtatatgtgtatatatatgtgtgtgtatatgtgtatatatatatgtgtgtgtatatatatatatcacatgtaacctaaaaatacgtagaactgatatgtatcaatttaaaaattaataaaatatgcttttggttaaaaaaaggttggctgtggggatagagtctaaagaaaccctccctccctccttcatggagcaagggagcagctgccactgcaggaaaggcatgaagccacatccagaccattctcgcttacggagcaaagccttaagccactgtggaagcgaagtaaatcctgttgacccctccgtccctgctctaggcaaaggtgaagacccattacagctagtggggatggaaaggaaaaggaacactaccttggcagaggggcaggaaactatcttggactcagattgtaagaggtcgcctaccactgggggagggacaggatcactgagaaaaccccacttaaaaactggggctgcgtcaggacaacagagaagcactgctcatcccccaccaccaggggagcaagcactgttcaattaggagcagtggactgcttctgaggcaggaaacagcatacagagactgactgaggcacaggcatatgaggaaagcctacagctgagggaggggaaggaacattgaggaacgaccctccaacaagcagctgtccctaaacctaactctagaagacttggaaaatggtggtgcactgaaggtaaccttaacaaaaatctcaatcccagctcagcttctgaccaaattaactcaactgtccctaccgatggcctggaagaacaaacagtgtgcccatttctaaacagatacttttacctctgtctctcctgtcttaacatatgtctggcattcaataagaaattatgaggcatccacaagagcaagagaaaaacgaagccactgtgaagagcgaaagcagtcaacagaatcaaactcatatatgacaaggatgtcgaaaccatcagacaaggaatttaaagtaactgattcatatgttaaaggctgtagtgaaaatgttgataacatgcacatacaggtgaggaagactcaactactgtttataggaaacccactataaatataatgatataaatggatttaaaagtaaaaagatggataaagatataccatggaaacactaatcaaaaggaagtgtggttatattagtatctgataaagtatacttgagaacaaggaatcattccaggtataaagatgatacataataataaaaaggtcaattcaccgagaagacataataatcctaaatgtgtgtatacccaataacagctttgaaatacctgaagcagcccaggcactgtggctcatgcctgtaatcccagcattttgggaggctgagacaggaggatcacttgtgcccagaagtttgagacaagcctgggcaacatggtgagaccctgactcaacaaaaaaataaaaaaaattagccaggtgtggtggcatatgcctgaagtcctagctacttgggaggctgaggcaggaggatcacttgagtctgggagttggaggctgcagtgagctgtgatcacaccactgcactccagtctgggcagctgggtgacagacagagtgagacactgtcctctcccgtccccccctcaaaaaatacatgaaacaaaaactgaaaggagaaatagataaatctagttacaattggaggctttaatatttcttctttgcagtaatcagtagaagtagtgtacagaacatcaataagaatatagaaaacctgggccgggtgtggtggcttatgactataatcccagcactttgggaggccaaggcgggcagattacttgaggtcaggaggacagtgggtgtagcccacggagggtgaaccaaagcagggcagggcgtcgcctcacccaggaagcgcaaggcgttgggagatttccctttcctagacaaaggaagccctgacagactgtacctggaaaaaacggaacactcctcccccaaatactgcgcgttttcaacagtcttagcaaatgcagaccaggagctactatccagtgcctggctcggtggttcccacacccacagagccttgctcacagctagtgcagcagtcagagattgaactgcgaggcaacagcctggcagggggaggggcacctgccattgctgaggcttgagtaggtaaacaaagctgcctggaagctcaaactgggcggagcccaccacagctcagctaggcctgctgattctgtagcccccacctctgggagcagggcatagctgaacaaaaggcagcagaaacttctgcatacttaaacgtccctgtctgacagctctgaagagagcagtggttctaccagcatggcgtttgagctctgagaacggacagactgcctcctcaagtgggtccctgacccctgtgtagcctaactgggagacacctcccagtaggggatgacttacatctcatacaggcaagtgcccctctgggacaaagcttacagaggaaggatcaggcaatatttgctgttctgcaatatttgctgttctgcagcctccactggtgatacccaggcaaacagggtctggagtggacctccagcaaactccaacagacctgcagctgagggacctgactgttagaaggaaaactaacgaacagaaaggaatagcatcagcatccacaaaaaggacatccacaccaaaacctcatctctaggtcaccaacatcaaagaccaaaggtagataaaaccacaaagatggggagaaaccagagcagaaaagctgaagattctaaaaacgagagtacctcttctcctccaaaggatcgcagctcctcaccagcaagggaacaaagttggacggagaatgactttgatgagttgacagaagtcggcttcagaaggtcggtaataaacttctccgagctagaggaggatgtttgaacccattgcaaggaagctagaaaccttgaaaaaagattagatgaatggctaactagaataaacagtgtagagaagaccttaaatgacctgatggagctgaaaaccatggcatgagaactttgtgatgcacgcacaagcttcaatagccaatgcgatcaagtggaagaaagggtatcagtgattgaagatcaaattaatgaaataaagtgagaagagaagtttagagagaaaagagtaaaaagcaacgaacaaagcctccaagaaacatgggactatgtgaaaagaccaaatctacgtttgattggtgtacctgaaagtgacagggagaatggaaccaagttggaaaacactgttcaggatattatccaggaatacttacccaatctagcaaggcaggccaacatccaaatctaggaaatacagagaacaccacaaagatactcctcaagaagagcaaccccaagacacataattatcagattcaccaaggtggaaatgaaggaaaaaatgttaagggcagccagagagaaaggtcaggttacccacaaagggaaacccatcagactaacagcggatctctcgacagaaactctacaagccagaagagagtgggggccaatattcaacattcttaaagaaaagagttttcaacgcaaaatttcatatccagccaaactaagcttcataagtgaaggagaaataaaatccttaacagacaagcaaatgctaagagattctgtcaccaccaggactgccttacaagagctcctgaaggaagcactaaacatggaaaggaacaaccggtaccagccactgcaaaaacatgccaaattgtcaagaccatcgatgctatgatgaaacttgcatcaattaatgggcaaaataagcagctaacatcataatgacaggatcaaattcacacataacaatattaaccttaaatgtaaatgggctaaatgccccaatgaaaagtgacagactggcaaattggatagagtcaaacccatcggtgtgctgtactcaggagacccatatcacgtgcagagacacacataggctcaaataaagggatggagcaagatctaccaagcaaatgcaaagcaaaaaaaaaaaaaaaagaaaagcagggattgaaatcctactctctgataaaacagactttaaaccaacaaagatcaaaagagacaaggccattacataatggtaaagggatcaattcaacaagaagagctaactatcctaaatttatatgcacccaatacaggagcaccaagattcataaaccaagtccttagagacctacaaagagacttagactcccacacaataataatgggagacttttacaccccactgtcaatattagatcaacgagacagattaacaaggatatccatgacttgaactcagctctgcaccaagcagacctaatagacatctacagaactctccaccccaaatcaacagaatatacattcttcttagcaccacatcacacttattctaaaattgatcatacagttggaagtaaagcactcttcagcaaatgtaaaaaacagaaatcacaacaaactgtctctcagaccacagcacaatcaaattagaactcaggattaagaaactcactcaaaactgcacaactacatggaaactgaacaacctgctcctgaatgactactggctaaataacgaaatgaagggagaaataaagatgttctttgaaaccaatgagaacaaagacacaacgtaccagaatacctgagacacatttaaagcagtgtgtagagggaaatttttagcactaaatgcccacaggagaaagcaggaaagatctaaaatcgacaccttaacatcacaattaaaagaaatcgagaatcaagagcaaagaaattcaaacgctagcaaaaggcaagaaataactaagattggagcagaactgaaggagatagagacacaagaaacctttaaaaaaatcaatgaatccaggagctggttttttgaagggatcaacaaaactgatagaccgctagcaagactaataaagaagaaaagagagaggcatcaaattgacacaataaaaaatgataaaggggatattaccaccgatcccacagaaatacaaactaccatcagagaatactataaacacctctacgcaaataaactagaaaatctagaagaaatggataaattcctggacacatacaccctcccaagactaaaccaggaagaagttgaatctctgaatagaccaataacaggttctgaaattgaggcaataattaatagcctaccaaccaaaaaaagtccaggaccagatggatttacagccaaattctaccacaggtagaaaagaggagctagtaccattccttctgaaactattccaatcaacagaaaaggagggactcctccctaactcattttatgaggccaacatcatcctgataccaaaacctggcagagacataacaaaaaaaagagaattttagaccaatatccctgatgaacatcaatgcgaaaatcttcaataaaatactggcaaaccgaatccagcagcacatcaaaaagcttatccaccacaatcaagtcagcttcatccctgggatgcaaggctggttcaacatactcaaatcaataaatgtaatccatcacataaacagaaccaaagagaaaaaccacatgattatctcaatagatgcagaaaaggccttcaacaaaattcaacagcccttcatgctaaaatctctcaataaactgggtattgatggaacgtatctcaaaataataagagctatttacaacaaacccacagccaatatcatattgaatgggcaaaaactggaagcatttcttttgaaaactggcacaagacagggatgccctctctcaccactcctattcaacatagtgttggaagttctggccagggcaatcaggcaagagaaagaaataaagggtattcaatttggaaaagaggaagtaaaattgtctatgtttgcagatgacatgactatatatttagaaaaccccatcatctcagcccaaaatctcaagctgataagcaacttcagcaaagtctcaggatacaaagtcaatgtgcaaaaatcacaagcattcctgtacaccaataacagacaaacagccaaatcatgagtgaactcccaatcacaattgctacgaagagaataaaatacctaggaatccaacttacaagggatgtgaaggacctcttcatggagaactacaaaccactgcccagggaaataaaagaggacacaaacaaatggaagaacattccatgctcatggataggaagaataaatatcatgaaaatggccacactgcccaaggtaatttatagattcaatgccattcccatcaagctaccaatgtcttcttcacagaattggaaaaaactactttaaagttcatatggaaccaaaaaagagcccacattgccaaggcaatcctaagcaaaggaacaaaactggaggcatcatgctacctgacttcaaactatcctacaaggctacagtaaccaaaacagcatggtactggtactaaaacagatatatagaccaatgaatcagaacagaggcctcagaaataacaccacacatttacaaccatctgatctttgacaaacctgacaaaaacaagaaatggggaaaggattccctgtttaataaatggtgctgggaaaactggctagccatatgtagaaagttgaaactggatcccttccttacaccttatacaaaaattaattcaagatggattaaagacttaaacgttagacctaaaaccataaaaaccctagaagaaaaccgaggcaataccattcaggacataggcatggacaaggacttcatgactaaaacaccaaaagcaatgacaacaaaagccaaaatagacaagtgggatctaattaaactaaagagcttctgcacagcaaaagaaactatcatcagagtgaacaggcaacctacagaatgggagaaaatttttgcaatctgcccatctgacaaagggctaatatctagagtctacaaagaacttaaacaaatttacaagaaaaaaatcaaacaaccccatcaaaaagtgggcaaaggatatgaatagacacttctcaaaagaagacatttctgcagccaacagacacatgaaaaaatgctcatcatcactggtcatcagagaaatgcaaatcagaaccacaatgagataccatctcacaccagttagagtggcgatcattaaaaagtcaggaaaccacagatgctggagaggatgtggagaaataggaatgcttttacactgttgatggaagtgtaaattagttcaaccattgtggaagacagtgtggcgattcctcaaggatctagactagaaataccatttgacccagagatcctattactggatatatacccaaaggattataaatcatgctactataaagacacatgcacacgcatgtttattgcagcactattcacaattgcaaagacttggaaccaacccaaatgtccatcaatgatagactggattaagaaaatgtggcacatatacaccatggaatactatgcagccataaaaaaggatgagttcatgtcctttgcagggacatggatgaaactggagttcatcattctcagcaaactatcacaaggaccaaaaaccaaacaccgcatgtcctcactcataggtgggaattgaacaatgagaacacatggacacagggcggggaacatcacacactggagcctgtcgtggagggggggacggggggagggatagcattaggagaaatacctaatgtaaatgacaagttgatgggtgcagcaaacccacatggcacatgtatacctatgtaacaaacctgcacgttgtgcacatgcaccctagaacttaaagtatagtaaaaaaggaaaaaggaaaagaaaaaccctcatgaaaatcttaggtataaacttcataaaatatgtgcaatgactatactgacaagtataaaataaggatgaaataaagatttaaataaacggagagatatactgtttatggattggagtactcaacattgttaagatggcctattcttccacaaatgatctatagcttcaatgcagttccagtgaaaatcctaccaggcttttgtagatataaacaagccaattctaaaatttataggaaagaataaggggactagaattaactgccctcccaacccaaatggtgaaaaagatgaacagtgcagttggtggaccatactgtctgatatcaaaattaactgtaaagttagggtaatcaagacagtgtagtattggtgaattggtagatacatagatgagtggaacagcatagagttaaaaatagacacattttaccagttgattttctacaatagtgcaaagacaattgaatgataaagggataggcttttcaaaaacggtgctagaaaagttaaagatctatttttttaagtgagtttgacctatacttcataccatatgcaaaaatcaactccaaatggataagcctaaacttataagctataactattaatcacctgttttgtggtacttttcaaaatcatgtattaaatttgtagatatacacaaggatatgtttctgagccacttatcctgcatgagtttttttgtacgtgttttttatagtaatgccataatactgtaataactatcattttgtcatacggctttatgttgggtgagacaagttctccctcattactcttattttgcttttttacttgaaaagtctatgcaatccaactcattcttcattagtcatctgaatcgacttttcactagtatcatcaatgatatttttaccaaagcagtctttgcctattagacccctgtgtagcatttgacatcatgattactctctctttgacattctccccaaatgtgtacataacatttgtattagtcagcttgggctgccattgcaaaataccttcaactctcttaaacgacgtaaattaattttctcacagttctggaggctagaagtacaagatcaggttgccagcatggccaggttttggtgagggctccttgcctggcttgtagaaggcacgttgtctctgtgtcctcacatgggggagagaaagctctggtatctcttataaggactagttctgttggatcagggctccacccgtatgacctcatttaatcttaattacctccttaaaggccctatctccaaaacagtcaaatagcagataagggcttcaacatatgaagttgacgggtcggggggtgggggtggggtggggggggggaacaaattcagtccatagcaatattattttcatatttattttattgtatggtaactgttttgctatttcactccactagacttttgagctccttaagggtggggattatatctaatttatttgtgtatctctaatacttgatacataataaggcaccctataaacatttaaaatgaataatgagatgacgtaattcatcttgtgttcccctgtcttaggtaatggtattaccatgtatctgtcttcccaggttgtaaatctcagtcattgtttacttttcccttttatataccctatgttcaactatatccctagtactaagactttgactttctaaaggtctttcaaattcatcccttctctggctccagggctacatctttcctatcatcatgtgtcagattgtttttattgcctcttaacaggatgtcttagtcagttgagtgttgccataaaggaatacctgaggctaggtaacttaggaggaaaagaggtttgtttggctcacaattcggctggctggaaagttgggcatctggtgaaagcctcaatcggctttcactcacggcagaaggcaaatgggagttggcatgtgctgagattacatggagagaggaagcaagagagtggagggaggtgccaggctctttttaacaagcagttttgtgggaactaatgggtgagtactcactcctcctccccaaggagggcattaatctagtcttgaggaatctgcctccatgacccaaacacttcccattaggccccacctccaacattggggatcaactttcaacatgaggtgttgggggacaaacacccaaactactgcacaggatttctggcttccagtttgtcccatccaatccatactttgctgcgagatcaacttttctaaaatgccagtctaatcatatcactaccttttagtaactttccatagcttaagactaacatcttgaactcttaccctgtcagagtcttttgtgatctggctgctgcctacttaattacctcacaacttcccaatgtattcattatgctccagccttactaattcacctacagttttgtaaatatatgatcccatttcatgcttctgcacctgtccttccctcttcttggaatactcttttcaactttagtatctcgtgatttttaaaaggtgcttttaaaaaggactctccaaccatgggcccttcctgacctgttccaggtggaattaacctcgccatcttcagtcttccaatacagcttgtagaaatctgattttagtgtattgtaattatttgtaattgtatccatcatccatactaaatgataaactcttgggaggttggagaccacatatagtttatttttatattctcaaatcgaacacacagtaggtaataaatgtttgttgaatgaatgaataaattaaatatatagctttaatgttaaaagtgagtattttatttattcaacaaccactgtgtgctgggcactgtgctagatgctggggcaaaggagaattatggcatgtaggttacaataattggcattctttttttttttttggagacagagtttcactttgtcaccaaggctggagtgcagtggctcgatctcggctcactgcaacctctgcctcccaggttcaagcgattctcctgcctcagcctcccaggtagctgggactacaggcacatgccaccacgcctggctaattttctgtattttagtagagacggggtttcaccatgttgcccaggctggtctcaaactcctgagctcaggcaatccgcccacctcggcctcccaaagtgctaggattacaggcatgagccaccgcgcctggccaattagcattctttgaagaaaaactctgaaaacagactgaatgccatttgtgttcaaagaggggacgttcctttgtctttttcccctctattaattcatccttcatattccttattttaaaccccctcccagaactactgttctgtggctgccaatatgaatgcctagaataagttaagaggaagatcagtacaggtggaatagcaggagatattttagtaacagtttaattattaatttttgataaaaggttctgattggtcatttctcctacgaaagtcataattacaaggacttatacttttccaaaagtacctttttaaaaggtagagacagtccaggtgcagtggcccatgcctgtaatcccaacagtttgagaggccaaggtgggtggattacttgaggcagggagttcaagaccagcctggccaacatggcaaaaccttgtctctactaaaaatacaaaaattagctgggcgtggtggcacacacctgttatcccagctactcgggaggctgaggcacgagaatgacttaaacctgggaggtggaggttgcagtgagctgagattgcaccactgcactccagcctgggcgacagagcgagaccctgtctttttttttttttttttttttttgcggcagggacagagtctcactctgtcacccaggctggagtgcagtgtcacgatctcggctcactgcaacctccacctcccgggttcaagcagttctttgcctcagcctccccaagtaactgggattacaggcatgtgccaccacgcccagctaatttttgtatttttagtagagatggggtttcaccatgttggccaggctgttcttgaactcctgacctcgtgatccacccccctcggcctcccaaagtgttgggaaatacaggcgtgagccaccgcgcccggcgagaccctgtcttaaaaaaaaaaaaaagtttatcaacaaacctgtgttaaagaccatggcatcaacactatagatcttaagttgctaaggttctgtaccttttagactgggagcataagccccttgggatctgagtttctaaggttgctttgcttctgtggttcttgttcctatcggtttttctttctatgagtcacatgagtattctctactacggacctccaaaacctaaatattggcagagtctacagcttctgctgtgtgtctaccctgcctggctgaaatcttcccatgcttctctgtccttttttgatctttaacaatgatacctgtcatatcagttgctgttcccctactatgagtgaggagtgatgagtcctcgcgatcgtgtccatgtctgaagcaagtcttgtcctcgtggtcctaggcaaccatagcatatggacattgtgtttggcaagggtgtgagagctgtgggctgtgacctcaggcagctttgttctcccgggacactttgaataactgcagatggctggtttagagcaaatgaatgttctaaccacagtctctttctgattgtagagttgcctcactcacagagctctccaactgtcagcagcacctgtactaaagtgctctatttcactgaccggtcacttacgcccttcatggtcaatataccaaagaggtgagattctgggatcattgtatttcactgtaaagaaggaaaggaaggcagaacctcattagttactgcccacatgagcagctgaaaggtgtttgagaagcagtatagtgagatctcactatagtgagataagccagagagacagattctagtttcagctttgccactattcagtggtattataaaggacaagtcatgatctactactagatacaggtacaataatagtacttccaatcctgataactatgcaaatatggctctgcatttgggaaaatctttttttttttttttaagtgttcaaaatagctcctgctgatacaatggattgcagcctggcactcactccaggactatgactaattgatctttgttactattcaatgactgcagctaatccctattgagaaattatgtcaaaaaccttccagaaagttaatgtgcttccttttaagggaaatggttttgaaatagaaatatttaaactctgcaaccaactattgagagaggttataggatttttcttacttagtctgcttatttagtctgggttagaagccagcttcctaaagatagagggataaagatcatgatacttgatttgattctaccatcctagagaattgggatattgtagcaaagaagaaaatcaagagaactttgatatatttatggttattcaacaaattttatttcagggactttatatcttatttccagagaaaagtgatttggcttctgaagcaataagtcaattttaaattctcacatcaccccatatttaatactgttttcattccctagtgatgactggttctccagcctctgctgttttagtcatctgggttatcggggcagtgacctaacaaggggctatttctgcttattgactttggcagggggctgtgtttaaagttaacatcttatctttccagctattgatcaacagtctattttagtgctctctccttgtgttgcaggttggaggaggtgacgttaaaggattttaaagcagctattgatcgggaaggaaatcaccggtatcacttcaaagcactggatcctgagtttggcactgtcaaagaggaggtaaagaatctgtggggagtctgtatggtattattggtcctttctgaaccctgaagcctcctgttcaagcactagtgtccagaagtacatgagttccctgactaggtcagaagaatttgccagagcctcagaccatggtctgattactctagacaagtggtcatagaatagtccaagatgctgataggttctttagttgtaggacttcatcatttgactgagaacttggatataatttttattttaaattattttgttagggaaaataaagaacctaagacaataaataattttccatctgcagccaaatcttagaaaacttcttgcttcctatgtagagcaaaataaacacgcatggatatatggaactgtgtatttctcataatgaaatcaaggaacttctagggagttatgtatgcttatgcccaactccttgagtaagtattttcttagcctacgcgtctctttataatccatttgtcaaagatagacttttgggggaatacagttctgggttatatagtattacaagtggattcactgcagttacagaatgaaaaaagttattatagagaaagtaaaattttattttgtaaacatttcctcagtgaaatgttttagtaaccctgttttattagtggcttaggaaatgagttgaatgaattaatgaaaataactgcatctgagaaatgtgttaaaatgagtcttttttccccaccctttctttacattgcctggtaactaaattttccactttctcatttttaaaatacttaacactacatctttcctctaagaagcccaaagtactttgtgattggtaatttattaattcttacaaatctctatgagcaaagtagtatcaggcattttttaaaaccatttcatagatgtggatctaagaaaaaaataaaatatcagttgcagttctagggacaagaccaaaaggacatagactcttaactcaaggctttcttctacatggttgaggtcttatttttattagcagcaattgtttagtgaatcagattccctgttttttcactgtggctttttgtttttttctctagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctcc

SEQ ID NO: 38035 - DNA, 86205 bp, Homo sapiens; identical to SEQ ID NO: 36965

SEQ ID NO: 38036 - DNA, 58869 bp, Homo sapiens; identical to SEQ ID NO: 37750

SEQ ID NO: 38037 - DNA, 44909 bp, Homo sapiens; identical to SEQ ID NO: 37675

SEQ ID NO: 38038 - DNA, 26033 bp, Homo sapiens; identical to SEQ ID NO: 35695

SEQ ID NO: 38039 - DNA, 22618 bp, Homo sapiens
gggcgtcagcgagccgtgagatgcgtggtccaccatcggtgacctcaccgcctcggttcgccctcagccgccccggtgagctgcgctcctgcgggtccctctctgcagcgcgcccttccggcgcaggaagaagggccgggaaggcctgggacgtgagggcgctgctggggccgtagcgcgcgctcctccaggcccggcgtctccgcgttctggggaggggcggagacccaggccgcgccttgaagtgggcggtggggctgcggcttgccgagcgccccgggtctgggccgccactcagtctccgttcccggttgcgtgtagtggcggctcgggcggtgaacagcccggatttcacaggggcgccgagcaacccaggtcctcttgtgccagggtcgccgctcctcgggtggggacgggccagcggcctagcgagctgccacgggggtcttttggccggaggtggagggggactcggccacagccagggtccactggtggggtgggggttacagccatgagacggatgggctaggtccgactcgggttccctccgactctgatgctccagactttattgtgggaggcgggacaggggaggacttcgcccgcgtgttttggggaagggccgctgctttgggttgggagcaccccgccttgggacgatcttccgcggataggagtgtaggccgggaccaaatgtcctcgcacgggcacgtctagacgtgttttggtggggggggggggggatctgcgtggggcagcgtccgcgggaggtgaggtggctgtggggacccaggtggcctcttccctggggccttgctaatgacggcaaaatccgggttctgccaaaatatatttaaaaaggtttattcctagtcagtatgagtgactgtggcccaggttattcagcctcaagaggtcctgtgaaagtgcccgagatggtcaggcttgcaggttaattttatacaattcagggagacaggaatttcaggtaaagtcataaatcaggctgagcagtgtggctcatgcctgtagtcccagcactttgggaggccaggagttccagagcagcctgggcagcacagcaagaccctgtctctacatgaaattagaaaaataaaaaaattagcggggcgtggtgtcccatgcctgtggcctcagctacttgggaggcccagtcagttgagtccaggaggtggaggctgtaaccagctatgttggctgcactgcacgctagcctgggtaacacagcgagatcctgcctccaaaaagaaaatcataaatcaataagagaaagatatacacgggttcctcccaaaaagctggtatatctccaaagggtttacacctcatgggggcacttagggattctttagtggacagttggttgagagacttaagctactgcctgaagactggaatcagaagcatgccagagttaaggggattgcgtagatcaaagttcttattatgtagatgaagcctcttagttggcaactctcagaatagatggtaaatgtctgttttcagttttttgggtttttgtgtttttgtttttgtttttagagagagtcttgctctgtcgcccaggctagagtgcagtggcgtgatctcagctcactgcaacctccacctcccaggtttgagcagttctcctgcctcagcctcctgagtagctgggactacaggcgcccgccaccacgcctggctaatttttgtatttttagtagagatggggtttcaccatgttgctgaggctggtcttgacttcctgacctcaggtgatccacccacctctacctcccaaagtgctgggattacaggcgtgagccaccgcgcgtcaggctggctgtctcttccagacctaagaaaggcttagaacaaaggaggtctggctacattaatggagattcgctgcagatgcaaattttcccactaaagatagctttgcggggctatccatttcaatctgttgcccctgtggcagccacttcaaaacatgtcaaagaagtatattttggggtaaaataatttccttcagcatctgctgtcatgtgatgctgtaccagagtcaggttggaaagtgagcctcattatataagagtaataaaactcatctgatgagattttatggtttctcgggcaggattccccaagcctcatacataggcatttgggcaagggaaaaaaggtgaatttagtcctcaccaggttggtagggcttcctcggttattggagtgggagtaacagcaaccattgggcccagcagtttttttaaatgtctctggggctgtggactgaccatccaaataactgattttaatcatttcattatggaaaaattgtcagcagaacccccaagtagagagacccatcagtcaagatatacctcatgaccttgcaagctaatctagcttgacccagatcccctcctaatctgtgcagattcattgaggaatgtcatagccatgcctactggttaagacatagtcctttacagtgagagttgaaacccaagctctatcactttcttggctgtgttgctttgagaaaggcatttaaatgttttgtgcctgtttcctcatctgaaattggtgggtaatagtcacttcataggacagttgtgaagattgaatgcagaaaaatttgtgccacgcctggaaccgtccctggcatatattaaattctaaaaaagtgttaaatattataatgaatatcaacacttccttattctggaagcaccgacaggatatgctgtgtttagtgttagcatcatgtcaggacagggtctgttgcgatgcccacactcaggatctgttcccaggaacctgcgtaaagttttcttctctggaagactttgggtcctttttttttaacaagaagaggctctaccctgggactgggaatttccaaggccacctttgaggatcgcagagctcattttagagccattttagtccccagctcctcttcctccactcccacgttacccgtgagaggactgtctgcagggtaagggaggacagcccaaccccaggtggggacttcttatgtattgccttcctgcagtgccttctctgccctaaaccatggtgggtttcctttgctaatgtctgacatcttgtgccctacactgtcccatctgaggctcagaacctctcagccggttctcatggggaacgttccccagatctgatgccctcattcaggacacttccatcattgtccctacatttcttctctcagtgctttattcaggctgctgcattcgtggtgcagaccaggtcttgtaaaaaattattcagtcagcatgtgctgagccattgtcctgtcccagggacagggctttatagtcattgccctattcatctcttcaaccaatgtggaagttaggaattggaatccccatttcacagactaagaagtggcgtgttaatcagttgaaataatttttacggcttggcgtggtggcccatacctgtaatcccagcactttgggaggccaaggcgggcagattacctgaggccaggagttcgagaccagcctggccaacatggtgaaacctcatctctactaaaaatacagaaattagccaggcatggtggctcacgcctgtaatcccaactactctggagcctgaagcaagataatcgcttgaatccaggagatggaggttgcagtgagcagagaacatgccactgcactacagcctgggggacagtgagactctgtctcaaaaaataataatttttactttatgtaacatatctgggatcaagtggactgggttgtggagcaagctgggattttgggggtttctgttaagaattagcttcattgaggtataattgagacaataaaattatctcccattttaagttctagttgatgagttttgagaaatgtatatagtgaagtcttgatcatcaaatcaacatatgaacatttttcatctcccaaaaatgtaggagctgtttttttatcttaggagaattttaatgaaatatacgtggaggagctaaatgtttcaagtttgcctcatattcatatctaatttattggtaactaatttaaaccactttcttacggctctcagtttctgttcctacaggatattaactcccacagatggcaacagatggcaggagtgagaccaaacagtttgcagtgttctccattcacaccctggaaatgaaagttttctctatttttcctctccaaattatcttggaagggatattcaatttttttcaaatttactatgaaaaatattgaagtaggaactaaagtagagagaatatataacagatctctctgttcccttgttgcaccttaacactttgctcttcttatttcatccaaccccctccccaccccatgctttctgttttcaggctagagcatcttgaagccaatccaagacaccattttatctgtaaatttactgcagctacttctctgaggactatttttgttgttactgtcttgccttttaacgtaactagagtaccagaatcatactcaacaaaattagcaatgtattaatttcactcattacccagtttatgcagaaattttccaggtctcaaaaatttctccttacaattcagatttcacactcaggttcattaagatgggaagcatgagagaagaaatatctagaaaccagctcagtagtgccccttgtctgttttacttctctcgttgtgatctaggtaaaggaagtttccctaccttggcaaacttcccatttgcttgcttaggtgctgaggcttgttcattctttccttgccatagctttttccttcccttccttccttctgcctgccaggctcatctcctaattctacttctacccataaggacaaataatgatcacaccacttacctaattgcctggccctagttctggtcccaactataatcagaaatgtggattctggaatggcagtgaggagcgacgtggactgtatctccagtaaaacaccataactggtaatttagaaaaccaaaaacaaccatttaaactacacggaatttgtcttaagaccactcaggaatttagagaaacatttattcagaaaaatcaactgagcctttctgagaacagtgagagtctgtaacatttgacacacaaactgctaccctccccacccccattttggtccactctgagagaaactccactgtgggctgtgaaaatcacaagatggaaccctgtccctctccagttctcagtctatggtgacagcttttccctgagagaggcacgatgccactattcttaacttctctccccctgccagtcctgtgttcctgaagctggtttcatgtaagtatagttgagaagtgtgtttgggtgtggacctccttgaatttattcttggagtttgttgagtgtgctggccttgtagattcatgtctgtcttcaaattttgaagttttggccattatttcttcagtaatctatcagcatcttctagacacccatatatatgtccagttaatggcaccttataactcttttggctctgtttatttcattcttttctcttctgcttctctgtctctgaaatttcaaattcttctctttatgtttactgattatttcttctgcctgctcatctgccgttaaatccctctactgaatttttcaattactgtgttttcgggtccagaatttttgtttgcttcctttttgtaatctctgttggtattttgttcatatatattttcctgatttccttttctctacccgtgtttcatgagtttttgagaatattttagacagtctaaaatctgtctagtttgcctgaagcttatgtttctccggggaaggtttccgtcactttattttcttccacttattgggccatgttttctgagtttttgttgttgttgttagaaattaggcattgtggaaaaaacaacctccttttccggtttttgcagactgactcttttccagggaggatttttgctattatcttggtattcgttctaagctttgggatcaatctgaggagaaggtttaagattttctcaggcctttttggagcatggatcttacctttgcttgtggctttttccattttctcataggcaactgcttttaaatatttatttgtcccaagagtctctcctctgggcctttgatggtctgttgtatgtctccacccataatatcttgccccaggcatctgctcttcaatctgtctgcatctttgccaagcatgatccagtgcttttcttccctaaggtgtgagatcctcaaaacagagcagtccctcaggcagcctccaacagcttagaaccttgtaagaaaggtctactgtgctttctcaggtttgagggaaggaagtggaaactgagatgctgctttagaagctctgttgtattctgcacctgtaattttttgccccagggatctataggcaagttcaccatgagatttttccattagacaacacttggacaggatagaacattgggaataaggtgtattgggctgcaaatatgactgtctcctgttttgtttttgttgttgttgttgttttgttttcttgagactatgtcttgctctgttgcccaagctggagtggagtggcatattcaaggctcattgctgcctcaacctcttgggctcaagccaggagtagctaggactacaggcacgtgccaccacatccagctaatgtttatattttttgtagagatgagcctttgccatgttgcccaaactggtcccgaactcctgggatcaagcgatccacatgcatcagcctcccaaagtgctgggattacaggaataagccactgtgcccagccagctgccttctgtttttaatgtggctttttcttgattgggcagtttcttgaatgctggggacttttgagtattttcaaatgaagttagctcctataagattattttagccaattttttggtaagcatagaattagcaatatgattaatgctttttctgtaaactagtgttatgaaaaatctcaaatgggtagcaaaattgggagatggtaataggaatccccatgttgccttcatccagatttgatcattttaaaaccatgggtagttctgttagatttatcccttccccctgtttatgtgccaaagtatttcaaacaaatccagatgtcttgttattttacccatatatacttgatctctgagaggatttttaatcagtgttgaggtgtaacttgcataccgtaagaagcactgcttttaactgtataatgagttttgactctttaaagtatacacaggtcacttatcacctcaatcaagatacagaacatttcaacaagagttctcatgtgcccttacatgtaatcattccagaggaaaatagtcaagaattctcaccaaaatatggacaagtagtatccagcaatacatgaaaaggatgatatattctagccaaatagagtttgttcccaaaaaaccgaggatagagtgaacatagagtaagcaacctgtggagatatttaactttttttttttcttgatgcggagtcttgctctgttgcccaggctggagtgcagtggcacggtctccgctcactgcaagctctgcctcccacgttcacaccattctcctgcctcagactcctgagtagctgggactacaggcgctcgccaccacacccgactaattttttttttttttttttttgtgacggagtctcactcttgctcaggctggagcgcagtggcgcgatctcggctcactgcaagctctgcctcccgggttcacgccattctcctgcctcagcctcccgagtagctgggactacaggcgccgccaccactcccggctattttttgtatttttttgtattttcagtagagacgggtttcacggtgttagccaggacggtctcaatctcctgaccacgaggaggaggcccgcctcagcctcccaaagtgctaggattacaggcgtgagccaccgcgcccggcagagatacttacccttacttaacctatctgtagttctccgcttaggaacaaaaggaaaggtagcttcttggatgaatcagctttcagcttaatatttttcttttggcagagtggtttgggttccaacgtttttattttcctttcactgctttcagggagcaaaagagaaaaacctacattactatcttaatgcagaaaaatacttgataacatttcacacctattcagggtaaaaattctcagtaaatgaggaatagaaagaatttcccttaatgaaacaaaggttatgtgtgacagcctggctgcaatcatcatatttaatggtgaagtgtgttcacactaagatcaggaacaagcattaatgttgattcttatcactcttatttagcattatcctagaataactagctaacctgttaaggtattaaaaaggaataaaaggcataaacgttgaaacagaaaaaaaaattttttattcacagaagatgtgagtatgtacatggaagaatagttaaacaactagatactagtaacacacagtttaggaacttcagaaaataaggtcagtatttttaaaaagcacttgtatttctgtaacctagcagcaaacagttaaaaaatgaaatacatatttatactaccatcaaaaacaacatatttaaacttctaagagtaaatgtaggggaatatctttgtgactttggaataggtaaagatagcacagatgggacatgaaaggtaaactatttatgtaagtatatagaaagaaataacaaaaatgttttaaatcacctttcaactgccgtcagaggaagaaatttcactgtttttcttctccaactacatgtaaaccaaaaagtatcagagtcaagtaccaatttagatgtttattttgccacagttgaggacatgccacagaaagaggccagtggctttccccaaagatgagtttgagagcctcattgtttaaaaaggaaaagtaggctggaggggaaagaggaaaggtgtggtaatccacctgtgacaagagaaaaggagcaggtaggaaaatagttatgcattcatctcacactcagtaaatcagcactttacataagatacggtgtgcatagagtagctactatggagatatttaacgttttatctgtagctatctccttaagaacaaaaggaaaggcagcttcttgcatgacttagctttcagcttaatgtttttccttttggcagagtggactggggtccctagttttattttcttttcataacaccatagtatttgttcacttctgtctcaaagttactggctagtggatgtatgctgtgttcatcataatcaccacatgatagcatctttgttccttcacatttccttcttttcacccctatatgtctgtgtttttaattttatttttttagtcaaaacattcacttaaaagtatagtgaatactctaatgaaatcattacacccaccactttaatttacagttcttttcctgtatttctactggaatttttttcaaaaaattcggagaaaataatataatgaacccagtacacattattcagttctaaaaattatgaagtgtggccagtaatgctcaattgacttttgagggtgagaaggggtgtttaagcacatccagacatcattttcactcatgaatgttccaaaagtttgtatacaaggaagggctcatgtttttaaaacccaaaatacttttataacaacaaaattaatgtttgataatctaatatccaattagtgttcagatttcactggctgttaatactcctcacatattctttgttgcaatcaggatccaaattgcattggatcactcattgccttagattaaccatgtgtctgaggacttttattcctgacagctcacactccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggtgagacttcccagaactgtcgttcttgctgtcacaggatgggcccatttccttcactggccctagcagttacattattagcacaggaccaaggccagcaccgctcctggggagtgatctgtctttcctggcgtcctccagcaggtgactggcctgtgggtgtcactcatcaagtagtgatctgtgtacagatggcagaacctggaatcctccaactgcgtgagtgcaacactgtccctggtgagcatgcctgggttttgtgttacaggctttcttggcatttggggatgtcactgtggatttcacccagaaggaatggaggctgctgagccctgctcagagggccctgtacagggaggtgacactggagaactacagccacctggtctcactaggtaagcgtggcttccctcgagcctaacatttggcctgtggtgcctctgatgttgccatagggttaggttcagagacaagaatgttgttttctctattcccctgaggaaggtctggctttggtaaagtttcatactgactgccactgggcacctgcaggcctttccccacactggggctccccctgggggtttgtactctgagcatggtagacagggtcctcctgagccttccccctctgattctccctcccttcctgccctgggtggctccagcaaatggcccgtggagcctacaaccaggagtcacctcatggtttttttccctgtgagcaggaattctccattctaaaccagaactcatcaggcggctagagcaaggggaagtgccctggggagaagagagaagacgccggccaggcccctgtgcaggtgaggggatagacagggcagacagagcacaaggcactccgcctttcaggagggaggaggcttctctgaggccaggggacctggaagctgttctggcctccttggctgctcttcagaccacctggccctgccttccttccagtccttgctgagtgagaggttctcctgaggtccctggactccttctcccaggaagcctcctttccccctacttgctagacttctttctcccactcaatctcctcatttgtgactttcctcgtgactgcccgactgcaagcctaagtctattgccccttcctgatactgtccaggtattcctattttagcttctttttgttttgttttgttttgttttttaattatttttctgtgtaagtaaatataaattttttgatacaatttgcatctcattcttctatatactgattttcttttttttttttaatttaagttctggggtatatgtgcacaacatgcaggtttgttacataggtatacatgtgccatgttggtttgctacatccatcaactcgtcatttacattaggtgtttctcctaatgctatcctctcccctgccccctaccccccaacatgccccagtgtgtgatgttcccctccctgtgtccatgtgttttcatggttcaactcccacttatgagtgagaacatatagtgtttgatttttctcttcttgtgttactctgctgagaatgatggtttccagtttcatccatgatcctgcaaaggacatgaactcatccttttttatggccacatagtattctatggtatatatgtgccacattttctttatccagtctatcattgatgggcatttgggttggttccaagactttgctattgtgaaaagtgctgcagtaaacatacctctgcatgtgtctttatagtagaatgatttataatccttcgggtatatacccagtaatggcattgccgggtcaaatggtatttctagttctagatccttgaggaatcgccacactgtcttccacaatggttgaactaatttacactcccaccaacagaggaaaagcattcctatttctccacatcctctcaagcatctgttgtttcctgactttttaatgatcgccattctaactggcgtgagatggtatctcattgtggttttgatttgcatttctctttttttaattttttttaatattttttatttatttgtattattattatactttaagttttagggtacatgtgcacaatgtgcaggttagttacatatgtatacatgtgccatgctggtgtgctgcacccattaactcgtcatttagcattaggtatatctcctagtgctatccctcccccctccccccaccccacaacagtccccagagtgtgatgttccccttcctgtgtccatgtgttctcattgttcaattcccatctatgagtgagaacatgcggtgtttggttatttgtccttgagatagtttgctgagaatgatggtttccaacttcatccatgtccctgtaaaggacatgaacccatcattttttacggctgcatagtattccatggtgtatatgtgccacattttcttaatccagtctatcattgttggacatttgggttggttccaagtctttgctattgtgtatagtgctgcaataaacatacgtgtgcatgtgtctttatagcagcatgatttatattcctttgggtatatacctggtaatgggatggctgagtcaaatggtatttctagttctagatccctgaggaatcgccacactgacttccacaatggttgaactagtttacagtcccaccaacagtgtaaaagtgttcctatttctccacatcctctccagcacctgttgtttcctttttaatgattgccattctaactggtatgagatggtatctcattgtggttttgatttgcatttctctgatggccagtgatgatgagcattttttctaagtttgttggctgcataaatgtcttcttttgaggagtgtctgttcatatcctttgcccattttttgatggggtttttttttttcttgtaaatttgtttaagttctattttagcttcttaaaacctctgtccgttattctccttcttcaattcccatagctttttttccttgtcgtttaatgttttaagcagtactactgttgccagaggtcacttcaccttcctccttcccccatttcccccagatgtactgcctgagtggggctgtggtctagaattgtgcaccctcttaagtccctgtagtcaccgcagtggttcatcaggactcatgatgatgatgatgatgatgatgatgatgatgatgatgattcttacctctagggtggacttgttctctcttggagcagttttagttcacagttaggccctgtgttcctctcttctcttttcatgctgttttactggctttcctcactcctcacagtgggaccacaggagactgctgaaaagtggtgttaagttttctgcttatgacaatgataaatttagttttctctatcttgttatgtgtcagtttcaggggtcatctgtttctattgacctttatatcctatttggagaatgtgtggacagatttagccttacacagctgcagttctcctcgagtacttggaagtctcttttatgtcttgtttaagaaacccttcctagatcaagtttataaagatacaaagatttaaagatataaagtttttttttttttgagtcggagtttcactcttgtagcccaggctggagtgcaatggcgcgatcttggctccttggaacctccacctcccaggttcaagcaattctcctgtcttagcctcttgagtagctgggactacatgtcctcaccaccatgcctggctaattttttttgtatttttagtagagagaggtttcaccatgttggccaggctggttttgaactcctgacctcaggtgatcctcctgcctcagcctcccaaagtgctgggattacagacataagccaccatgcttggccaatatataaagatttttgttgttgttatttaactcttctgtggctttatagttttttttgggagggcagtttgaactatccaatacttgaaaagatgatttttacatcttctatattcatagtggattgttccatatctactaagttttgtaggactttatatattttagcctactattaaatacatgcagggttagaattattataattttattggctcacagggaatcttgtgtcctctgtactttcaccctcatctcccattcctggattattttgaagcaaatcctggtcatcatatttcatctgtaaaacctaataatagttactgtattataatctatttcgtttaatattaatattagttcctaagattttttttggtgactgtaaccctcatttaactttccttatttcatggcatatatattttgagtttacatcctataatacttcctttcctccagcatttttttgtgaagcaaatgttgaacaattatattttggtggatactaaaaagttgaaaggcttatagaatgaacacctgtcgatctgccacctacagtcagcatttagctttgtgctccgtattctttatcgcttacttacccagctgtgcattgctctctccatccataagtccatcttccttttgatgctctttaatattgtggacatcattatcctttacgcataaacacttcagcatgcatatcaataagtagtattataatgtttctttgtggttctttttaggatttatataagatgcataaatcttaagtgtaacattcagtgagctttgacatatgcataactttgtgtaatctggacccctatgacaacacaaaagaattactctcaccccagaagtgcttttgtgcctttttccagtcatttcctgcccccacgtccaccagagaaaatcactattcggattttgttcaatatgccttaatttcacccatcttagaacttcatgtaagtggaattacacagtatactctctatcagaaaattagcaggttgatttttttttatggttattgttgttgactttgtcctattgtctgcaaaaaaagcaggttcatacagactgtggagttctttcccattccttgcttcccaccaccccataaaaaatgtgggggcatccactgagaaatttggagctggcctgagttttcacgtgcataaggtctctgcttttggatcggggccactccctcagtttacataggtgggaagggactcctctgtcatcttgagtatcgtagaaatgacgaaatatcatagactgggaggcttaaacaacagacatttatttcgtacagttctagaatctgggaattccaagatgaaggtgctggcacctttgcttcattgtgagggtccccatcctggctcacaggctgccgcctccttactgtgtcctctcatgggctcaccccacgatctcaactaaacctgtttatctcccaacaactccacctccaaataccatcacattgggggttaaggcatcaacatatgaatttgggggggatgctaatgttcagcccattatcaactcccttctctcgcccccatatcaattgcttgctgatttgtctgtcagtgaattaaaataaaaggcttcttgtctaccactgacttctgaaagtgtgaatgtttaatgtaatgggagcatatgttaggattttatttaactcataagtgaggttactggcaggatgacaaagctggttcagtgcaggtatgagaaggtgggatgtatgtggatagtgccaaaataacaccattgtaagttaccctgtaactttacagaatcagcaaacttaactgtcattatccgagtgatcagaaaaattaaaaattatacagatgatgtaggaaaggtcatataatcatatatctgacaagttttggagtatttttcctgaataataagcacattgactgtcatagtaccagcagtactttctatcagtttgctatttctcttttcactttagtttttcctttcttaatatgaatattcattttaatgtattaaaaaagataattctttattattctccatttatatataaatatctcccctttgtagatgcctactattttgtattagttttggggggattattttcttatttgttgatacataataattgtacattatttatggagtagatgtggtattttgatatatgcataccatatgtaatgatcaaatcaggatccataacctcaaatatttatcatttctctgtatactccatttttttctattttgaaatataaattacagttaaactatagtcacgctactgtgctatcaaacacttatttcttctaactatatttttgtacccataatcaactgctcttcgttctcccttccctctccctttcctagcctctgctcccacatatgagtgacaatatgcaatatttggctttctgtgcctggcttatttcacctaacataatgaactaatgatactgattatatcattagttaatgataatgattctaatgatactgctgtaaatgacagcagtattcttattcttctttatggttgactaacattccattatatatatgtactacattttctttatccattcaaccattgatggacatttaggttaattccatatctagactattgtgaataatgttaacatgggggtacaggtatccttttgccatactgatttccttttctttggataaatatgaagtagtgggattgctggattgtatcgtagttctatttgtagttttttaaggaacctccataccattttccataatggctgtactaattatacaccaagagtgtataattattgccttttttctgcatctttgccattatttgttattttttctctttttgataatagccatcctaattgtggtaagaggatctctcagtgtgatttgcatttccctgatgattggtgatgatgagcattttttcgtatacctgttgcccatttgtatgtcttattttgagaaatgtctattcagatccttttcccactttttagttggattttttgttgttgttttttgacttcttgtatattctgtatattagtcccttgtaagatgaatactttgcagatatttcctcccattctacattttgtatcttcactgttgatactttcctttgctgtacagaagctttttagtttttagtttaatgtagtctcatgtgtgtatttttgcttttgttgcttgtgattttgaagtcttagccataaaatatggctagtttaggccagtgtcctaaagcatttctcctgtgtttcttcaagttgttttataattgtggaactcatgtttaagtctttaatctattttgagtttatttttgtatagtatgagaaacaaacatctaacttcattcttactcattttggaattcactttttctaataccatttattgaagattctgtccttaccctaaggtatgtttttagtgcctttgtcaaaaatcagttggctataaatatatggatttatttgtagattatctattctcttttattggtctatgtgtatttcatttttgtttttgtttctatggacagggtcttgctctgtccacccaggcaggagtgcagtggtgccatcacagctcactgcagcctctaactcctgggcttaagtgatcctcgtgtctcaagtagctaggactataggcatgtgccaccatgcccagctaattttttttttaaccttttgtaatgatggggtctcatcgtgttgcccaggctggactcgaactcctagcctcaagcaatccgcctgccacagtctctcagagcactgggattacaggtgtgagccactgtgcctggccagtgtctatttttagaccaataccatgctgctttgatgacactagctttgtattatattttgaagtgaggtagtatgatgcctcccactttgtactttatgctcactattgcctattggaggtctttttggttccttatgaattctaggagtattttgtctatttttataaagaatatcactggtattttaataggtattgcagtgaatctgtagattgctttgggcagtatggtcatctcaacagtattattttgctccatgaacataagatgtcttttcatttgtttgtgtcctcgtctatttatttcattgtttttatcatagagaacatttaatttggggttgtttattcatatacttttttgtaccaattataaatgggattgctttcttgatttctttttcacctagttattattggcatatagaaacactactgatttttttttctgatttcatattgtgcaactttattgacatcattcatcagttcgaagagtgtttaggttttctataggtacgatcatgtcatctgcaaaaagagacaatttgacttcagttttccagcttggatgccttttatttccttttcttgccttatttttttctcttaccatagttctgactaggactccctgaactatggtaataagagtggtgaaagtagacattcgaatcttcttccagttcttagaggaaagacttttatcttttccccattcactaagatgtttgctgtgggtttggaacatattgtctatattatgttgagatatgtttcctgtacacctgatttaagtttttatcataggctgggtgcggtggcttatgcctttaatctcatcactttgggagggcaagatgggcagattgcttgagctcaagaatttgagaccagcctggacaacatggcgaaatcccatctctacaaaaaatataaaaattagccaggcaatggcacctatggcttgactacaggcaggcacctgtagtctagctatttggaaagttgaggtgggaggatcgtgtaagcctgggaggtcgaggctgcagtgagccatgatcatgccactgcactccagcctgggtgacagagtgagaccctgtctcaaaaaaaaaaagtttttatcataatgggattttgaatcatatcaaatctttttctgtatctgttgagatgatcatatgtcttttggtccttcactctgttgatgtgatgtatcacaagtattgatttgtgtatgttgaatcatgattgcatacttgggataaatctcatttgatcatggtgtattatcttttctgtgttgttgcattggttttgctagtattttgttgaggatttttccatttagcatcatcagggatattggcctgtagttctctgtttttgctgtgtccttgtctggttttggtatcaggataatgctggccttttagaatgagttaggaagaattcctccctgccctgcttcaattttttggaatagtttgagaagaattggtgtttgttgttctttatgagtttattagaattaagcagtaaagcaatatggttctgggtttttctttcatagaagacttttcgttactgattcagtctcattgttggtctattctccaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatac

SEQ ID NO: 38040 - DNA, 336397 bp, Homo sapiens
gaaaatcaaaccctccggaatgtccccctgaagaggaccactgttgcagcggggaccctcctttcaggcatcctcattttatcatgtccctttgctttcttccccagtggccttttcaaaggtcagagagaaatgcttagtcaaacccctacttgagtatcacaggtgactaattttgggatcgaagattaaggaggttttgttgcgtccttaaagaacttggaattggagtccaggtagttttggtaagtcatcaacagctggaaagaactgtcggaaagtgactcactttcaggctgatagttctgtgtagaaaacattccctgtaatggtgaacatgtattgattccttcctgcgtcccaggcactagacataagcagtccctattcagttctttcgattctcacagcaactctatgaggttggtgctgttattcttattatcacaggcaaggaacagggttagggagggtaatgaccttccccaatcacacaggtggttagggactgggacctcaacatcagagtcctggctctgggcaggagttaaggttgaagatgccatgaatcaatccagcctgacttgttccccttccccttaactgcattttgggtagcccctgctgctgcgtgccctggccatgttgagagctttgcctctctcatttgctcttaagaaaggcatcttggaaggttctctttgagtcctctgggctggattgaccagagacagatgtaataatgcacatcaaagcccatccctggcatgtgacagccctttcttttttattttttgagacagggtcttgctctttcactcaggctggagtgcagtggtacaatctccgctcactgaagcctcgacctcccgggctcaagcagtcctctggcctcagcctcttgaggagctgggactacaggtgcatgccaccacacctggctaatttttgtattttttgtacagatggaggtttcactatgttgcctaggctggtctcgaactcctggggtcaagagatccacctgtcttggcctccgaaagtaatgggattataggcgtgagccaccacacctggccagcccttttcaataagcaagagattttattattagtacattcttctgaaaccttgttggtccctcggaaagggcctggaaccgcctgtgtcttagggggctggatggattaggtctggatgttatggtctgtttctgaccacttcgttcattcacgccctcgctcattgatattgaggtgtgatttttccagcaagagagtcccctggtctcaagtttccggaggcacccactacaatctagattccaattagcttaattgcttcatattagacttcttagaaaagattttttttttcttgctgatggctgcctttccaggaatgtctcccccactgccttccttcctgcttcttccaagcttgtttctttcaactttatttctctggtactgacctgcacctcagtcctgttagacccggtgccattgtgtcagtttacatctgagaggccaaagtgacaccaggaaaaaaaaaagtatatattatatatatgtatggagagaaagagagaatgggagcttatatatcccatgtatgtaaaattacatgtgttatttttaaatagaaaatttctttttagggtgtgtgtatgtttcagtgaaagaactggacacaaaacctacccagagttctgaccctatctctcttccttttgccatcaacaccagattttttaaaaagtaattttcaacaaccaaaggaaacagttacatcctgattgacacacaggatgtcggagcagcattcttgctgttaagtgatcaggatttcagccaagggaatataatgaaatccacataaaaatttatttacctaatgaaaatcctggagtaatgcataagtggttctctgataataaaatgcaaatctaaaactataaccaggaggacaataatcttcattaaatgtattgtctagaggaagcctgtgacatctacttaacagtgatttgatttgtttagtaatttccacgtaatatttaaactttatttcgagtcttaaaaaccagcccacgagtttcttttgcatcagagaggagggcagctgctggtgggtggaggtgcccgcccattggattctcagggcctctgcttacggggcaccctggaatctcgtccttttctgggcagcgtggcatttggtggagaggcggggtccaggaagggaaagcaaggggtcaggtttccttctggagtgagacccagaaaagctcctgttctgcaggaaaatggcatttgaggcttagaaaggcttggagatgggaagtgactcgcccaagtttatcttggagctctggtggtgcccaggtctcctggctccccacccagtgctcctgccttcctgaaatctggccagagctgaggatttgagtgccactctcctgccactcaggctctgtgtagcatctctgtagctctctctcctggcctgagaccacttagcaacagcacacctcccccacccccaacttggtattggcatgattggaagttgcaagcagggtggaagtgctttggaagcaggctgacctgggttcaaaacctggctctgtctcttgtcacctgaggaaccatgggcctgtaccttactctctgtgaggctcagggtccctacctgtgacaggggggctctaatctctacctttgggactgctgggaggactctgaggaagcgtgtgcagtgtctggctggagacgcaatgcctggctgtgggcttagaagtctcttgggtagcttagaagcatgatagggaataatttattttgggacattcccccccagttttgacactaataatctaaaccctagatgagaaaaactacccttttggattaaaaaaaaattttttttgagatgttatcactctgtcatcgaggctggagtgccgtggcattatatggctcactgtaatctccactttctgggctcaagcgatcttcccacagcctcctgagcagcttgggactacaggtgtgtaccaaatttttatttttttttgtagagaggtctcactatattgcccaggctggtctcggactcctgagctcaagtgatcctcctacctctgtcttcccatgggattacaggtgtcagtcactgtgcccggcccctttaacacaaaatcccagatacatgacagatgaagcctgttggtgtgtgtacatgtgcaagtgtgtatgtgtgtgtgtgtattttccctccacatatcacggtaacttcgcagattacccaaccttcctcttactgtctcctctgcctccttcttctcctttttttttcccccaacaagttataacttttttctttccctttcggaatgttgcagagcattttgaaaaaatattaaaacaaattatccataatctcaagcaagaatctccttccaagggcagcataggactctggttaggaacacaggcctgttcagacaccagctttgagcttaccagctagctgtgcaccctcgagcaacttccttatcctctctgagcctcagtttccttgcctgtgatgcagcattaacactcgtttttttctgcacagctgtgaagattaaacaagataatgtgtgtaaagtgcttagcagagtgtctggcacttagtcagtgattgataaatgggagctgttttgttgttgcaagagaaaaggttgctctgaacagaagccccgtgaaatggagaagtgaggcttctgtccaggtagtgatgccagccgaccagcaggccagccaggcataatggcttgagtttccatccaagggctggctcaggttactcctggcccattagcatcgctggtgagagcttggagcttcttaagttcaaggtcgatcacaggccttgtccccgactcgggcctctctgctttgcccagagtcattagtcaccagggtggtctgaagagaaggtgaggatgccttagggcctcctatcctgacctctgggccataccccagggaaggaccttgctcaagacaggggatcagccatccagaggctttgaaaattcacttgtgtatctggaaaagcagttaaatcctggctgcgtagatgactacctgggcaagtcgttaagtagtctgagcctcagtttgctcatctgtcaaatgggtatacaagtgttatttcaccaggagattgcacatgcttactagcctgcaataagaaattttgtatttattcccccaggaaaacttcctggagaaggatggattttaccctgtaaaagaagaaagacatggatgcataagaagaggggtgagcaggggaggccttgggctgaggggtggggcaagggaagtaggcagacagaaggagctcgaactagagcttagttctcttggacaatgtgggtctcatcccttctgactcagctaggggccttgcctggggaggatgaaggagcaacatcatcttgaccccatctaacttggatttaaaaattcctgcagggggccggatgtggtggctcatgcctgtaatcccaacattttgggaggttgaggcaggtggatcgcctgaggtcaggagttcgagaccaacttggccaacatgatgactccctgtctctactaaaaacacaaaaattagccaggcgtggtggtgggcacctgtaatcccagctacttgggaggctgaggcgtgagaatcacttgaacctgggaggcggaggtcacagcaagctgaaatcacgccactgcactccagcctgggcaacagagagagactccatttcagaaaaaaaaaaaaaaaattcctgcgggggtgacttaggcaaacgggttgtcatttcagcccaaatactcccacagtctcctgtatcaggagatcctgcccacgtgctgttggaattcaccagccaaccagggactgctggagtgtttcttcttactcatcttcggctttcccagctctttcctctagcaggatagggatgtggaagtgattgaaccttctccgggagagagaggaagacccaactggaggcattgaatgcatcccccagaggccctttcatggttgtgcacagcagacctcaccgcctttgagcacagccttggaggctgcagagggtctgggctgtcgggggtggtaataaataccctgaggcctggggagccccgtgtggcctccttccctgggcccacagaagggcctgagtgacagccaggctcggccttcgcacacaccgggggagggaaaaagagagcagcaggggcagaggagggggctgccaggcagggacaaaggcagagacagggagaaacaaaggaagagagaaatctcttcttgttacaacctgtggtttaaagaaaaatgtgctttgccacccctgaaggccttagagtgagaccctccgttcatctggtcacagagcaggacttttcactttgcagaccacgcctcgagcccaggtgtgggaccctcatcctgtgcgttcttctgggcctgaagcttcctccacttaagcttgcatggaatcagttggaaatgggaagaatcagaggcaatcatctgctgccaaatttgggagcaaacatttttctttctggatttaaataattgcattgcctccccagctctggttctcttctaaagccagccccagatgacatttggcaggctatccatggtctggctccccatcgccccccgcccctgcccccgccccaccaccctgtggggttttcttagaatattttcctccgcgtctgggtagctggcttttaaacccgttcagtttttcttttttttcttgttcaggtctcaaattttattaaatttaaattttattccatttcaggctataaaatctccaaaagtggctttgaaagtgaacaggttttggcatgctggaaataggttacctccaatgcaaataaaagagtctagcttccgaggcgaacaaggctccaagggttgggaaaatgcgtggagcagttagagactgtggcatagaaatggtcagagaccaatttaaaagcacatatattttaaatgaaacattttgtggacatatggaacccatagcttttgccaaaagcccaattgtggggatcaagtcttaagagctaaacttcaatctactacccaaggtgatttttaacagacaaatgaaagctcctttttgctttctagtctaaggggaatcttaatacatttttaaattatttggcattttgaattaattttcttagaatgaaacgagattcttaaattgggatcttgtagggaaaagacagccaggtaattagtgaactgatctcctttcctgacacacgaatgcaagggggagggggagagttgaactccaaccaaggtgcacacaaaatctattttagagcaaaaatttcaaagtaagcaacaccatctgttctttaattatttctccttattaaaaaaatgtagctaaatttatttgggttacttagttggaaagaaatgtctttaagacactcagaactggagctattaaagtcagattgtcagctcttgtttgctaggtatccaagaactgaaaatagtaaaggcattttagcattgactttcttttccaacagagcttcctcttggttaagcaggacatggttatccaaggcctagcggatattcctctgctgctcatatcttggggcaggggctatgggattaagcagagggttcatgctctagcaggtcaatcaagggaggtagggggtctgccttcaagaggagttaggccactgggagtctctgcccctttcggagttcttgccattcagctcactgtccatccttccattcatctgtctgtccgtccgtccgtctgtccatccatctgtccatccattcatccatccacccatccatccatgcatccatccatccatccatccatccatccatccatccatccatccacctattcaacaaatatacctttaataatactcctaacctacaaacatcagggcttagcgagcttatcttaacatacttggaacacctacattagcctacagttgggcaaactaatctaacacaaagcctattttataataaagggaagaatatctcatgtaatttattgagtactgtactgaagtacagtttctactaaatgtgtgttgctttcataccattgtgaggttgaaccattgcacgtctaaacactttaagtcagggaccatctgtaatcagatactcatggatgggctcattcctgtaatctagcactttgggaggccaaggcgggtggatcacctgaggtcaggagtttgagaccagcccggccaacatggtgaaacactgtctctactaaaaatacaaaaattagccaggcaaagtggtgggtgcctgtaatcccagctacttgggaggctgaggcagggagaatcgcttgaacctaggaggcggaggttgcagtgagctgagatcacatcactgcactccagcctgggtgacagagtgagattctgtctcaaaaaaaaagatactcgtggatgagcctatgattactaacagtaacatgtgctctagagtctagaccagtgctgtccaatagaccttttggtgaagatggaaatattctatatctgtactgtccaatatggtagccactagccacatatgggttttgagcatttgaaacctggctagtgggactgaggaactgccattttttttttttttttttttgagacggaatctcactctgtcacccaggctggagtgcagtggcacgatctctgctcactgcaagctccgcctcccgggttcacgccattctgcctcagcctcccgagtagctaggactacaggcacccactaccacgcccggctaatttttttgtatttttagtagagacggggtttcaccatttggccaggatggtctctatctcttgacctcgtaatccaccggcctcagcctcccaaagagctgggattacaggcatgagccactgcacccggccagagctgccattttaaatttgatttagttaaaaaaattaaaaatatttattttaacaatatgtatttattattattatttttttagagacagggtcttgccctgttgcccaagctggagtacactggcatggttacagctcattgtagttttgaactcctgggctcaagtgatcctctcatctcagcctctggagtagctgggactacaggcgttcaccatcacactcagctaatttatttttatattttaagagatgagatctctctattttgcccaggtaggtcttgaactcttagcctcaagggatcctcccacatcagcctccagagtagctgggattacaggtgagagccactgcacccagttcttttttatttatttttagacatggggtatctctgtgttgcccaggctggagtgcagtgtctatacacaggtgcagtcacagcgcactatagacttgaactcctgggctccagtgatcctgctgcctcagcctcccgagtagctgggactatatgcatgcaccaccatgcccagtttgatttacttttggttaatttttatttaaatactcacatgagggtagtagcgactgtattggacagcatggggtcagcctcacctgggaacttggtagcaatgcagatccccgggccctatccaggttctgctgagtcagaatctctgtgggcgcccgggcatctgagtttcagcaatccctccaggtatttttatatggctttgctctaggaaaggtaggtgtgggtgtgatgctatcatgcgatccattctggggggcggtgcatcaaggagtaggggaattagatttcaactgcacagaagccttctgagaaaaaggactgatgagctgtgactgagacatgagtagcgaggtgaccatggcaggcctggcactggatgggcctttggtggtgatggaatacagctcaccatgcccagcagtggggagggcttggcacagttgacgaactcaaaaaaggtcagaatgttggagcgaagagatggagcatttgtgaactggcgggttggaggcctggtactgcagctgtgtgatcctgaaatggtgtcttaacctctctgggcctcgtattctcttcattgataaaatggagctaaccacaccttgcgacacactcatctagtagggtcaaaagatggatagactcaaactgcatggacaaagcatgcatgtgcacaacagaaaccctgggataagtgacatggtggtcttgtttcttactgagttttctttgttctctaactgcactgtccccatttctcctaccttcagggtctcagctctgcctgagcacctcctgcccagcaccactctccccagctgtcctcaatcaggctaaggcggtatcaggcgttctgtgtggctctggacccgcaccctggtctgatgggacctgtgttcctgttgctgctctgcatttccttcctggaaagtcctccccaggcctctgcgtctcttttattgggtttataatctcaggggccctttccagaccctcatctggaagcccaggatgggcccagagagtggacttctgcaagtgcacgttaaaatcagatgtaaccaaatgccttttggggaaagacttcatagtaattttagcagcatcttttctgttgtctagacctaagatcagcattttagggaaaagtgtcgaggtaaactttcccctgcctccccctgctctcccctctccgctgctaggactccgtgcaaggccctccctctaggacgtcaggtggccagagcctcaggcgtgccccagctacttggcagccaaaagttttgtccatggaagatgccagacttatttcgagatggcaaatgtggcgatgcttctctgctggaaagacaccaagtgtctgatctcagccttgggagtggtattttggggagatattagcagcttcttatctaaaatagacacatgcttttcttcaccctctcaaaagcctttgcagtcaactgtgtcctcagtacttgggatggtgccttgagcatactgattgctcagtataggttagttattgctaccgttattgttattattattactttgtttttccaggactgaagcattgcttaggcctctcctctagactaagacatttacaataaacgctttggaatcttccttttttttgagacagggtctcgctctgtcacccaggctggagtgcagtggcatgattatagctcactgcagcctcaacctcccaggctcaagcaatcctcccacctcagcctccccagtagctgggactacaggtgcgtgccaccatgcctggctaatttttaaatttttagtagagatggggcctcactatgttgcttaggctggcaactcctgggctcaggcaatcctccttcctcagtcttccaaaatgttgggattacaggcatgaaccactgcatcctgcctgaatcttctttttaaaagaatatccagggagagcactgtttgactaaaaggaattagtagctaatggtggaattttagtcacctgggcaagacattgctttatagggaaaagtactttccaagcacctctcatgtcattttagctcaatgacaaaacaaacaaacaaaaatactcaggacctgctttgaaatcctgggggaaggttgcagtctgggaacccgaggagcgcatccagtgtcaggatcattttgttttcttggctgctcaggattaaaatttgtttttggctaggcacagtggctcacgcctgcaatcccagcactttgggaagccaaagcaggtggatcgtgggagcccaggagttcaagaccagcctggccaacatggtgaaatcctgcctccactaaaaatacaaaaattagcccggcgtagtggcgggcgcttgtaattccagctacccaggaggctgaggcaggagaatcgcctgagcctgggaggtgaagtttgcggtgagctgagattgtaccactgcactccagcctgggcaacagagtgagactttgtctcaaaaaaaaaaaaaaaaaaaaaatatatatatatatatatatatatatatatatattttttttttttgtttgtttggaattagaatgtaacacttaaaattcaggaaagtatgcacaaaaatccagatttctagctgttcttcaaagcaatcaggagatcaagttcctgtacagtgaggatgggctggtgctgcctgcttatacccaagcctgcgtgctctgttcctcgtacctatgactccctgttgtgtgcatcaagccttccttaccctttaatgttacctggctggccctgaaggcctcaaggttgccagtactccgaggattgaaagagctgggcagtgctgccctgccagagtctgcctggagctcctggaccagccctgcctcctgtttgctgtgtgacttggcacccgtcataccacttccctgtgcctcagctttcccatctgtccagtggggcactagactgagttggcagtttcccactgtgcctgatgaagcagaagcaggtgccaggccccctacttcccttgtgaatgaggtctgtgccttagatttctcatggaaagttagggaactcccagataacttcctgtcctgaccccgtatcgagatctttgtgcagctgctgcttagggggctgctttttttggttcgttttggtggagcagctgggggtatcagggcaggaaagggaaaataatagtgttattaataagaatggccaaatttactgagcagcctattctcccactaaggtaggccctctttgacccattttactgataagaaactcaagttctgagagtctgagtaacttgccgaagttcacacagctgatgagcggccgagccccgctgtgagcctggttggtttcatcccagaccctgaggccctaaccagcaggctgccctccccgacgtggcttgggaggtggcattctaggacacacgtgtgggaaagaggaggtcaggagagatgcccgctgcagagttgagatggccagtgctctggggctgcttcagaagagacctgaccgcctcctgtcgcctccgtcttgctggccatccacactcctggggtgggggatgccacctcctcctggctccctgctcacatgccaggctcacccctatcagagccctgttttgggtcatgctcctgggtttgaatgaggtagataaatggggtgctaggcctgtcgagctgtaaactcattgcggattaattttttttttttttacaatagtggcttgcaaaacttttctggaacaaatcttatagcaagccaattgattaggttgttcaggaggaccttggaggattggagtaattttgtacttctcaggaacaagcgtgtttcctgtctgagcctcagttgcccacctgagaaagcacagcccatgcctgtcctgcttgccctccgatcctgtcccattgttggaaaaggcaggtgcagtttatcctggcacagcccacccctgtcccgcttgccctccgatcctgtcccattgttggaaagggcaggtgcagtctatcctggcacagcccacccctgtcctgcttgccctccgatcctgccccattgttggaaagggtaggtgcagtctatcctgggcacaggacatgtcggggatgtcatccccccaccccccagagcccacgggaaggcagatgaatcatgtccattttacaggtgatgcctgaaaaggttcagtattacaggccccgtctggagtcccactgctgctgagggctgggcttgtggccttgacccagggccttctgtctccgaagccccggctcctcagggcctggctcttggaccctggcagcccacagccttcgacctcacgccttccctggaactgtcacttcctgcgtcctctgggctttccaggagtaaaaagtgggagttcggcaaatcctgctaacgtccttgaggaaggagctgcttgttttctttttccagcttcttctgcaggagcccacctggggcctcccggttctccaaggcatttataggagttggggggcggatgtggacccctggcccctgtccaaagagcttttggcctttcctgggtggcttctgagtcagctgcaatggcaggaccatctccatggtctcagctgctgtctcggccactgtgctggtttcctgtccagcagggttcagtggtgcaggtgacagaagccaactctggacaacttaagccaaaagagactttaacaggaggccaagggggagccaacagtgtgaatgcacagagagatggaggccttggggcagctctggagatgcgggagcgagagggaatggatgttctcttccgggaactgccatggggcgggagtttgtcacctcccgtgtctcctgcgtggctctgcttgaggatcaatccctgggcagatcaagcatgagcctgggccatggcccaggggagggcagggcattttgactggtggcacattgaggttagggttaggggcggttcctcagggcacgattggggtgctgctgttatccgaggctggggcagtggatacctggaggatgaacatgtctgcttggctgtcactgctctcctggtggcctgtcctgccacctcagaaggctctggctgcctggagtcggggcacagggtgggctgggggtgaagtgcgccgttgcctgttaggccagctctgggctgtggggttggagtcaccaaggtagacctgtagggcaccagggtgggtggggatttgggggaagtccagtctaatgtcattcatacgcacagggaaatgggagttgagagagagcagcaagaacttccccaaagccccaccgcctagtagggctacaactaggggagtggaccaaggtgggaaggcaaaaatgcagcaccccaaggcaagtgtgggtgcccctggtggtgtggcagggggtttaagtagaacacacacacacttttaaacacacgaattgctaatgaatgcacaaggagcaaaattagaaactcccccagccacccactgtcctccctggaggccactgctggtcctagtttcttgtgtctggttccagggcaatttacgtgtgttcagacacatgaaaattcgtgtatttatctcccctccccaacacaaatggaagtacaccatacagcccctcaccctttctcactttccagactgtgagaaatgattccaaatcagctacttcagtactgcttcaggactttatttattcatttatttaggttttctgagatgggatctcacgctgttgcccaggctggagtgcagtggcacaatcacagctcactacaacctagaactcacaggctcaggagatcctcccaccttagcctcctgagtagcgcatgccaccacacctggctaatttttgtattttttgtagagatgtgctcatcatgttgcctgggctggtcttgaactcctgggcctccaaagatccacccactttggcctcctagagtgctgggattacaggcgtgagccaccatgcccagcccccttatcccagcctttatcagtagcgttgactatgccctctctcccctctcatagccagccaggcagcaggtgcctgtagcttctagaaaacaaccaggtagatggggaatgtggatgtgggagagccaggaccctctagcccagtggcttggtgtgggattttaaattgcataggtctggatttgaatcccagctctgccacttgctggctgtgtgaccgtgagcaagtgtcttaacctctctgagtataggttttcttgcctgtgcaatgaggatggttgaggactccctgcaggatccctaggaaggtgacacaagtgctctgtgtgtggagcaccccgcctagtcaccggtgctcagcggagttttgattgtggtggcaccagaggtctgctccctgtcacaggcctaggggcaggaggaaggggagaggagagcgggacagagcctgcttctctgcccctgtggcatccatcccagatgagcaaatggctctcagcagggcatggggaacggaatctctttctggctggcggtggctggccagcctcagggcagctgccctgttcccagatctggggttccaggctgggtggctgaggcgggcggtcaggcggggcctgggcagctgacagggcctctgggggcgggggtgggggtaggaggccagctgtagtcctggagcagcagagagccaactcagactttaacccattccagtcctgcggggatggctgctcttctgggcccggaaatggctcccttttctttcagtagcctcgtttgccctgtgagctccttgtctgaccagggggtcggcagcctgcagtgcaaggactgtatttggactgctagaagtttggtcagcctgtcttaaaattggaatggttcctataaatattcagatctctggcctccctggagaaaccagaaaatgggaccctgctaagcacactctgggtggcagcgtgggctgggttgggggtagagtggtgccattgtctcctccacccccagtgtttatttctggtacctacctatttcccctgcgatcatttgagatcccatcaaggccaactctaactcctctcctagctgagccttgactttcttgggggtctctctaccgctgcttggtcccctcccatgccgggagcctcactacccccaagcagacctcccctcattgcctctgctgatagcgtcccatctgtttcttcttgaaatcgtcccatctgtttcttcttgaaatctttctgtagtgccttccactggttggtcccggtttgaccccttgaggccacacagccagcgcagtctgtcttctctgtgacagcccttcagatgcctgaagacagctctgagggccccctgagcctgcccctctgggctgaacagcatcagttccttcacttcccctcccaagatgtggtttcaagaccccccattaccctgatgcccctccttagccacatcctcgtgggcccgtgaacttcttgtggccggactctcagcgctgccctgcacaccccgagggcctcaagaccactcagacatgccccaggtcccatttgtgttgaaggagagaaagtgtaaatgcacagaaagtgtccggtagggccgactgccctcaaatacccatggcatttccgagaggggcattataggtggttttatttttccctgagtactcacctgtatttatttatttttcctataatctggaagattaaaaaagtaacaaagcaaagggcttgcgatgaattcattttaatcaactcatggcagttgtctgtggagacgaggccctgagctgggagtgaggggcaaggaggaggaacagggtggggctgtccctcagggagctcacagcataggggaccctgatgcgcccaggggtctcagctgagtcgggccctcagagaggattatggggaccagagaaggaggcgtctgtttatccagggatctgggaaggcctcttggatagcagaggtctggtgggggcctccaacatggcaggggtgttttgggtaatgagagcagcagtggcagaggtcctgagacaggaaggtggttgcctggaagggagcaggtgggtgcatggcttggagcatcaggaggtaagaagggtgtgtggcagggctgggggcaaggggctggcagaggcccctctctggctgtcctctttggggtgaggagtctgtgagtctgggaacgtgttctttcttctagattatctccaggtgccaggactcccccagcctccccgaccccagaccaccctggacctctggggcctctccctgtgtttgtcttcccaagggtggaccaagccttcagtgtgcatatccccaggccaaagagtggggaaggggtgctgtcagcaggaaatggggcctgggcagacctttgacacatggttgcccctgtcctcgagggaaggagctgggggtgggaggaaaaaatgggtgggcgcaggctgggggcctgggtcctgacagctgggcgagctctcactctcatgcggttcataaggcttcccctggtgtcctgctaagagctcccgggtggaccctccagccccagaccccctggtgtctttgtttccagtctcaggagcaggcttcagatgcctcagggcttggtggaggcactttggaggccatcagaagtgggagcaggaatgcttttaccagctgtgctaacccacccgggggtccccacctctcccctctgggagccagcatgtggtctgctatgggaggatgaggcagccacatctgttctcgcaggtgcagagcggagcctctgggacctttctctcggattctccttttccccaaagtccccctctcgccttcttgggggttccaggaccagcaggacctgggtgtgagttccactacacacaggctgcactggcttgtgtgtagtggaacacaaggcttctctgagacctctctgcctgggtggggagattgaacctgctgccgcccgctggagcatagcagtgtgggtgacacacagagcatgggaccactgcagcctatgccgctttgcacgaggcagcttttccaagggcccccagggccgggccggcccctgccagccgtggaccagatgtgctttttctgatggtgtgggagagcttctctgtgtgggtgtcctcgcattatgtgtgggccgctatgttttgatcgaagggagccaaactgattttcctggcccatctctccgccattcgaagcagaaagttaaataaacacaaccaagtattatcgcaggacacgcggaaaatgaacttggtccctacgggtggccacatctggcaagtgtggggccgtgcagggctatgggatgagacagatgtggttggggcaggaagggctcagtgtgccccctgctcggggacgtgcctcctgccaggggctctggccctcagtggtatcctttcccattgctgaacctttctgaggccgtgtcttctggcttggcttcccctgagccttgccgcagcctggtgggtctctctggccctgtctggtgtgcgtagggaatgcacagctggagtccctgggccatgggggcaggtggtcaggtgcacttgggaaatagtcacacttgtcgtgatttccacccctctccacccctctgctaacggccctggggggtggatgagccacaggttttgggagtacttcactgcttgccagagtgtgtagccagcatgtcccccgcccctcccactgtcctctgcccagcactgcccttggcatgcaacactcagcccttgctgaactccagtgggctgagtgggttcccggagatccatttaggacaactgacatgcacctctttatcagaggtgcccagcacttctcatgcccactgtccccaaaatgggacattgcaccggaggcttgtgggattcaggtggctgataggtgaatggttctcttttcttcatacttatatatatttattccttcatctgttaggaacatgttacttcttatgtttattttattgtctattagaaaaattgggcctggcataatggctcacatctgtaatcccagtgcttccaggggccaaggcaggagaattgcttgaggccaggagttcaagaccagcctagacaacatggtaaaaccctgtctctacaaaaaattaaaaaattaggtaggtgtggtagtgcacatctgtagtcccagctactcaggaggctatggtgggaggatggtttgagcccaggagctcgaagctgcacttagctatgatgcagccactgcactccagccttggtgacagagcaagattttgtccctataaaagaaaaaaaaaaagaaagaaaaattgttactagcacaccaaatgtgtgatttcttgagtaacgctgcttagggagaagctagaaaaaaaggaatgtaagaaaaagcagggagttgatgggaagaaaagcatcccgtgactctgagtgccagaggtgtgtcctcctggcaggagttgtctggggaggtccctgccagccccggggcagggacagtggagaggctgagttgctgctctggagcctgtgcccaggcagaccctgtcacggcccctgggatggttggcatgcttagtgaaggttttggggttgtcttgggatggcaggcaggtttggattagggagggcctgccttggtgggaccagctgccaggtggagctgcctggggtcccccaaaggccttttccacatgcaagctccccacggtgggtgggcaatggggccaagtcgggagcacatctgtgccagtgaaatgtccccctcccaaatcagacattaaaaatacaaactccttaagccgtgaagtattgtgcttgcccctaccccggggtgtctttgtggaatgaaaaagtgtttggaaccagacattacagttcgtttctgtggaaggtttgggcttttattttgtattttttgttttttttttgagacggaatattgctctgtcgcctaggctggagtgcagtgggctatctccactcactgcaagctctgcctcccgggttcacgccattctcctgcctcagcctcccgagtagctaggactacaggtgcccgccaccacgcccggctaattttttgtatttttagtagagatggggtttcaccgcattagccaggatggtctcgatctcctgacctcatgatccgcctgcctcagcctcccaaagtgctggaattacaggcgtgagccaccgcccccggcctggcttgggcttttaatatgaaagagaaggaagataatgtgtgtggagttagtactgctgtagtgtatgtttaacattgctaaaatggtacattttatgctgtgcactttttttttttttttggagtcagagtcttgctctgtcctccaggctggagtgcaatggcacgatctcggctcgctgcaacctctacctcccgggttcaagcgattctcctgcctcagcctccccagtagctgggattacagacgtgcgctaccatacccagctgatttttgtatttttagtagagacggggtttcaccatgttgtccaggctggtcttgaactcctgaccttgtgatctgcctgccttggcctcccaaagtgctgggattacaggcgtgagtcacagcgcctggcctgctgtgcattttttttttttaaccacaaaaaaagtatgaggaagaagagcaatgtgtaaaaagagagatggatgggtgatctgtgtgttcagaaccagatggaagcacacacacacacgtcatacatacacaaatcagttttcaatgacagactcagtttcctctgctcgtgtttaaaataaaccacatgtataaccaggaactgacatttatttacagtatgttagcacagaggacaagctgttaaggggttgtaaaaaaacattagtttctactttatagtgctttttcttcaaatgaaagtggaaagaaggaaagagagtggggtgccgatcttacctgcttcttcctttccacccgaaacagcaaacagacctgggcagatgtgggtcctctgtaccataccctgagtgaggggctgggccccaggctgatgtgcccactgtcaggttcctgaagtacaggctgccactttcatctggcggttgtgtgggctgttgtgtggcccctccctggggggctggggtgccccccgctccaccaccttccatcagcatttcccagctggtgggcgagagcccagtgttgcccccgaaacaggatgcaggagccagaccccattgtaaatccacgtttatatgctgcacgtttctggttaacgagaccatgcagagatgactgtatgaaatgaaatacatgtatgaacgaggagattaacctcagggagagatgggattaaacgagagggcagcccgggaggccgggggccctccctgttaaggtccaggcaggcggttccccagaaagggaattttccgcacacattgcaaccctggatggactggctgggggcacagaagcaatcatcctatttcgtgttgctcgttggacgccaggcactaagctgagatctttacctgtgttatttcactttgtctttaaaataaatggaattttttaaatccccattttatagatgtggaaataaagactcgaagagtccattacccaaggttacacagcaagcaacaggtggagtttatgatcaacgtgggctggcacacccaatactgacctctgcagactggtcactggagggttcagaaaaaaggagtcatttcaacccttacctgcctggcgagctttgccttattttgagaaggtacaggcaatctgggaagtttggccagttaattactgtttgttttgaaggggccgagagaggcaggatggcctggtgaacttcagagccatgtagacccagcttcaaatctgggctccatctccctctgcttccataatttggtccacttaaaaaaattagtttagcccctggtttttccacctgtaagatgagtacctgcttttgtagggccattgggagtatcagcatgaacgtggtaacgtgtgaagaggtggctcagtgtgttctcactacaggtatgtgatggttgtctctagtgtctctgatgtgcacagtctgctgccaagtgaactggaaggtgggagaaagaggagatggagagactttccctaaaggggctgagagtatggttgtgggcaacatataatgctgtgggatcttgggaggctgaggcaggtggatcacctgaggtcaggagttcgagaccagttctggccagcatagtgaaaccccatctctactaaatatacaaaaattagctgggtgcggtggtgggcacctgtaatcccagctacttgggaggctgaggcaggagaattgcttgaacccaggaggtggaggttgcaatgagtcgagaccaggccactgcactccagcctgggggacagagtaagtaagactctgtctcaaaaaaaaaaaaaaaaaaaaaagctgtgggatcagggtttccatttgccaggcactgggtattgggtcctgaaccatgcactttatacacaccatcttgtttgatcttcagagctaccttgcagggttggtgtgcacagggttggtgtgttacctgatttgcccaagtcacacagcaaaatatggtggattgggatttgatcctaaggcatcttgcttcaattacaccctgctgcaggtgagaactaacttcagtccatggctggagaagacttcttggaggaggtgaccttgagctctggtcagtgtttctgaccaggagaggaggtggccttgtagcctgtggtcaggctgactctggggacatggatgagaagctggaagccctgggcctgttcccaggtctcctcataagccggatcccaggtgatgctagactgggtggggcgaggctacctagatttcctctagtattgatttctttgcttagttaaattcaatttgattagatttttttctgaactttacttttgagcaggaaaacttgcttacattaaaaaagagacccatggacttttaagattttgtccacaattatcattcttcctgaaaatgggatttgcatattagtgtaaaaaaatcagaattttaactctgattgaagtagaaactcatctgaaggcggggcgcagtgcctcaggcctgtaatcccagcactttgggaggccgagatgggcagatcacctgaggtcaggagttcaagaccagcctagccaacatggtgaaaccccatctctactaaaaatacaaaattagctgggcgtagtggcgggcatctgtaatctcagttactggggaggctgaggcaggagaatcacttgaatccgggaggtggaggatgcagtgagtcgagatctcaccactgcactccagcctgggtgacagagggagactctgtcaaaaaaaaaaaaaaaaaaaaaagaaactcatcctagccctgggccggttccccacccctgagtctgctctggggctatggctatggagacagagaccccaccttgagctctgcctttccccttccctagctccctgcccctcccttgtgtctgcactccaggtcctctacttggttttgtcttgttctgagtttgggatgcatttagcaacctccagcataccgtagtttgttcattcattcactcactcagctcctgtgtgccagcccttgaaggggcacagtgatgggtaacacttgtcactgtggattcaccatctagtggttgaaggtcaaaacccagcttccttttctcatctctctcatgctacctagcgcagacttctaggtagtctagaggtgctcagtgcttgttaaaggaggaaatagccaaatgcctcctggtagtgtatcccaaaagcctaaaaatgggtacactctttgtcctagcaatcaagcttctgacctaaggaatattatcgaacaggcttgtgaccatacatgtgttgcagcgtggattctcttacaggaggagacagctggaaatagcctggctatccagcaacaggatattggttatttggagcctcctgtgatgggactcaggccatcattgataatagtgttggtctccgtttatttttattttttatttttttgagacaaggtctggctgtgtcactcaggctagagtgcagtggtgccatcataactcactgcagccttgacttcctgggctcaagtgatcctcctgcctcagcctcctgagtagctgcgactacacatgcatgccaccatgcccagctaattttttttttatttttctgtagagacggaatctcgatatgttgcctaggctggtctcgaactcctggcctcaagtgatcctcccaccttggcctcccaaaaccctggaattgcaagtgtgagccatcgggctggtccttggtctctgtttttgatgtgaaaggatgttcactgggtactgctgagttagaaaagcggaatacagagcactacctgtttttaatgttgtaacaatgtatttacatactggaaagttgtgcttttactttcttcattttaactcacatgtattccctagttttctacgttgtacatggattacttatgtcagaaacttttacagaaagaaagagacgtttgttctaggaaacaataagcaaagggccacttggagtgaattctgtgtttctgacatatttggaacataggggcaaagcctaggcagggcaggtggggtgggtgggagagctggggtctctgcagcgtcctaggctgccaaagccccttctctccttcctcctcctcctgtgacactgtgcctttgtcccatggtgcgctgatcgtgcacatttattctgctcagcagtgtcctgtttggtagcttgatgttggctgcagtgggggcatttacactgcagaaagtggcaaaccctacaaaccagagcctcttgttctcctggatagccccctgttagacattgaccagcacaccattgtctctcatggtttcaccccaaggaccttgagtgcttagggagacccaagagatgaactctcctcttcttagggtctcctggggctggcacagggagggacctaaggatcttaaggatcatgggagcggggcagagtgagagagagtgagagtccagtcctatgttgactgatcctactcaatctggaaccagacctgctgcctgttggaggccgaagtaaaatcaaggggttaagaattctactcccagctgggcatggtggctcactcctgtaatcccagcactttgggaggctgaggcgggaggattgcttgaggccaggagttcaagaccagcctggccacacagtgagacgcatctgaaaaaaattaaaaattaactgactgggtataatggcatgttcctctagtctcagctacttggggggctgaagtgggaggatcacttgagcccaggagtttgaggctgcagtgagctctgatcacaccaccgcactccagcctgggtaacagaacaaggctgtatctctaaaaaaataaaaatccagtcctggctataccccatcctagctccatgacttttgacaaattgcttaaccttagttttctcatctgtaaaatggggttaataaatgtacttactcataggttctcaaacttaagcacgcatcaaagtcatttgttggttttgcaaaaacacagattcctgagtcccaccctcagatattctgattttgtaggtctgggatggggtctgggattctgcatttccaacaagctcctaggtaatgctgctattgctggtctggaaactatattctgagaattactttgtgcaaccgaagtgcacatcacagtgtgtggcacaggtgagggctcagttgcacttcactgcttattcagaggtgggcagcattgtccaggagtattccagggcctgaaagctagaatgccgggttctgagtctgcttttgccgcctcgtctgggcccccaggtgagctatttctcttatttgggactctattcttccttctttgaaatgggtcagtaaagccctgactttcaggcaggagctgaggaaacatctgtaaaagcctccagtgccagacagttctggtgcagggtggtggggaaggacgtgagggacctgggccaggctggcgtctgtctcctcacccacgtgggaccagcacagagaggcaggctgtggcagggcacgctctcctcagtcccccggggctgccaacgtacccaggcttggctcctcttctgacagagctgcgagggactgttttagaagaagaaaaaagacattgttttaattcacgtgggttcctgcctttgcgatgttgtcttcagttcttctcagttcctgattctggctttccactaacattgccacatcaggtggctttgtgatattcagtttccttttcttttcctaccccatggctgggctggaccaggacagaacgaggggtgaatggctgggtgttcacggctcccctttttccttcccttccctgttttgcctttgagctgaagccatgcttggaaacatctgccctggcctgggattccgtggctggcatctggacaaatgctgtggctccctggggctttgtttcctcaccagaaaagtgaggattttaagggctccctctgagggggcctgggaggatggaaggggagccagtatgtgggatacccggcactgtgccagatgccacttgggctcagtgaagggtggcctttcctgctcacattgggcacatcctcaagtgtgtgcgcaggagtgtgtgtgtgtgtgtgtgtgtgtcatgtccaggtgcttgcagggaagttctatggaccagaacagagaaacccaagattttaaccctcgctgttgagacttttgaagctgcatctgtgccaatttagagaaagaaccccgatcagttggcaatatctatggtgggtgcaagatagaggagctggggcaggtgttccacatgtgtgctgtcctgggtctagtggaaaaacccttttcctagtacttagagaaaactcccaaggagggaggatcatgtgaggccaggagtttgagaccagtctgggcaacatagtgagaccccatctctacagaaaaatatctttttttttttttttgagacagagcctcattctgtcacccaggttggagtgcagtggcacaatctctgctcactgcaacccctgcctcccagggtcaagtgcatctcatatctcagcctttcaagtagctgggattacaagtgtgcatccatatgcccagctaatttttgcattttttgtagagacagggttttgccatgttggccaggctggtctcgaactcctagcctcaagtgatctgcttcccaaagtgctgggattataggtgtgagctcccacgcttggccagaaaaatataacaattaaccaggagtaatggtgcgtgcttgtggtcctagctacgcaggaggctgaggcaggaggatcccttgagcccaggagtttgaggccgcagtgagccaagatgttaccattgcactccagcctgaatgacacagtgagaacctgtcttaaaaaataaaataaaccaaaacaaaacaaagaaaacttcaagtgtttcacactcattgtcctattttacacatcatcatcatcatcatgtttttattagggaaagatggaggagaggagtcacctttctgcagagttgccgaagatatagattttactggggttagtgtctgcttcttctgcagagatctcctagcctttctcttttggggtgatcatggggaataggagggtgagagggagatgagctggcacagaagctgagccccttggctgtcacctccaaatagtcccacatttagggacaccatccctgcactgtagtgggaacaggaaagcagtgatgctgaggcatctgtggctctagctgggcattcctgtgggtggggcggggtgggctaaatcgcagtgggaaatttgatctcactgctcaaaactcagctctcctgtctttccagggagagtgaaacctcagcagccagccaggaacctggcgggagaaggggagcttgaattatcccagtaacatgagctcacattgattgcatgtttccctggagctaagtgctttggggtatcatctcatttggtcctctccaacctcctgcgaggttggtattctgattatccccattttacagagacagaagatcagggtggatcgagtctctggcctgagatctgatggcctgcaagtgatcacttgggggacagcagcctattccagagcccacttcccacacccctacattttatagtgtctctccaggttccctcctctacctcacagccatagctagatgagctctgctgcgtgacttctgcaagggtcacttttcctgtaaggacagatgaatttactttttggaattcttggattattccctggtgtctttctgttctattttatatatagcaaggcaaggagaggaaggggcacagtggctaagcaaggtttaggcttttagcccctctgcctacaattctccagggcaacagtttatgaggagtctgtagtagcgtggcagcttccagaggtgctggttctaaagtcagtttaaggagaaagtcaagcattgccaaaattgcctgttatacaagcgccgacgtggagacccactgaccatctatcagtaattcttaacaatggtttttcttcacacattggaatattctgctttaatttttttaaaaaaaattgtatgtatttatttttaaaaagtactagattggttagaagatttctggttaggagttgtgttgtctgaaaacaggcttcttttttattttgttttgtttctgagacagagtcttgctctgtcacccagactggagtgcagtggtgtgatcttggctcactgcaacctctgcctcctgggttcaggcaattcttgtgcctcagccttctgagtagctgggattataggtgtgcatcatcacacccagctaatttttgtatttctagcagagatggggtttcattatgttggccaggttggtctcaaactcctgagctcaagccatctgcccacctcagcctccataagtgttgggattacaggcatgagcctctgcacctggccttctttcttcttttaacagatagggtcttgctgtatcacccaggctgaagtgcagtgatgtgatcatagctcactgcagcctcgaactcctgggctcaagtgatcctcccatctcagcctcccgagttgctgggatgacaggcacataccaccatgtctggttactttttaaattttttatggagatagtatcttgctatgttgccctggctggcctggaactccttggctcaagcaatcgtcctgccttggcctcccaaagtgctggtatcataggtgtgagtgactgtgcctggcctaaaaaatcggtttctttaaatactagacccagcctccttttggtgagatgcccatatattggggggcagggtgtggacagagagacccatgagacagagccagagggtcctgtccctttcactctcacttcagggcataatggcaggcgatcttacctgtgctgttgaaacagcttgttctcttttcagcaagtggtcagggtgaatcacgggagttaaacaaaggtgattgtgatgtgactgtcatattgtggcttttctgatggtctgagcttggtgccaaggggcctgtcagtggaggtgttgggtggttttagctttagctgcagggagccttggcttttgcatgcaatcacccccaccccacccactgcctgaacacatcgccacctgaaaggagcctggaggatgtgggcttcctcgttgggtttgtctgcacttgaccctggtcatttgacctaggagcgtgatgccaaagatgatcttgggctgtagaaaagtgattggctatgcttttgtgcaaaggaatgggcacccctttctctgggcattcacagccctgcaccaggacacagtgctgggtagacagagtgtgggtcacatttcagctctttctcgccacctttgcttggccttctgtgcagtgcttggcctataccgctctacctgcttggcctccctgcctggtctatgcttttccattcctggaggttgctcagtagtaagtcagaagcagtgatgctctgtttcatgcttgacaatgagacttgggtctctcgctgtcccctttacctgttgtggccttggcctgcagtgtgtgagagggtttccctaaggttgagctaaggaggggcagtcacgtgccccttgcctggccaccacctctgctgggacagggatgtctctggggaggcatgggatgttgtaagggtgggacgggccagcaaagcatggggaggtttcccaaggccttggggaaagtagctgagaacactttgcaaatgagagccattggtctatgggtgcttaaagttattttgggggtggaggtggttctagatcttctgatgaaatctatggatcctttccccagaacagtgcccttttgtgcctgtgcacagcagctcacacccagagccttcttccagccttcaagccaggctgagcaagtggccccagcatggattttggagttcagaaaggagcattctgggttcttccctggccctactagaggcctcctctgacccttggaccagcactagcctctgtttgtctctcattcacctcctgccactgtctgcctcagaatctgtcccccgagctttcctgcctttgacctgaaccttctctgccaaaacacatcttgcctgactttgacaaactcctgagcagggccccagccctgtctgggccccactgctgtgttctgggccctttttccagaccccatgcccagctttcaccttccctttctgtttccctctccagctccatctcttctgcctctgtgaggtgttggggagccctctgggtggagggcattactctccaggccaggagcaagtgacctggaggaggtggtgcatgcaggtgtctgcctagtgccacttgctctgtgccactggatatctgaaatccagaggcctggcacacaagggatctcggtggtggcaaggcctgtgctagtgcacaggggacgagctgtggccaatcccagagcaggagagttgtagctacttatgcacctgctgtggagttggggcgacagcattagggggagctctatactcccattcgtcaatcagcctcccacaacttctgaccccagagctgagagtcaacgtggagtcctgatctgcctgaagccctggcagagccccagaatccttcttaatgcaccccaggaaccatggttaatagtgagagctggtcttagacctgctgccaccaagcaggcgccctctaagggccctctggcctctttgagccccttcttgtccattgttgaggatcttgactcacacagggaactggaagccccccaggacttcagagatggccgcaaacaccctttctcttaacaggatgtgttcgggtgctcctttgaagggctttctgcagcagcccttgtccagaggctgctggacgttgcccatcagtctccacagcttggggggattatcccaggacagctgggagtcttaagattgagcccgttcctacctccctgtgtagccccctccatccctgtgggggcggggcctccaaggccctgtccggtgaagtgttttagcaggagctcctcgcagggctactgtggtgcccttgggcccttccagggccacctgattgttgaggtcacactcagccctgggaaggatcccatctctgatgagcgatgatgattcccattgcatgggcaggaagaactccctgctccatccactctgtaactggattctgtggccagagttttctgttcagtgcctgcctgaccccaggcaggagtggtttgtgctcaaggccggggcaagtgtgagcgccatgagggagctggattggcatgtgtgaccttctgctcccagagctggtgtgactctagtgtgatggggtggggacagtggtggcgtggaggggacaggtgtgtctgtggctgccttgcccactgcctggttctgaacaaagcccatccctgctgcaggccctctgggatgtcaccacacatcctgtgtgcttattgattaaaaatttgggccgggtgcagtgactcatgcctgtaatcccagcactttgggaggctgaggcaggtggataacctgaggtcaggagttcaagaccagcctggctaacatggtgaagccccgtttctactacaaatacaaaatttagccgggcatggtgataagcgcctgtaatcccagctactcgggaggctgaggcaggagaattgcttgggaggcagaggttgcagtgagctgagatcacactattgtaccccagcctgggtgacaagagtgagactctgtttccaaaaataaaatttttgttttttgttgagcacctgctactatgtttgcactgagctaggcactgggatacaacaatgaacaagacaggcattgtccatgccctagtgagggaggcagataaaagcctaggaaaccaataggtggaaggaataatgagaggtgttcgggttagcaggggctaagccggaagctgccctgcaaggtcaggtctgggaatcacgagcaggagctggtagaccatggggcaggagtgggcagctgcagcctggccatgtgacctgggccactccagagcctttctgcatctcacacatgagcgtgtgcatgcctgcacgtgtgcttgaacagagggtactcgaagtccactgcctggccccagcacagagcttgtgtggggggccgtatggctgaaacaactgggggagtcctttgagacaaagagtgcaaaatgcctgtggccattctcaaggtgaccgacaggagaggaaatgggatggaagagagtttggagtagatagaaaaagtgggctaggtgcagtggctcacacctgtaaccccagcactttaggaggccaaggtgggagggttgcttgaggtcaggagttcaagaccagcctgggcaacatggcaaaaacctgtctccacaaaaaaaaaaaaacaaaaacaaaaacaaacaaaaaaaactacaaaaatccaccgggcgtggtggcatgtgcctgtggctccagctgctcgggaggctgaggcaggagaatcaccttagccaggaggttgtgcctgcagtgagctgtgatcacaccactgcactccagcctagacaacagagaaagaccccatctcagagagcgagagagagagagagagagagagagacagagacagacagagacagagaggtcttaagtaggtaacagatctttcctttgcaaaggttacaaaacatgtagggctacagaaccccactgctgggacccctcccagtgtgcagaggggcttgagtttgcaaagggctctggagctggggcttcattagcatcgtggtgaatcgggctctgccatgtgccccctccctgtgtattcacatccaccctgcatgccctccttgtgtgcatacacctgccctcatgcctccgctctgtgtcacacacttgcccctatgcctctgctctgtgtcacacacttgcccccatgcctcctctctgtgtgcacacacttgcttcacgtgctgtccctatgccggtataccctgtgcaccctccagtgtgggcacaccctggccacccacctaccttacaaatgcccatcatccacaggagtactgtgttccccttgaagtggggtagggtggggtgtgtatctcttggcttcagtggggccaattattgtatacattaaacaactagacatggagctagggacgtctggaggaggcgccgcgggccggccaagtagcccctttggtgtgttgtccctatcggcccctgtgcggattggggtttctctgagctgcgagtcttcagtgtgcagtggggctcggcagcagaactccctcttagggatgttgggggctcgctgcttgggcccccagagagtgcctgctgccagtgtgggttggggccacctgtccccagctccagttgcagacgggccctccttcctctgtgcctgctgcccctgcttagtgatgccattgctggagatccagtctggacagaagagtgcagctgtggggagaaaaaaacctcacactcattgctgggtagcacagggccttatgggggtggtggggggttgggtgttgactctttctcatcaagaatgtataaaaaccaggcgtggtggctcatgcctgtaaccccagtgctttgggaggctgaggtggagatcacttgagcccaggagtttgagaccagcctgagcaacatagcaagaccttgtctctataaaaagtataaaaataaaaaaattagccagatgaagtggcacacgcttatagtcttagctatgcaggaggcttcggtgggaggatcacttgagcccaggaagtcaagactgagaagtgagctatgatcgcaccactgcactccagcctgtacaacagagcatgagcctgtctcataaaacaatcctctagcccatattctgtttttgtttttctgttttttgaatcctctagcccatattcacctttgaaggtgtgcttctaccttcaaaaaacagaatatgggctagaggagggcatgtgagtggggtggtgcctgcagttgtaggaaaacgcattaacacccaagtcgtaagtaaggtgacccacagatccctcaccacacagggatgtggttccagggactgcattgtgtcatgcggctgcttgcagtgagggaccaggaagcctgtagtgagatctgccactctggacctccccagccagttagcactgggccactttcctcctctttccacccctgcaggcctgtctggacttctgggacccagcacagagctttgatttcccccagagctccaaaatgttgggtgtttccctgttctctttcccattatggccgaggccagatcttcctaagaggatgacttgacatctttggggcatcctcaagttcagtgacttgggtggtcacacttcttaactaaaccaccttgagtgggtgtaagtgtgcagactatttgtcctgatacctgggtgcacagaggtcagaggagaactggggtcatgtattaatgccctgatacctgcagatgactaaatcaataaaagaaaaagaaaaaaaaatcaaaaagaaactctgtatccttagctatcacccctaccttcctacccctcccagccccaggcaaccaccgatccactttctttctttttttttttttttttttgagatggagtctcgttctgttgtgcccaggctgagagcagtggtgcagtatcagctcactgcagtctccagctcccaggttcaggcaattctcttgccttagcctcccgagtagctgagactacaggcatgcaccaccatgcctggctaagttttgtatttttagtagagatggggtttcaccatgttggccaagctggcctcgaactcctgacctcaagtgatctgcttgccttggcctcccaaagtgctgagattacaggcataaaccactgtgttcggccctggacatgtctttttaatgcactcaaaagggattctgctgaacatattttttgtgctttttctttcaaatttaacatatctgacctctttatcagctcatatacctttacgtcattcttaaggtttagggacccatggagaccttgtggaaggtgtctaacaaaatggcagcatggtaaccttgcacactggcagcagtctcttaatagaagcaccatatatttacatgtgtgcgtgtaagtaaaagatgaaatgtaagggaaactgattttttggcatagcattgaatgctgttaacaacagctccttccgtgcatggcccgcttctgatggctttaggcattagccacccatgttttggaggctgtctggttggaatcattttagtgaataatatcaattttgtctgacacgaggtcttgattgctatttataaagctgcacatttgaaaacccaccccagctgtaactagctaagtaaaacaatagcttgggtcccagctcaaattatctgtgcatttcattgtcttgatcctgcctgtccactctcaggatgcgggcttggaaaagagagcacacttcattagcattccttggctagttgctcgtggatgttccctcttgcatgtgctgtttctcagggttcagagaaacccattctgtgaggctttggggaggaggaagaccatggttacatagtcaagggggtagattgcaccatgtagagcaccacgtagagcaggactgtttgagttgtggcatcgacccccactcggttggttgggccactgttctagcagatgacagccctgacattattatgggggcagttaccctgtgccggcacagtgcccaatgctgcacagacgttatcccatttaatcctcccagcagccctatggcttaggtaccgttattttctccatttttgaagtgggaaaacagaaacccagaggttagatcatttgctcaggtcatatacagctagtaagaggcagagctgagatttgaaggtgggctgtgccttgcgctagaactcaggttctgaccacaagccagcctgcttgctccactcgcaaggtggctgcctgcgtgttgtacatgccttccatgtggtgggttggggtcactgccctccagcctgagttgctagggttctggatagcatcctttgtaccccggtcaacagtggttttcaaagcaaccttggagacagacaaccctgggtttgagcccaaactcttcgtggctctcactacctgtaagacctcagacacccctctgagagtccgttgaggaagacgaaacccagtgatggctgcaaagccccagcacagtgcctggctcagtgtgcacccacgtggtgccagcaagaacatcgacagtgcagagagaactgggtggttcatggtggcttcagcctgcacatatgcagagctagaaaggccattaaatctgaaaaatactgtgtatgcacatttttggcttaaacaaagttccatttacaaagtccataacccagctttaatattattacatgccccagactgggattaattccaggacaagagtgttgttatgctgtgtagtgtttctcccatattctcctagtgcatggcctctaccagcctgggcttatgtcctggggtgtgggatggtggggacaccctatctctgcccagcttggttctgtggggtcctgggtggaatgggggggaggctggttgccttctgatgttgtcagctcatgagttgcagtgctcagacgtgctgtcattgggagagttgacctcagcgtgtcctgaggtctatctgtgggtcaggtctcagcagggtcatgagcactcaccactttgctgatctctgagagcaaccttattggtttcttgaggcagtgctgagattgattagtgatgtctgccaggggcacagggctggggaaaccataactgatccagcacttaacttgcttgctattcctgttttattccgatcattttacatctctgtgaaaccaataaaggcctctttgtaggctttgccccctctcccctggtgatgggtattataataaggacccccacaaatgttccttcttcctcgccctgtgccttacctgatctatttgtacagccttcaaactcacaggcccatctctgttctctctttcagttgaagagggggaggcctcagacttctcgctggcctgggattcctccgtgacagcagcaggtaaatgcccgggggctggtggaagagttgcagggggtcctgggggctggcccaggaactcagaaagccacccagctggttatggaaatgatattcttcgtgtcacattcctgcctccaatccagactaccccatgcaacacgatttttatatcagttccatatggtcaataaaatctattacatacggagactaatattcccttattctcccgagggccacatttccttcttgtggctacagttcagatgggcagtgattttcccactgcacaagccttgaagctccctgctatgggcgtcactgcacattcattccaatctaattgcataaaagccactttaataggacttttaaactccagtctacatcagaattcctctttccctccctggaaggggctgctctgcattctcagggctggcagagctgagctcatgcctccagggagaggtaatagagggagctcagactcgtggggtgtcgggggtgacgtgacagtcaggatccccgcataagctctttcctgtacctctgtttcttagctgtaaaaagaggtggatgagtaaagtttttctgactgtgaagttttgtagcttggagccttcccatgagtactgagattagaactggctttgagaggtctttgggagctcctgaatgagggcccacgctctcctgtttgctcctcatgcagccagggcctctcttggcagtgatgcccctggctccctgtccggcaggcgccgggatccccttccttgtcctcctcccctgccttgggccaggcctgccctgggatcctgaccagctttttctggatttgtgggggagctggagctgcttcagtcttgcagaatcctaaggcctgaggaggcctatgagggaacattcagtccaagcttctcctcttttagttgtggaaactgaagcaggaagagagatttgctctgggtcagtatttcagaaacgcggttaggcatcaggtatataaacatttaatgttttcatggttatgtgtctaatgtgtggtattatagacatttgtgacttacgatgatgctaaattcatttaagtgaaaaaactgagttgacaagaaagtgttaatagtacagaatacggagactcagcgggaagcttgaagatggttcaatgaaatttgggaaaggagactaagcccttgaacccaagcctgtggcccctggttccgtgtcctttccagcaggagctaatgctgcctgcagagtctccagggtcctggttgacccaggcttgggcactgttgtggctgcaggtgccctggcccttggtgacaggggcttcctccatagagaggggccttgtctgaagccaacgtggtaagtggtgctcaaattctagggaggagggtccaggactaggacaggccttggggtcagcactgggcagataggaggctgggggaaggggctgtgtagccccccgtgtgtctccttctgtgcggggagtgcgttccccatggttggcggaaacagcaaggccataaggcgccgtgtctcagacatgtagtcctcctgagagacgaggggtgcaggggctcaggcttgctgcccgctctagagaggatcccactgtaggaacccctgaactaggaaagcactcagcccagtgttgtctacagaaggtcctccttcccagctgctttcccggtggggctggaggtgatgcagacagatgggaacagcagtggcgtgcaaggagggtgctggcagtgattgctatagacagacagccctgggcagggggggtgtcaagcaccccagctgcatcccctaggcagtgaggtgtctcccagcttgcagaaggcaagggtggtgttggtgctagggaactgggttctgtagttctgtaattccatagttgggcagccagtcttagggcctctctggggtgcctgggagtagtgggagctgtgggatttgccagtttccaggcaagagctgagcatgcctcgtgcatgtaggaggatgcacactccttgtgactccatggccgtggctcgccacggtgccagtttcggattctctgctcagctatggggagagggagggcagagcatccctggcagtggataatccacagccagacagccaggccaggaattgttttgttttctttggctcatttttgctggtgttttttctttttttttcttttttttaatagtttgtgctgtgcatgtgtaaattttccttcccagttctattggaattgggctattaaagtcagcttttattccctgagcactgggcgtgtgagacggctccaagcctgggtggcaggcggaagtcagtgtgggaggtagccctggacgtgggcgatgtcacatttattgagcacttacttagtgcatgccaggcactgagtgaagactctacctgcagcatctcgctgagccatcgtgacagctctgtgaggtgggtgccacttccagcagcagctccataatttctctgtgggcttggtttagggacagccatctggttgacaccagggccaaaggcctggtgaaagctgcttttgtctaatacttttcattaaactgagaaaatgtcacttggccacatcagagaatggcagcagatgccaaagaagattatgggggagcaaaacctcccaggccatccttggcactgctactgagaatccccatcctcatttgacagatgagggaaagagcttggagctgtacagtagtgaatccacggtccccagtcggcaagctgtggatcagggactcgaacccaagtcctccagaagccagagcctgtggtttcacctctgcaccacttggcatcgggaggtggagagctgagcaggacctgaaggcagggcattatggggacttctggaaggtccctggcaagacaggcctggtggctgcagggcataggtggtcctgctcacaggcccccaatgtccctgggctgagggcagtttaccaggaggaagggagagctgtaaggcatggagcagcccctcttcttggggggccctcttggcccagagcgcaagcttttcatgcgccttcctctcccctgcttttcccagccttgggtgtgtgatggagaactgcaataaagaagcagaatgcgcagtttgtgtcttcactcacccctggcctcccctggccaccctgccagtggggaccctgtggccctccgcccccagaaacaaccaggcttgctccttccgtgccctcgagcgggggccctgacagtgatggagagcctggccttgcctggcagggaaaggagcgaaatgatcagctcatggcaatatcctgcagtccggaggcgggggcgtggggagcggagtgcgcaggcccactcatgccacttgctggtgaatggggctgctaatggtgagcccaggggaaggagcacttcatctggagtcaagatgtgggggtgccttggaggtgtggagctggaggagttcttaacctgttttgagtcacaggtgcctttgggcatccagtggaactgtgtggattctctttcggacacacacagggtttcatgtgtgacttcaggggagttcgtgggtcattcttcttctcctgccaaccccaacttctcctgccttgccaggccataggtgtgaactccttacaaatgtgaaagtcctttgcaaatgggaaaaccttgccagggtcacaaactcaaaggcccacccaaggcaggctagtggcccaggtgggctgatacgtgagggggccgtggtggatggtgacacagaccttgcaaaggggatggctggccctcagctcctgctggctgggccatgaattgccagaattctggctgggtccagagttgccagatcttcagaggttttaaaagaaaagccagaaagctggattttcataagaaatctttagattcttaaaaaaataaaaacaaacaaacccagcttatatctttttaaaaacagctttattgagatataattcacatatcatacaattcacccatttaaagtgaattttggtatatttagagatatgtgtgaccattactacagtcaacttagaacattttcatgtccttaaaaggaaactctggaccaggcgcggtagctcatgcctgtaatcccagcactttgtgaggtcaaggcaggaggattgcttgagcccaggagtttgagaccagcctgggtaatatagtgagagcctgtctctacaaagaataaaaacaaaatagccctgggcatggtggcatgcacctgtaatcccagctacttgggaggctgaggcaagaggatcacttgagcccaagagtttgaggttacggtgagttatgatcatgacactgcactccagcctgggtgacagagtgataacttgcctgcctgcctctgaaataactaactaaataaaagaaaaagaaaaaaataataaaaaagaaacactgtatccttagctatcacccctgccctcctacccctcccagccccaggcaaccattgatccactttctttttttttttttttttgagacagagtctcattctgtcacctaggctggagtggggtggcatgatctcagctaactgcaatctccaccgcccgggttcaagcgattctcctgcctcagccttccgagtagctgggattacagacgtgtgccaccacacctgactaatttttgtatttttagtagagacagggtttcaccatgttggccaggctggtcttgaactcctgacctcaggtgatccacccaccttagcctcccaaagtactgggattacaggcatgagccaccacacctggctgatccactttctgtctctgtagacttgcctattctggacatcctgtcagtggagtcatataatacataatctccattgactagcttctttcacttagcctaatattttcaaggttcatccatgttattataggaggtgtctgtccttcacccctttttagggctgtataatattctattgtatgggaggaccacattttgtttgggtattgttgattgacattttggttgttttcatctctggctattgtgaatagagctgctgtgaatatccatgtagaagttttgttttgtttttagaggtggagtctagctatgctgcccaggctggatttgaactcctacctcaagggatcctcctgcctcagcctccccttgtagtggggactacaggtgtgtgtcaccgcacctggcaatgtacaagtttttgcttgaacgcttgtttttatttcttttgggtgtgtttgtaggcgtggaattgctgggttatagggcaactttatgtttaacctttggaggagccaccagaccttcccaggcgttttacattcccactgctcatgaggattccactttttccaggtccttgtcaacacttgttattttcctttttgtaaattctaaacttcctagtaggcatgaaggtatctcattctggacaactcatggatttctttttcttttctttttttttttttttgagttggagtcttgctctgttgccaggctggagtgtagtggcaccatcttggctcactgcaacctccacctcccaggttcaaacgattctcctgcctcagcctcccgagtagctgggactacaggcacgtgccatcacgcccagctaatttttatatttttagtagagacggggtttcaccatgttggccaggatgatctcgatctcctgaccttgtgatctgcaagcgtcagccttccaaaggctcccagtgcctttgacctccctcctaccaacgtctccaaatcccctttattctgcgcatcacagcctggcactagccctaaccctaaccccccctctctcccgccaatcccagccttgtacgaaacctacccctacacctaaccccccctctttcccacccatttcagcctgctactaaacctaacgctagctctaacccccctctttcccgcccatcccagcctgctactaaccctaaccctactctaaccctaaccctaacccccctctttcccgcccatcccagcctgctactaaccctaaccctactctaaccctaaccctaacgcccctctttcccgcccatcccagcctgctactaaccctaaccctaactgtaatgctaaccctaatccccctctttcctgcccatcccagcctggcactaatcctaactctaaccctaaccctaatcaccccctctcccacccatcccagcctggtactaaccctaaccctacccctaacccctgtctctcccgcccatcccagcctggcagggagacacatcttaccttcagcatttcctccctcttcccacaagccctttggaatgaggtctctaagtggcagacaccagaaacatcatgcgtgatcctgaggtctatgatgtggggtttcagggaaccaacacgaccatgtggaaatttacctcctctttccctgtgactgagtttgatctgggagctgaagctgctcatcttttttttttttttttttttaattgagacagggccttgctatgttgcccaggttggtctcgaactcctgggctcaaacaatcctcctgtctcagcctcccaagcagctggaattacaggcatgtaccaccatgcttagcgtgaagtgggtaagggggtcatttttatgtaattgtctagtcagagtctcattggaatctcccacctctccaggctgggttctgggactggttgggcagagtctgctccatggcttccatccagcatagcagctctggaacagcagcagggagaggcagtaggagaagggtctgtggatgggccagagataggacacagtttgctgacacatacttcttgtgaatgcctgggcaggttaggtaagtttatttctggcatggtgacagacacacttgtggtttgagaggaacactcagtattatcagttgaccgtgatggacccgcagcctgagaccttattggtgtcgcactgtgatcagacttttaggctttcctgccatgggacaggtcttcttgctctggttaataggaaccgtcactcccatttacgaggtgcttctaggagccagggctcctttccagtgcttttcacatacatgtgagaaaaccgagaaacagagatgctataacttggttctaggtcactcagccaagaagtggcagagtgagggtttgaacccaggccgctcatgcatgaatttagtgcctcaactgtagatggcagacatgccggtgagaaagtgggtcccatgccttgttttagaggagactctctggaatcagctctgtgccccggtcactcctgggtcaggtagaagagtctgactgcagccagctctcaggatttgctgcctggaaggagaggaggtacatgttttgaagaccttgcacacatctcccatgttcaaagccaggcctggaaaacactgggccaggctctctgcagggactcacaccacctccagccccatccccagccctccttccacatctgggtgttgggcatggggccagtttgcaggggaaggtggggataaggctgcagtctctgggacctgctcagatgggaggtagagctggcaatggggtagctggtgtcctgggacctccttgggaagaatgcattgaagcctcccatttttcttttagcctggttctgggtaaaagttggggtgaggagaatggtcagggtccctgctcctgaccaaggcgacagcctcatcccctgcagtcctttgccccgaggttttggctggggaaatggatagaaatgtccagaagcccgggcctttcaccatggggaggcgaggccactccgtgcagtcccgcctgcacttctgaaccacgcggagctgcctcctgccctgcttgtgttttgctggagtgcatagttattatttcaacagcttcacagaaactccacccacacccctgcgcttctgcacttgcgtttgcatttctcccagtcccctttcgagctccattcgtctataagcttctagatgaagtccacgctgaactcgcagtgggtttccctgtagtccctgttggacctgagcttcctgtgatcctgggacccacgtacctctcaccttagtgtctgtgctggagcccttgagtggatgggcatgaatgttattctccgcctctcccctgttggacgtttggactgctttaggtgatggctgttgtaaataatgccatgatgaacatcttcgtgtgggtggtctttttttttctcctttggagattttctcaggggctcccagcaccttctaactttttctttcaatccccaaatcaaggctggagagactgttcccctcttctctgtccattgctccccgctgggtctcactttacacatttccccaagtgaccgtcctgcattgggtcacctgtgggatgtcccacccacccacgatacttgcctggagctgcctggctgtggcccgtggtgcatgctgcctgggcgccctttggcttccggctggtgtgctggtggcgtccaccttttgtgcttgagccctcaacccaatcatcttcttgatgaggaccaagggacattttaaaggagcaaaaaagtctcactaaatagatgtagaatttcccagcattttaaagacttatgaaatgcatttttatatggggccagctggggagtttctcattagctcggctggggagcctgtggggagttgagctaagtggagccaggcaggctgggtaggaagacgcggtggccctgagctcaccgggggagcgtggcaggcatgcgctggcgggttggctccatggacccctggccaggcagcccgggctgcgcctttgttagagctgctccccctctagcacagggggcctcagaaatcgtcaggtggtgactggagctgagaggtggccactctgttaccatggtgagcagtctatggggtagggcattctgtatcttgtgtgcacacggatgcatgcacttgtgtgtgtgcttgtgtgtaagtatgcccaggtagctgcagccctgactcggacccctggcagggggaggctccagcacccctgtgctccgcctgctggtttgtgctgcatcctgggctccctggggctgccttggaccagttctctgaggaggaggtggcatttcctgcccacccttttcctctggctctgcaccagccttggggcccccattgggctccactgtacttggcttcctcgtcgacatgcctgctgtgcacatgtgtatgcagagcctgtgcatacatgtacacatgtgtgctctggactcaagtgtgctggtacccaggacatgtggaaatgaacacgtgtgcagtgcgtcttctgactcctgttttcctcctgtacctctaccctggctgatgacttcgcttccacggagctaggcttgtcttgctgatttccacccacttgagatggacttggggcttccctgatggcagggatgctgtcatttgtctcgtgtccctggcctggcattgagattttgcagcgcagttgctcagttgatttgggaccatctgccccagcaagcccatggccctgcccctcctctcctggtgctgttgggcttttcgggggacttcagtaatgaggattgtaaagacaaggaggggccagtcctactttctccaaagctggggtgctccctgaggatggaaaggcctctctttggtgttggctgtttcctaggtccccaaggatcccgctgtcctgctggtggacactggaaatcaatagttctttggcgacttgaagcctgcctgtaaacagtcaggcatgtctgtgggttggggtgtgtggggtggggtgccaatggcataactcctcatgcatttgggggagttgctgcccatcctgctccctccagtgttgcccagccttgtgcgtcctggggtggtttgcaccagtgctcctcaaacttgaacatgtgtgcaaattgtcaagatgcagattctgactcagcaggtctgggtagggcctgagattctgcatttctaacaggctccagggtgatgttgatgctgctggtccatagactgtgtgtgtccccttggcattttttgaagctcagcctaaatgacacctcctccaggaagtttcccatgatagccctgacataattttgtgccccctgagccaaagagctcctgatcctggccctcagtgctcccgctgccctctgcttggttctaatgttccttctcttatacccagctccctgatgctctgctcactcctaggggacagtgaccaagtctgattctctgtgtctccacagcccagccctggcttggcagttggcaggtgcctggcaaatgtctgccaagatgcagaatctcacctctacttcttcgtctgtatttgtcctgggaagtgcagggcctgagttttgttcactttgtttagagcaaaatctgggtttgaggtctagatacttattagctgttcaatatggagtaagttactaaacctccctgtcatttcattttctcatcggaaatggggagaataataattctacttcctaaggccattgtgaggatggcacgggaaatccgtatggagtgctcaacccctaaggtgccacctggcaccctgtacctttacttttgctattgacaccatgtggagggaagtgccataggagcttagctctgagctttgcgtctgtatgggtgacagagaaggctcagatgggcccctccttctcgtcacatcgtcacagcttcctgcctttctccccacatcgtgactggcaatctctgggcatggccacagtgcctggggcaatccgcttcaccttcctgcagatttggggtggaactgagtctgtagggaaccattcttgttcaccgtggttggtgaggcatggcttgtttcccaagtggggaaggccaggtggggtgggggttggtgggaggtgggctgggtctgctctgaaaggtagaggcctgaggctgacctgagatcaggttccttccttgggtggggctggacacatggactgtgcggccatgggccagtgcccattaggaaatggccaaaatcagcttgaccacaccacctggcgtgtgttggcttcctgggtggacactctgcagggcccagctcctgggttggatatggtcaatggtgccctgctgtagactgcaggcagcccacaggggttaggctgctgtcatgtcagctgacattcccttaacattcttgaatgtgcaggcaggtgcacacacacgcacacacacacacactctcacacacatgagattatgctgaacctggctatctgatgcctctctggttcaaaaaattattattttacctccactgataatttgttctcctttgtcatggttgattgctttaactgatggctgctggccatacgtgatagttagcacatcagactcatgcttagtctggcaaatatgatatattttacttatgctattctacttatcaaggctaaatgccttgcaaacctggcaagcttgtggaggcagggacagtgcctgtttgcttcctgtcgtatcctcagcaattatcactgtcttaacaataacaattaaaaaataataaccatctagtgagcatccacttggtgccagacagggggctgtgacatgcattatctcatttaagccttgttaaccacagtattagcattcccgtctcacagatgagcaactgaggccaaagagctaaagagactagtccagtctgcacagctagttggggttttgtctgagtctagggcacgctttctgtagttgctaattcacagtgcctgggactcagtggagacttactgcatcttggtggaatgacgggcactagaatgtgctgtaatccctaatgtcattgcagcgacacaccactagtgagaagccaccagggtcagtgtgggaatgagtgattgctaatgggcaaaaacctgtgagtgctctttggtggtgatgtgtaaattcacaagtcattgtgtgtgcatgcatgtgcacacacaacatacacatattacatgcacaccaacacaaggatgcatgcacacattcatacatatatatgctcatactctcactcagtgcaaatgtactccacacaatgcacatggacattcacacacatgtaggtacacatttgcacacaatgcacatgtaccacccatgcacatgtaaacacacacgtatgtgcacattggcatatgcatactccacacaatacacacattcacatatatgggccttcacatacatgttcctccatactacacacatatgtacgcacagccaagtgcatgcatatgcataatgcacacccacacagatgcctgcagacacaggtatgcacacacatgcataacacagatgcacacccatacgtgcatacaggagtgtgttcacactgccaacatacccatagtgcgcatgtgcacacacttacaaatgcatgcacatacagaggcatacacacatatgcagcattcactcatccacacccaggcatgcaaatgagcagaaaaagcctgtttctgggctgtctcccttgaaggatcaggaacagtgcccaggcggggtgttcaagatgtccagattgtctccttgctctgttttctttcttccatttctttgtcgtaccctcagggccctagacattctttccatccaaagatttgcacccctgcacttgggcccagtgctgggctgaccctggtgtggacctagaccccagtcttggtgcatctgtctgttcgcctgcctggcctgctgtggcctgcatgggccgccccgcaacccccaacttgcatgtgacttcattttacaccctgcacctgcctctttaagagaccaggggcctggcaggcctgtccccagggtcggggctgggggaggctggacagctgcaggttggggggaagctttgtgagctcccagtggcctcttggagcctgggtaatgctggggaaactgaaacaaaggccgacaatggcctccttccctccccgggtggcctcggagcagggcctgcctgggcggcctctgggggcccctgttatttcctgtgctggctgtggggctcctggccagcttggaatggggcaggaagctgggcagggcatcgcctccccacccgctgggctggccctcgcaggccagagtagccgctcctgggagtgggggtcggctcagcgttcctgttctgtgaccgctgctccagctccgcttggcctggtctgccctactcaggtctggccaggcctcccaggagggaaactcagccttccgtctccgctgccctctccctgctgccgactccatgtgctcccaccatcttcattgagtccatctatgctgtcacctgagctcctgcatctcctctccctaaatggcccaagcctctgtgttcagagcccttgccccacagagccaaggacagggtcaggcagggagcatttcatggcttattaattaattcatttgggattatgctagaggttagcataggtttggttatcagggttagggttacactgaaggttaagtttagcgttaggtttaccaaaccctgcagaccaaaaagacacgagcgttaagggcatgggttttcaggcagataggcccttatttcaatcctgattcaccaccagttattcatcatagtattgtcaggcgtctgtgtgcttctaggccacaagggcacagttgggtccctgacttccaggactcacattctagagtgaggaggcagcagtgggcaggtgaacacacacagcacaaattaagtgtattcactgtgagaatgggcttgactcagtgattgcaccttcccagagctcagttttgtgatctgtagaatgggaataacaaagcccctaccttgtggcaccattataaggacaagtgagagggtacatgacatgtgtccagcatggtgcctggcacacagcatgtccccaataagtgctaactgtgatgattactaatgaaaggctgtcgaggtggcctgtgggtcagtggggagctcaaataatagttgaagagactaattatgtcaaaacctaagggaagggtcaggatgcctttgagcctcctggcagccaaggcccaaagagaaatagaatcaaagctgcttctgtattatgtaagagcttgggacagaccagtgttttccccctggcttggaatgctgaggaatttattctgtggatcctcattaatcaatggacaaacagcaggaaccatctcagtaacaatttggcacacgatgcagaaacatctttcttagagttccttcttcaattgaccctggaaaaatgctccgtgcctcagtgcaccacacaaccctggagttccatgcagtacagcctggagggagctgggcggaggcaatgctgcctttgctgggctgcgtctgggggctggtggggcagctgctggggtaactttcctaagtgcctggttaagtgcaattgaatgggtttctttaaggcaggatctccaagggccctcaacatgcctgtggatgctttgagtcatagagagggttcttaaaactcttgggctcagaatctgtccttcatccctttttttgactaccacctatccctaagcccggaatcttggaacacagtttgggaagctctgtttatgtgcttctcctttgaactgaacaccatgggaggcacctcactcacggtgtcccctcctccccttgcccagactgtcatttggctgtggtttattccgataggcctgggggtcttcatctggcagagcccacccacctgttgcttacttcttactggatgattgcatttactcatcttatctgagtccaatccagcctccaacaggggtgcagttagggaaactgaggctcagaatgcgtagagggctcagggcatgctcacacacatgcatacacctgcatgcacgcacgatcacccactttttgctctgcgtgtgtaggaacgttgttctgtgtctgagatctaaagtctggctggagccccctctccctctcctgcccacctccccctcctggtgggcaggactgggagcctgccccagttaggcctgccagtggccacttactccgtgtctggcgggtgccctgtggagtttccatggtgagctgtcctctgggggccctgggtgggactttccatctgggtggaaacctgacccactggcccagggctggaaggggaggaaatgccttctccaaacgtggaaagaggaagcaaagagaggtggccagcctgggattccagccacagtccctgacttctgcaaagccacagggcctgaggaccccaaggagcctgggaaagagctgcgtaggactcacccatcagggacggccacagctcagatagggccatagctgcacagtgtggcttcgctttgggagctgactgttgtaggctcctgtggttctgcccttgagctcgtgcatgtctgtgctggcattccttgcatgctcttgcagagacttggggccagccagttggtaaatggctgggccaggatttggactcagctcactgtccccaaggcccatgtggttgtcactctgcctccttgcctccctcaagcaggcatttccataggcattgcctcactgagtccttgcgggcgcactttgaccattggtattatcattattcttgtatttcataggtggaaattgaggctcagagaggctaggcatcttgcccaatgtcacacagcaagtttgtggcagagctgcactatagcacagattccactcaccctttactttgctgacaacaacatatgcctatgtacaggtcattatttatcatttaacttccttcaacatagataggcacatttgccaaaaaatgaggacaataacagtgtaaagggattggcaattgcagtcaacaggagctggcttactcagggaacctgcgatgtggttaggcactgtgtccccacccaaatctcttgaattgtaatcccccaaatccccatgtgtcaggtggaacaggtggagataattgaatcatgagggcagtctcccccgtgctgttctcgtgacagtgagtgagttctcacaaaatctgatggctttttttgtttgctttttgttttttttttgtgagatggagtcttgctctgtcacccaggctggagtgcaatggtggcatctcggctcactgcaattttcgcctcctgggttcaagcgattctcctgcctcagactcccgagtagctgggattacaggcacccaccaccatgtctggctaatttttgtacttttaatagagatggggttttgccatgttggccaggctggtctcgaactcctgacctcaggtgatccactcgcctaggcctcccaaagtgctgggattataggcatgagccacagtgcccagccaatctgatggttttataaggggcttcccccttcgctcagcactcactccatcctgccaccctgtgaagaaggtgcctgcttctcctttgccttctgctatgattatacattttctgaggcctccccagccatgtggaactgtgagtcaataaacctctttctttataaactacccagtctcaaatatttcttcatagcagtgtgagaatggactaatacaacctgtgatgtgggtgagaatctgctgttccctcgggtgttggtctctgtggccccttgtggggcaggtaaatttgactctggggttttaagatgtattttcatcccacatgcttgatgtatggaccaaaccattctccatggatgtatctcaagccacagcagttgtatcttaggggagaggaaagagttttggggaataactttgactctaagacacatttgcctcatagactaactttagaacctggcactcccttgcccccgaagctgggacaacaggggtgagcctgtgcctgacccacgggttcaccaaggatgcttggaccaatgtgtcagggcaggtgtgatggccaattctgtgtcaatatgactgggctaagggctgcccagacagctggtgaaacatgatttcagagtgtgactgtgcaggtatttcgggaagagatgagcattttgatggctggactgaataaagcagacggctctcaccggtgcaggctggcatcatccagtccactgatggtccggatagaatgaaaaggcaaaagaagggtgaatttgttctctttgtttgagctgggccatccgtcttctcctgcccttggacgtcggcactcctgtttcttgcgccttcagcctgggactgggactgacaacattagctcccctgggtttcaggccttgggatttggacatgaactgcagcatcggctttcctgggcttccagcttgcagatgacacagggtgggatgtttccagcttctatacctgtgtgatccaggccctcataacacatctcttttgtatgatccaggccctcataacacatctgtgtgatccaggccctcataacacttctccatatatccatatgtggatcctcttgactctagttcttgggagaaccctggctaaggctctagttcttgggagaaccctggtgagggtatgtgggagctgaattttctctgtgtgagtccattttcatactgctgtgaagaaatacccaagactgggtaatttataaagaaaaagaggtttaatggccttacagttccacatggctgggaggcctcataatcatggtgaaaggcaaaggaagagcaaaggcacgtcttacatggtgtcaggcaagacagaatgagagccaagcaaagggggacacaccccttataaaatcatcagatcttgtgagatttactcactaccatgagaacagtatgggggaaactgcccccatgattcaattatctccaacagggtccctcccacaacacataggaattttgggaactacaattcaagatgaggctgtacttggtggctcatgcccgtaatcccagcattttgggaggctgaggcaggaggatcacttgaggtcaggagttcaagaccagcccggccaccatggtgaaaccctgtctctacaaaaaatacaaaaattagccaggtttggtggtgcatgcctgtaatcccagctactctcaggaggctgaggcaggagaattacttgaacctgagaggtggaggttgcagtgagctgagatcacaccattgcactccagcctgggtgacagagtgagagagtgagactccttctcaaaaaaaaaaaaaaaaaaaagaaaaaaaaaaaagaaattcaagatgagatttgggtggggacacaggacacagccaaatgataccagtctccatcggtggtgttatgcttagtcttactcctgaacaacacctctcagcccacttcccggggcctgacctggaggtgccttgggccttggcagaggggaagattggcttctctgctcctccgtcccttggccccgactcctccagcatccagcacccctccaagctctggtgcgagggagggaaggtgggggctggaagccatggcctcctgctgccgtggggaggctcctgtggggtggctggctggattcagaggccaccaacaactttgggaagtcttagtgccctgggccaggtggaagcaacagaggcttcactggggcagttggctgggagagccacgttggtgggtgatgtagtagggcccggagatgatctcttgtaggcccgcactttgtccttcgtctgcatcttggcccctatgccttgtgcccctccgagagcaccctctctcccctttcccacctactccaaagtggcagtcttccaaggcccagccgctgtccctgccttccacaaaccctttgcacgtgagtcttctgggggggcctgtcctttccatgaacccctatcctgcccttcagagcctatgacgaccacatgctggcttgttccttttcctcagccattcataggcttcgtctccttcccaccgtggagcaggttctctccctcccctactccccctaaccccagtaatctagcaccaggctcacactatacatttactcatggatggacagtttctcagcacttctagcaccaggaagttctacttaatgtctaaccactttttccattgctgctggctgagcctcggtgctgttgttgcaagacctctctttgaagggctgtgatggttatgagcctgcaccactggcaggatccatgagggcccattcattcattcattcattcgttcattcttttattcattctttcagtcacagatattattgagcacctaccatgtgctggtgaacatccaggaacagaactgacaaagtctctgctgtgctcagagctcacagtcttgtggggagatggcactagaaaagtaaaaaatgaatcaatgaataaaaatgcaccacatgctttcactaggggtggccagcagggtgaccagatagatagagtggtgggaggtgaggaggagagggccggctgtgttggggtggtcagagaggcctctgtaccaaggagggggcgttagagccatgcacagcagcggaagcagtgtcccaggcgttccccactgtgggacagaagggacttcactgtgcctggaggagagcaagtgccaggcagaggagggagaggtgggcttggagatgagggagggagacgggggtgtgaaatgaggtggtggggggagcgtgaggtcagggagatgagagggggagagaggggaaagacggagcagaaaggaaggaggtgaggttgggagattgtcgaggggagcaggcagaagtgtctcatttcaggcctggagccttagtgggtgccttggcttttcttctgagttgatggggaaccagggagggctttgcacagggcagtggcgtgatcaggtttatatctggaagaggtccctctagttgtgtgtggggaagagatggtcggggctgaccaagtactcatccaggtgcaagcttatggggttgggagcaaggtcaggaggtaagcagaggtcagattctgagtttcttttttcttttcttgccttttctttctttctttttcttttctttttttctttttttttttgagacagagtctcattctgttgcccaggctggagtgcattggcgcgatctcggctcactgcaacctccacctcccgggttcaagtgattctcctgcctcagcctcccgagtagctgggattacaggtgcccaccaccacgcccggctaattttttatttttagtagagatggggttttgccatgtgggccaggcaggtctcgaactcctgacctcaggtgatccacccgcctcggcctcccaaagtgctgggattacaggcatgtgcccaagtttctttttggaggtaggttgaaaagagtttgtctctggattggatgttgggcatgagaaaaggagaggagctgaggaagcctgcaaggtttttggcctgggcagctggtggctggggctgtgctcactgagatgcagggtgctaggagaagttgtcagggcgtagggcagctcggtgtggatggtgtggctcaaaagttcggcttgtccatgataagcttgagatgcccgtgagatgttgagggggtacttgaacgtgtgttctggcaatcgggggaggatgggaccaagatgtgttttgggtgccatgagtgtgtggctgggacagatgcacccactggggggtgagcatagactgaatacagaggagctgaggtctagggccacgttgacattgcaggttgggacatcggcattgaaggttgggacatcgacgttgaaggatgggatgatgaggagagactgaggagatggagaaaggtgtcagggaggaaggaggaaaactgggagcgggcaggtccccagaaccctatgaagaaaatcttccaggaaggacagggtcaccaggcaggtccactgctttccaaagcaggcgatggcgtgggagtacatgtgccgtgaccttgatgacaccggctcttcgtttagatgtggccaggttgcaggagacgtgtggaagggaagcccagcctagcggctctcatgctttgcgggagccggatctgctaaaacagcctttgcttgaaaccattctgggccgagaagagttggggctcacgggttaatgaaatgaactctcgtctgcagactggcccatccgggggtgtccgcgccgcgcccccgttcccggctcccgctcagggacgtacccatggctggagcagaggtggtgtctgggagctgcagactgtccacggcagagtccagctgtgcgcgagccctcagcgctgaaattgccagcctcgtgcagcccagagccagcctgcggaagtgggccagccgcacctccgtacaggattagagggatgtgtaatggattaaagatcaaaaatgttaattaagaaatggtcttttctaataagatgccttcaagggcacaggcctgaaaaggaggggatttctcattttggcaacacggtttctgttgtaatgaaattggttcacagacagtggggaggacccgacgtaagcctggttttaaagacatctccatccaaattaattagcaataaaatacaaaggcccaagtgtcaggctggcaggcagacagtgcgtattggcctggctggaaggatgcgtggacttcagaggattccttctgtgtcctggtgcctgctggaatgttgtcctcgatgctgtgtttgagggcatgttcttggggtgcctggtggggtctgactctccctgggattaaaggatgaggcctaactcagtgggaacttgctgtgtgacttctgactgcgcatgcccctctctgatcattccactagtttccttttttatcagttgtggatgacagtgaatgacatctaattagatgtcagtgacaatgaacagcgctccatgggctgttggatcaaattgattcctagatcccagtgctgtggaatctcagaatggttcatatgaatcagtgtgatgatggctaagggatagtttggtctttttgtacctgatgcagcctcttggctgggaacaaagatggaggtgccttggcccacttcgagttctgctttccccggccttccctggtctccaggctttgaagtcccccatgttgtttgaatgtctcagaagaccatcacagtctaatggttaagaattgggttctggggccaggcacggtggcctgtaagccccgcactttgggaggccgatgcaggaggataacttgagggcagctgtttgagaccagcctgggcagcatagcgagaccccatctctacaaaaaaaataaaaaaattatctgtgcacgagtggcacacacctgtggtgtaggaggactgcttgagcccaggagttcaagactgcagtgagtgagctgtgtttgcaccactgcactacagcttgggcaacagagtgagaccctgcctctaaaaaaaaaaaagaaagaaagaaaagaaaaaaaaagaattgggttctggggttctggagtttgccaggtcataagtttgcatcccaggacctcctacttgggactttaaccttagtacttgacttgtgagcgtcagtttcctcatctgtaaaatgggatcagaggtcctagtttatagcacagccgggaagtgagaaaggagatagtgctgtgatgagcctggcctctgagggaccgaggctcggtctgcactgctgaagctgttgcttttattgccgagatgcagagaatctgcctgttggtttcagactgggcctcagttagaggctagcagcttccccacggctcaggctcaggctcaggcctgtagtgttttgagtttcctgggcctcccgggatctgaaactttgttttataagaagccaaaggactgggagtcccccagagcctgggacttgctctgaaggtcacaggcttggaaaaagcgtgggtgaggatgtctgaaggagggtctctcagtgctgtggcatcaggtctccctctagctgacggaagcacctgcgttttcttgcctgccacaaaccttgttttcctgggagtgatgttgggagcctgtgtgagcagggagaggagccttcctgtcacttcttgggcaggagatttcctcatccgctgtgcctggctcctcctttaggctcgctggagctgcaaaccttcacttaaaaaaacatgaaacaaccttgtcttatttaatgatatttcccttgaattgcatttggtcctatgttaatatcctgacttctgctttgaattttcttgcatctgcctgctatacattttctcagtattctactgttttcctccattaaaattttctttttagaaattgtggtaaaatacataagataaaatttactatcataaccattttaagtgcacagttcagcagcattaggtacattcacattctcgtgcagctgcctccaccatccatctctagagttcttttcattttcccaggtgaaactctattctcattaaacactcactccccattccccgtcgcctaggccctgacagccactattctactgtctatctgtatgaatttgactactgcagccaggccctcatgtgagtggagacatacagtatttttctttttgtgcctggcttgtttcccttagcataatgtcctcaaggtttatccagcttgtagcatatattagaatttcctcccttttctttgacttatttttttatttttcaaggtagggtctcgttctgttgtccaggctggagtgcagtggcgcgatcatggcaaactgcagcctcgacttcctggcctcaagtgattctcctgcctcagcttcccaagtaactgggactccaggtgcatgctacaatgtccagctaattaatatttgtgtgtgtgtgtgtgtggagatgaggtctcactatgttgcccaggctcgtctcaaactcctgggatcaagaaatcctcctgccttggcctcccaaagtgctgggattacagtcctgagccactgtacccaggaaaatttgtttttattatagtaaaatatatgtcacatgaaatttatcattttaaccatttatgtgtgcagttcagtggcgttacagtacattcacctttcagtgcagctaccaccaccatccaccttcggaaagttttcatcttcccaaaatgaaacgatgttcccattaaaacacaaactccccattgccctttcccaggccctggcaaacactgttctactcagttttttctttcacttaataaaagagaaggctcattgctggctcatggggttacttctctatgtggcagcctttttgcatacatgggattgaggtgaaggtagagaaaggtaaccaagaatggggttgcaggaagaaaagaggtggaggcacttggctgggggtggtggctgtaatcccagcactttgggagatgaggcgggcaaatcacttgaggtcaggagtttgagcccagcctggccaacatggtgaaaccgcgtctctactaaaaatacaaaaaaaaaaaaaaaattagctgggcgtggtggcgcacacctgtaatcccagctactgggggaggctgaggcaggagaattgcttgaacctgggagacggaggttgtagtgggccgagatcgtgccactacactccagcctgggggacagagtaagactctatctcaaaaaagaaaaaaaaagaaaagaaaaaagaggtgggtgtcgtatccacaggctcagcagccccgccgatccagacagttcttttccaccaagaggttgatccttggagccatctccatgctgtagatctgccagcaggttccgtagctttcccctgttgctggtggcatggcttctcatggcaccgctgatgtcgaatgtcctcagcgagcccattcatggccacgattctgtgttgggtcccgcacgcacctttcacggtccttttctgtaacatcacagtcctggcaatgaactccagatgttttgccctgaccttggatttaagtctccactctgcaggccctcatgagctcagtcccagcccgccttcttttttaaggctgaatcatagtccattgtgtgtctagcccactttttgtttatcccttcctctgttgatggacactgggttgctttaatttgttcaggaatggtggggtgagtgggacccagtgcagcatggtcttctcttatgctggaggggactggtggtgagaggctgcgtatctgggagtggctctcatgttccccgcagcagggcatgggagcgaggggtcctctgtggggttgggggctcttgccaacatccatcttccccacacacatcctctctttggcctgagaaaagtacatcgacctcctccctcttgcagtttggctgtgggagtgggtgactcacagacacagcccctttcctgtctcctcctgcccgtggggccagcaggctgcctcagccgtgagactttctgcacaaaggtccgtcagaggagaggtagctctccgctgagtggtgtctggttgccagacatggtgatggaaatgctttaaaccttaaacgagctacccagcaaatggtgggaaggaaggaacgggctgatctgatctgtggtcttctgtttgttcatggtgacatggatggggcaaaaggattgggtggaaactgaccctttggaaaacaaaaattaacaggaaggcatgaacgcagcaataaagatgaacaaccagttgccacccccaagtgtgggtgactcgtgtagacatcatgttgagcaaaggaagcagaggcagcggagaagtggggtgcacgtgtctgttcctgtgacgctggggagtgggcaaagtggatgtctgtgatagaggcgaagaagtgactgcctttggagggacatgtgggaacctactggggtgcagggaatgtcccataccttgatttgtgtgctcatttatgtaaaaccttgctgtccagcaaggcaaaaccccatgtctagaaaaaatacaaaaattagccaggtgtggtggcatgtacctgtagtcccagtcgggaggctgaggtgggtggattatgtgagcctgggaggtagaggctgcagtgagccatgattgttccactgcactccagcctgggcaacagagtgagaccctgtctcaaaaacaaaacaaaacaaaacaaaaacaaaaaccaaaaaacccagagtacaaagaacaacaacaacaaaaatacctgctgtcacccagtttgcttaagatttgtgagttaaacctgaataagaaagggatgctgggcacagtgactcacgcctgtaatcccagtgctttgggaggctgaggaaggaggctctcttgaggccaggagtttgagactagcctgggtgacgtagcaagaccccatctctactaaaaatacagaaattagccaggcatggtggtgtgtgcctgtaatcccagctactcaggaggctgaggtgagaggattgcttgagtccaggagtccgaggctgcagtgagctatgatcatgaaagggacgtgaaaagaactgatgagattaaacattttcatttcagtgatgtggaggttgtgggctttttacttggcttatttccccctcaattattagaataagatattccaagaccaagcgttgggctggttgcctgggctcagtcagccttcagatggggtgttgaaggtaagagtcaaagggcccacctaggccgttcccgagagcggaaggtagtgggagagtctggagtgtccttgcacctcctgagtgacagctgccagccctccagtcctcccctctgcacttgtaaagtaagtcttgggccttcttatgctggggaaattgttctagaatgaggtgcaggatgcctatcttttcttcttcctggcctgacctcatcaaattgcttgacctcatgaacattagtcctcttgtctagacacagacatggtcattcctggctcaccagcctcacagagaggttgggaagctcactcggggtctttgtgccctgcgaagggctggccacaggcttctgtgtggggcattctgtctgggcatcatgggctcctatagccagagatggagggaagacatggggaaaggtggacactgcctgagcttaggccctcagtggaggcccacttccttctggggcgctgggggacgtgcaccatgactaatacaacctggtgtggggattgagattcacaggcattttccgaaagggctggcagttctgaacataatgcttctctaggtgtctgggcacggaggctcagcctgctgggcctcaacgcctttgctgagcagcttttaaatatggatttgggctgggtgtaatggctcatgcctgtaatcccagcactttgggatgctgaggtgggaggatcacttgaggccaggagtttgagaccatcctgggcaacatagtgagacatcttatctacaattatttttaaaaaattaactggccatgctcctgtagtcctagctagttgggaggctgaggtgggaggatcacttgagtccaggagttggaggctgcagtgagctgtgatcgtgccactgcattccagcctgagcaatagaatgagaccctgtctctctctctttttaaaggattcgttcatgtattcattcccttattaagccttatttgaacactgttactgtaccttggatgtttgtgcagaggtcaatagtattcagaattagctggttagtgggagaagaggagggaggaaatggaggaaggagttgccattttctcagcacccactctgtgcctatctgggtgcaggagggctcccatacgcacgcatgttgctgcatttactctttacaacagccctgggaggtggtttttatggctcctgttttgcaggtgaggtaatgagttcagttgggctgagtctttgctactcagagcgtggtcctgggaccagcgtcgttctccttactgggagcttctagtaacgcacaatcttgggcttcttcccagacctgctgaagcagaatctgcatttgagcaggctcgctggggatctgtgtgtagggtgaaggccctgccgtggcatgggagcaggctggcacaggccaggtttgctttcctctgtagtatggcctcctcagtcgtagcaatggcagtcagaatggagctattggcagctatggtgcccagtgttgtgcaggaccctttcatggtttctcacatttaaccaccagcagtcctatgaggtagacattgtcattgtctccctttattgctggggagacccaggtcacagagagggcaagtaacctgggctgaacctctctcaggtcacactgtgtttgggaggcaaagggccttctcagagggtgtgtgtgtgcatgtgtgtgtgtgtgcatgtatgtgtgtgcatgtgtgtgtacgtgtgcatgtgtttatgtgtatatatgtgtgcgtgtgtgcgtatatgcatatgtgtgttcatgtgcatgcatgtatgcgtgtgtgtacgtgtgtgtgtgtgtgtgtgtgttggagggaggtggtggtgacggcatggcagggggaatttggggagatgactcttggaagcaatggatatagcagatggtcgggggagaagtcagtggggtggaggggaccccaaccaccgcctaggggtgctgtcctgagtctcagggggagactttctggcttttcaatcaagagtcaggtccaggtcccctcctctgggaagccctccctcattctctgctcagttcgagttctgtctgtgctcctatcttgtgctgcttgccctcatcacattgtctgatgtgtgtttctccattcctggctaaatggtgaggtccttggcggcaggaccatgtcttggtcatcttcgtatcctctatccctagcacagttggtttttcttcacccattcatttataaaaatatattggaggcctactgtgtgccgaaccctgactcaggtgctgatgggtccgtggcaagtaaggcaaatatgattcctaatcccctagaggatatgctggagaggaaagctcttgtgaaagggtgacaaatttattcattagttcatccatccatccattcattaatccatacatctacccaccccacccacccacccatccacccatccatccattcatcaacccatccacccattcatccatccattcattaatccatccatctacccaccccacccacccattcagccattcatcagctcatctacccattcatcccctcatccatccatccatccattcattaatccatctacccaccccacccacccatccacccattcatccacccacgcatccatccattcatcaatccatccacccattcatccactcatctgtccattcagtcattaatccatccatctacccaccccacccacccatccacccattgatctacccatccattcacccattcactaagcaaacactaggcactggggttacagtgtaagcaagtctaaagtgatcctggcccttggagctacagcccaggggaacacccacaactcgcaatctctctaaagagaaccagggccaaagggcaggtgcagcagggaccctagtctcatctgcacagacagggccacctcctgtgacgtctgaaggaggttgtggaattacacaaaaaaggactttacacttggaatgttaggcacccaacacattccaaacttacaacacttccagagttttgggatcttaactctaagctgtcacaggggttaaaagcaggaagtttcagagggtgtctggatttgcagaagtgcaactccatgcttttcaacagccattgccctgcaaagcgcactcctggctgagaactttcatgagtatgtgctgctcctgaggctgctgtggtcccgccagggttgtctgttagggtctgtagcacctatctgtaagttgaccctgggctggctagatgtcaccctgcagccattcgctggctcttgggttgcattgcacctaggcaaggggatagcaagctttccttttttttttttctgaggtggcgtctcgccctgtcacccaggctggagtgcagtggctcgatcttggctcaccgcaacctccgcctcccgggttcaagcgattctcctgccccagcctcccgagtagctggaattacaggtgtgcaccaacacacccagctgattttttgtatttttagtagagatggggtttcaccgtgttggccaagatggtctcgaactcctggcctcgtgatctgcccgtcttggcctcccaaggtgctgggattacaggcgtgagccacagccaccatgcccagccagcaagctttccttttattatttttttaaaaatatggttttattgcaaaatgaaacacagatctagaaacccacaaagtcaatgtagaacttagtgaatttttataaggtgaacgccattgaaaccacttcccaggtctagaaatagaactttgcaagctacttcggaaggcttatccttgttccccatccctgtttctccttccagaaagaatcactagcttgacttttatggtgatcacacccttgctttgttttaaagttctgtcactcacgtgtgtaccccttgccactataatttagacttggagtgccattctttaaggaacatgagggagtaatttttttttgtagtgatgattattttactttttttggagaccactctgtcgcccaggctgggagtgcagtggtgccatcatagctcactgcagcttcaaactcctagactcaagcgatcctctcatctcagcctccctagtagctgggactgcaggtgcatgccaccatgcctggatattttttaaaatttttgtagagatggggtcttactatgtggttcaggttggtcttgaagtcctggcttcaagcgattctccctacttagccctccaagtagctggaattacaggtgtgagtcaccatgcccagctgattattttaaaaattcttttggtcaggcgcagtggctcacccctgtaatcccaatactttgggaggctgaggggggtggatcacttgagtccaggagttccagaccagcctggccaacatgacgaaaccctgtctctattaaaaatacaaagattagccaggcatggtggcgggtgcctataatcccagctactcgggaggccgaggcaggagaatcgcatgaacccaggaggcggaggttgtagtgagctaagatcatgccactgcactccagcctcggtgacagagcgagaccctgtctcaaaaaaacaaattcctttctaacaattcctgatctggaagcttctggtgattaggctcccgggtaaaccattttctacctttggcaggtgaaggcgaggcaggaagtgcctaccatttagcaggtgttcactcagagtttgatgagaggctggagatgccagggatgttttacagtcacctggggaggaggtaccgcagtcctgaaccagggtgaccacaggcagggggaccaacagtgtggaggggaggagccgagggcgggtcaggggaggattaacatgaggggaaaggagatcctgtgcgtcattctttctttccctttctttccccttcagtacactgggggaaattaatctcccacctgccacggcagggaaacctgagtttgctgttggggctgtccagggcacgtggggtgtttgtctttgaggcctttcttcaccagaattgatgacaggggtgtatttcctgctgagccgggctcctcaccccacccaagggggatttggaggcaggtggtcacgtgtctggcttggtttgggtgtccacaatagcctgagggatgtgttgaattttagaagttactgacaggtgagttctatgggagagggctatggtgattttcaaatgctgggtcaacagcattctgcagtcctcaccatgcaggtgctcctcatgtcctggaaacttaacttcaagcaggtggctgatcaagccttgctgttggtaggagcagggggctggcctccttattcacctaatcttctctacatgggaacaggatagtggttttatgactcattactgaaggctccctttgttagaagttcagactgtaggagatgtcggtgtagccagttttaagctgagtcaggaagagcatcacgaacctatggaatctccaatagcacatggaaacaggaaaaaatgagaatggaaattcttggcctcatttataaataagcgttgattaaaagtctatttttttgtctttgttgtggaggacacaggagtgttggattcagtcccaacattgcacagcgtaatggaaaagaaataactgtcattgtgcatcgtgacaagtaatttataagaaaaacaaaaacacttgcacagggccagttgtctattgtgtgttggtgacacaaaatgggacttctcactatagttaggtggggtttctgtcttttggcaggactttggcttttaaaagtgccacacactctagaagaaaacaaggaattatgcagccatgtggacatgggttctgaggcctgttcatgtctgcccctccccgcgcatgctggcttccccccgccatctcgcaatggacttgtcctcaggggtgctcacaagtgtccgaactcatcatgggtgcttccccctgttctcagcccacccatgacccgtgcctttttgcccgtgtgccctgggaggtggtgatggttgccacctcctcctttccatgcaggtgagagctgggctggatgaggtggtctcttaggtcccttccaacttgaagcttccctgggtccaagcttaagggatgggcagggacctttcgagacacgcatttggtgggaagatgcccctgaaaggtgccatggagtcatctgtggcagtccgggtgctctttgtctaggccagtgttggaactccggggaggggtccaattccgtatcagtgtggcggggactggccttccaaaaggctgttttccaagcgcttgatgttcatgctgttttcattctaagatgtgtattttgtcattgcctaacatttctgaaattgggaagcattttaatgtctgtatgtgtgtttaataaaatgacagtccctccaaagagagagctgtcattaagatagtggtgggccacacacttagagcctcttagacctcacaggctgtcgtaactggtgataggcggcctgggctgatgcaggctgcccccaggattcaaaacagcaagtccgttttgaaaacccttgtctctgaaaccttccagtcatctctgtgggctgtcatctaattttgcttaaacactgcatttgcctcccctccctcactcacaaacctccagtggctccctatttcttctacctgaaccttggactcagcctggctttcagtctggcccctgcatcattctttctgcctcaatcagccactcacccagttcctttccagtaggaagatttcatgatctcctccgaggcagggccgtctctgactccaccgggtccctagcacagggtcttcgggtggcaggcattccggcaacacttgttggctgatgcattgatgtggctgcagctcagacctgaagtcctttgggcattttattaccatcagcatctgggcagtgtaactcgaggattaacagagttataggagaaaactccactctaagaatggctaattattattattttttaaccaactacaatttacagagggttcgtagaggcacaaaagagcacacaccctgtaaacgagggttaatgagaaagcttcccgatagcttgtgcttcatcagcaacagaacagcgtgtaaataaatctaatttctctccaactcaactcgtcacaggcttaattaccgcagccacaatgtgtgcatgtgtgtgtttttttcattagcgaaagagggtcattattagccatgtctggtaagaattatgatgaagagcctggcttaccctcgataggtgtcctcagagagcagaaatgaactttccttgtgaactaaagagttcccaattaaggtggtttggaggaagcaggaagcggcaagcagattagaaaaagattacagaaacgggaaagcgggcgaggaggcgggagggttctggtgggctcggttaatgaccgagggaggaaggttttcttctgggggctgtgccctcttttcccgcctgctttgttatttgcttgcccagaaatcctgggggctccgagacccctcctggggtcctgtcttgcattctggctccagagagctgaaaatgagacttgcacttgtggggggacagggcttgaccgctcccagccacctcttttcgatggcttttcacacctccctcccctcctgctgaggagggaggcaggggagagcgtgccgctgccaccgcggaagatagccgcaccggcggactgttgcagtgagtgtattgttctagaaagaaatagctgaaaaccctgagtcagaaattagttaacacaaaggaagttgaaccctacaggccaagttccaattgtctgcaggaagtgccctgcccagggggccctttgagggaggatttaagtccattctgcctggcactctgtacacaatgttggcaaaaaaagttttttctttccttccgaccccaggcccgcaagccccccataatgattgctttcctcattaagcagtgcaggaggccgcactttgaggtgcaaatacatctctagtgattgagaaatgcaggcggcttctccggcttggtgcacatgtgttacggctgctgagacgctgtctgtccctgaggcagcccgagctgcccctccatcccttgcactgggcatagggcagacctgacagctttcatagtggaagaggacctggaagcctcttctgggtctgagggtccctagcatgtcttcttctaggtcctgcttggatgcctccagggatgggagtctcatctcattccaaagcagcttgatccctattggcagccctgatgatcacatttactgagcacttactgagtgcctataattacttaattaaacaaacattattgagaatctcttctggaccaggcactgtgctaggcatcggggattaatcaatgaccctggatggaggtttcctgccctcttggagcttacgccagattgaatgcaggagggaactgataaatgcaatgatgaatgctttgaaaactaaaagtgtgtagagagagggcaggttaggtgggggcaatgccactgccttgctcaacaaggaggagttactaaagccaaacttctccccgtttctttatgaaaccccacctgacctggccttgggttggggcctttgcataaacaaactattcttcctccaccttttaatgcctggcttttttttttttttttgacggagtcttgctcttgtcgcccaggctggagtgtagtggcgcaatctcagctctctgcacccttctcctcccgtgttcaagtgattctcctgcctcagcctctggagtagctgggattacaggcgcccgccaccattcccagctaatttttgtacttttagtagagacggggttttgccatgttggccaggctggtctcgaactcctgacctcaggtgatccgcccgccttggcctcccaaagtgctgggattacaggcatgaaccaccatgcccagccaaatgcctggcttcctcgtgccattcaagtgtttgctcaaatgtcctttctccagagaggccttttttgatagccagagctgaagctgcctctttgcttttcaacagttcctgtcctaacaccttttattgttttttttttttttttaaatagggtcttactctgttgcccaggctggagtgcagtggtgcagtcacagctcgctgcagcctctaactcctgggatcaagtagtcctcctgctttagccttccaagtagctgggactacaggtgcacatcaccacgcctggctaatttttttttttttttctgtagacagggtcttgctatgttgcccaggctggtcttaaactcctgggctcaagcaatcctcccacctcagcttcgcaaagtgctagtattataggtgtgagccaccgcgcctagcctcctatcacctttgtttcaatacttgccttgcatttatcaccccctgagattttctgattattattattttgctttgagacagagtcttgctctgttgcccaggatggagtgcagtggcatgatcttggctcactgcaacctctgcctcccgggttcaagtgattctcctgcctcagtctcccaagtagctgggactacaggctcacgccaccacgcctggctaatttttgtatttttagtagagatggggcttcaccatgctggccagactggtgttgaactcttgccctcaagtgatccacctgcctcagcctcccaaagtgctgggattacaggcgtgagccactgtgcctggtcgattttctgatgattatattccttgctgcctagtggattttgtctctgcggttgactgctgtgttcccagcccaggacattgcctggcacacagcagccccgcagtcctgacttgttgagtgggtgaggacatgtgaggctcatgctaccctctctgttaccttgaatgagctccacagcaacctcccattttacagatgaagaaatggaggttcagagaggttaagtaattaacctagggtcacacggggatgcatctccagtcagtagaaggtcaagcccatgccctcagttgtcccgatgaatttgtgcaggttttttctcctcctgatcagcccgtggggtctgttctgtgctctgtgacctcctggagcaagcctgcttgctctatgggccaccctcctgtggtccctagacagtctccctggcctccctgggctcccctttgaaaaggacaggaggcttggagagatatccagggctagagttctctggtgatgttgctatggtcagaaagggggaccagccttgctcccccagacccctactgggtcaaatggctggtgctgtggatgcccaggtggttatgcaagggtttctgtggctgggacaccgtcaggaagggatgttgaagaccccaggcccaagccatgtggggtgggggagggccactggtgtgcaccccctctcccaattccggtgtgcagttcttgcctgggggccatggaagccaggcgaggcatcaggccacctgtttgcaatgccttcctgggccacgtcacgggcacagtggcccgcattctttgattcctgaggtagtgaatatcaggcagggggaaatgtggccacacaattctgctttcttctgcaggagctggatttgggggtgagcactttgatacgggccaggagagcctggggtgggcactaggggtcctgagatgagctgctgctctgcatttgctccctccttgctgtggggttttggccaagaccttgccctccctgggctgtgggggcctcttcactgtcctgcctgggtgggagtttgagttctgaaccactgaaccttagccttggaaggaagaaaaacagactgtggctccagtgcacctctggggcagacaacaccaagctccactctctgtcatagttgctgagttggcaaggctgatcccatcattattttggggagcagagcccatgcatgggtggtactgcttcttcctctcccgacactcagaagcccagcatgggtttgaagatcatttactctttaataaatcagaagactagttctggctgaggtcatgatgggatttgaacccaggtctgaccttgcagccagtgcccaggccaaggcactttgcatggagctgggtacatattgctaactcagaactctcatgttagaaatgtttcccaataagatttgaccaatttaggctgggcacggtggctcatgtgggctcccatctctgcctcccaaagtgctaggattacaaggtgggaggattgcttgtggccaggagttggagaccagcttgggcaacatagtaagacttcatctctacaacagatttttgaaaaaaactagccaggtgtggtggtgcttgggaggctgaggtgggaggatcacttgagcccaggagttggaggctgcagtgagctgtgatagcaccactgcactccagcctgggtagcagaatgagaccctgtctcatacaacaacaacaaaaataaaagatttgaccaagctgagttattttaaagtacggaggctgtcaaacagtcttgtatgtgacatgagcacctgcagtctatcttcagtctggagttcccatgtgtgccttgaatggagttgtgtgcactggactctgggccgcttgaggggctctcccagcaccttctgatttcaggatttgatggcgtgtcctgggccttcctcgggcctttcgtcgccgtcgggcctctgtctctcagctctgtgctgtagacacactggcctccgcttggttcttggagtgcacgatgctccatgcctcaggttcctttgtgcttgctgctccccatcactgtcaccatcaccgtctggttccctgcagcttggctcacgctgcttcctcagtgaggctctccctccctcaccactctggctggagctggcgtcttccagcccctgtcacgtcaattattttatttccttggatgcgctgatcactcacagcaatgattttatttctctatttatgcatcttctgtctttttccccactagagggtaaactccctgagaggatctgtccacctcattcccggttttgctctgggacagtccctggcacgttgcagggtctccgtgagtgttttgtgagtgcacagatggccttaaatgcccctgcgcctctcttctggagaggagcgtctggctgaccctgggggctctggccctcctccctgtgtctggctgacacgtcttctgtgactcagtgctggcagttggcagaaagagaggaaggtacctcccagaggagtctgcttcccagaaacacccagcccacttcccccacctgggatcccccaggacagaggaatgcagggacttcttggaaacccctgacttggcccctggagggtgatgacttgaagccccatatttaaatgttagtgacaaaacccaggaagcctcacaattttgtgcctaggaaggggtattggtggaggagaaagaggagaggaagccgccaactgagaattcccagagtaggaatttcctaaacttttccccagatcactgggtgcaaggaagcagccccgatgtgactcaccccgagcagcagcatgataggtgagcttgcacttgcctgcacaggtgtgagtgacagccagagatgggctgttcggcaaggtatgggctgacggcagccttcccttcaaggtcagccccaactctccaccacatggccctttccatctgcacggatggactgggatgtggggagagtggatggcagcaatgctgaagcaggtggccccctgaattgcacctccagagacacatgcgttcgcgggagggagaatctccttaatgcaaagactcccagggtgaacccatttgcaaagcgaggaaaccttttctaagatagaaaccccacccccacccctccccaattcactactggggcctgttcacatttaactaggagttgtggacccgtgtgatttccctccagacgaaactttaaaggcagactctcaaaacgatccctggaagagatgaccatggcccaggggcgagtggaacaaagtgtagaaaggttacaaatcagcgtgtggcgcaggatcccattcgcacacggcgattgctgcgcgtgtccgtaaacgcaggagaggatgtgcgggatcgcgctcatcaaagtggtcacagccccaagctctggtagtgagatttcaggtgttttttactatttttctttatacttttctgtatggcttgtatctttgacatcagtcgcagttatctttgtaatcagaaataacagtaaagcatcgtttttttctgggaaggaaagatactcagaaacacagaagcagttctggggagaaagccgggtaagaccacaggctggccgaatgcacgccctgcatccctgtcaaggtcaggacctgggatgcttgttgcagtgtgggcagattccccggcatgggcgtttcttgtgggggtgggctgggtccttcctgcacccactcctgctcctggcatagcccagggctcccaggggacctcacttctggggcttctgtctttggtgagacttggtgctgctagatacccctgtggagtggtgccttggcttgagaggaggttactctcctatgctgtttcgccaccttcctcgtctctttatttaatgccgtggagatgggaccgtagcccctggactccatagaaaccgcattgtccatgtggaaaagctgcagcctgtggtcacgctggtctttaccatgcgctggacttctctgttgacctctttctgcatgagaggggtgcacacagcggggctcagaacctggtatcccgggaagcacctcgatgctcagaagaagctggaacccctcttctaccaccctctagcagtgaccttccccctcggggcctcagtttccctatctgtaatagtacctctgtcatagggcagggggtcacaggtgggtacccatcaagatactttcccatcctcccatccctgcacggaaaaggggcttcgctggaaagatttccagaaactgttttgaactctgaccctggccatgtcttgcctgtagtaagtgatcaggtgatgtcacccggtgtgatttcttagcaaccagctactttggtcggccagctggcagatgttctcctacggagagagttggagtaattttttccgttcgatgtgcactcctggaagggggccaagacgcgttttaggcagtacctggctcctccttgaattaggccgttttccattctcatctccccgaaggtggttttccagcctcagccatgactcacaatctcagcatacccacaggagggtcagaaaattggtgagaagtgattttctttttaaactcagaggtggaaaatctgcatttactgaaaaatgactaacttggtgttgtccagcaatggggcttgtccaagaaggtctgctttatggaatgatgtgcatgactttaatcacctcagtctaccttcattcatccattcaacacggggttattgtgcacctactacgtgccaggcactgttctaggtgcttcggattccacagtgaacagatagaagttcctgctctgagagaacaatatacttaggtcttatttgtttatttatttatagagacaaggtctcacttattgcccaggctggccttggattcctgggctaaagtgatcctcctgcctcagcctcccaagtagctgggactacaagtgacagccactgtgcacctcagtaccatttattcaagctcatcccctaaccagggctaggctcctccacaccggagggagggaaggagcacagggctggggcaatagccctggttctgccactaacttgccttgtgccctggggacaatctcttgcgtcacagattctgagaaagcgctggattggattggctgtcttcttcagtgccttctccatctaaaattctgtgcttccctgtggttctccaatttattcactgttcttttaaaaacttttatgatctaaaaattttcagtggctcagcaatggtgttttttttttttttaaatgaaatatctcagataaacagaagagaataacgactgtccaggatatacctttcagcttaaggaatcgttcacccagctgagtgccagagtgccctactcttcctgccccgttagggcttggcattcatcacttccctgtatgccttgcttctggagatatgtgatatttaattatagatgatatcaattcttcatttccctgtatgtcttgtttctggaaatacatataaatggtatttaaatactactgatatacatgttttaaaacaatatagataccatattttaccatatagatagtttatctttagcaacttgctttttttttccctctctcaacattatgtttggaagattaatccgtgttgatacatgtagctgtttcattaattttaattgctgcatggtgtccactctgtaaatgtaccacaatctatctatcgatctgctgttcatggagatgtagatgctaattttttttggctattacaaatcatcctgcagcagatactctcacggcggactttcacaaacaggagttttctaggatataagcttctgtgggcagtgactgagtcgaagggcatggctcaaactctttcccccgatctctgtctgcccgctctgctctccccactttaagtaccttctttcccggtggttctagcatatctccggattgtgtcttagtgtccccacttgggtcatgggccgagctcggaggtcagggaaaggtcaggatgctacggctaggggtgccacaactgctgagcactgctgggcaccgtgaggtgctgcttcgggtagatgggctccagctgttaggaggaagtagttcttttgcttcttgccctgagctgtcttagaaagcgcccagtcttggctgggcgtggtggttcacgcctgtaaccgcagcactttgggaggtcgaagtgggtggttcacctgaggtcaggagttccagacctgcctggccagctaaccccatttctactaaaaatgcaaaaattagccaggtgtggtggtgggtgcctgtagtcccagcaactcaggatgctgaggcgggagaatctcttgaactcaggaggcggaggttgcagtgagccgagattgtgccactgctctccagccagggtgacagagcaagattctgtctcaaaaaaagagaaagtaccctgtctttttggcaatagcagtaggtgagcagatgaaagaagcctgggtttgtgcttcactgtgattgataagggcaaccccaggctatgacctttagcttgtcctcttttgaggtggggaagctgaggctcgatgagtccaagcagatctgagatatctgtgagacccgctctcacaggaagctgctctgctctttgtcccacattttcttcccgcacccagtggccaggtgattcctttaacggtgcaggaaattaatcctgcacttttataggtggggaaacagagcctggaacagcaggggccaacattgcattccactcacagaatgccctccacacagagttgatgtaggatgttgttacaggtggggaaactgaggctcggggagaggaagtgactggcctgaggtcatgccaagagttagggacaaagctcagatgaaattacgtacttcctcagatccccctgcacctgtcctcattttagggtatttctctgccctgagtaagctggtgttggggcgcagatcccagttggaccttctgtggggtgaggggatagttcactgggtcccagtcccctcagctccatccccgtgggctccccatagagagtcctttcctgcctttgatgcaaattcttgcactttcctgataatattctgggctcttcttaacacgagggggtcagcggcaaggcatctcggcaatttataattcttgaaaattctgtttggtgacacgagttagcatttaatagacaccctgccacctcctctctccctattgtgacaagctcctggcagaatccttttgagactaagggtaattgcaccacgctgcgaacgggaagaccacgtcgcgctcgagtgcgcctcaaaaatgtcttcacaatagacagtcaggtacgagtttgctgggcttcaaggtaatgatttaaacttaatttgacccttgatgagggagcccatgtttctgatcagatgcagtctttaagtttgggcttgcctgccatgccttcaatagtagcacaaataattccttcataacaagtgcctttcagaggatgtctgctgctgacagctaatatagaattattgcccctgaatgcatttctgtaattacttcccagagatctgtctttgtgttagaagacatttcgcactttagtaacataagtgttttgggagagcacgagcaataattatgagcagtctttctgtgaaaataaacctaaaaaaattataaaagctaatggtaaaattggttagagccagggaggaatttcatctgaatttgattcatgtatatttattctgagtataataacctttcctgcatggaaacttttttttttaaacaaaagcaataatgatacaaagagcccgctttctaatttttgagccagaccgaaactgaaaactgattaaaagtgacaagttactcaagaatgaagaaagaagcctgatcgtggagctctgataggagacatttgcggtaatggaaaatgaaatgattcacagtgtgatcaataaaaaattagcagcatttaataaaaggtttctgcttcatgttgactaaagaacatcgccagcagtttgaaatccgagttaagtgatggtttgaggaggagcctgggggtggtgagtggggtgtggggtgtgcgtgtgcatgtagatcacactgatattggccatcaggcagaggcagccaggtccctggggtgggtctggaagtttccttggtgcggttcacttgacctttggcctgtggctaatccccccatgtctctgcatctctttgcctaggaatgtgaatccaggggtcctaggctgccaaacaggccttgctgtcactggctggggggtctgagtgcagtccccatcaaaaccctgaccccgagctgggtacaccccaaccccgagctggggacaccctggctggccacatgtgtgctgagcgtggggacaccccgcctggcctcgtgtgtgctgggcctggggacaccccacctggccatgtgtgtgctcggcctggggacactccacctggccacgtgtgtgctcagcctggggacaccccgcctggccatgtgtgtgctcggcctggggacagcctgcctggccacatgtgtgctgagcatggggacaccctgcctggctgtgtgtgtgctgaggcttctcggacctctgtggcagacgtgtcatgctgcccaggccattggctttgttctgtgccttgcttccagaatccaggtttctggagacatcagagaatgtcttacagcccacttgtggggctccaaacaccctcttggggactgacgggaagtcggcagaaagccggcagacctgagcaagtggatgagggtaagcggtggggagacccctggggtctcctggaggagccagctgcttgcatggatccttggaggtgggctgaggctgccaccctcctccagtgagtgggtgcctagatgggggtttactgggagcggctccttggaatctgagtgtactcctcctggggtgggatagcacgggaaagccactccacgagtcctgctcccttttctccaggcgccacttccgtattccctggaacgtggctgcgcaccaggctgtctccatgcctggcaactggttaatttttaaaggctttttgtggagcctctgcactgcgactggagggagagggggctcccctggccctccaggcccacctggaggctcgttggtaggaggatcattggtgggaagggagctgctggcttttgggttataatagaggccctagagccgggtctggggagtcccttgagccccctgtgtcccggggcagcaggcaggaccaggggcctgcttcgggcttcattcctgttgtcccatccctccctggaaatacagacctgtggctggatctttaaatgtcagagtgggaagggcccttccagacagcttcttcaacacatccttattaatcacctgctgtgtaccaggccctatgctgggtgctgagaggtggagaagggggaagcagagtgaacaaaactgatgcggacttgcctgcctggagcttgcatgcccaggagaccttcgcacatccagcaaataaaatcatgaggactgctatgataagtggagaaggagaggtgcccagcgagctcccagagctcacaggggaggcctgaccctgtgggggtgcagattcactgagctgagacctgaacggtgaggaggagttgggcaggtgaacttttacacactttctattttgacagtgaggctctttctgcaaagtgctgctgcgggaccctggcgtggaaggcgggcggcagcggggctccctgggtgtggaggtgttgtcttagagttctgtcctcaggcctgcccctggcacagtgttgagctgctaaggtgcatggtttttaaaattgcttctctgtggtccatgccttaatttacagatggggcagctgaggcccagagagggcacaccttgcccggaatgcacagcgatgatgcctggcccctgggctctgggctctccattcacaccgcctctgtttatccttggctctgagccaaactccattagcctggccactggttctggttttaggggtacagatccctcctctccctgcttttcttcccctaaccgggatcctttttttgcagccacaaggggggtgatttgcgccccagcatcctagccttgagttctgctccaggactgagagcaattaggagtgtcaggcactagcactggccacaaattagctggatttatcgagctccccacgctgcctgaccatcctccctcccctgcccaccgccggccctgctcccccatctcccccttcccagagacaaaacatgacagcaaggcgagggcagaatggtcactgcctcaggaggtcacgaggaggtaacagtgcacaattttcatggttccagggtggctttgtctgactgttcttcattactgcacgcggcgagatcagttttattaagattgtaaggcttggaggagtgacaccattaactacttgctggaaaaataaatttgattttttcttgcagggggtgtttgaggtttatttttctcccccctgcttccctcctcccctcttccctccctctcatctgccttcttttctttccactcattcctgacccactgtagttgagagctgagtgcaagtgtctgtgaggttggggaagctgccatctctctttaccttccggggattttgtggcagctgagccctgcagggagggtagagtcattcattcgtgcatgtatggaacacccataaaaaacaaggtccttgtgaccaaatgtcagcctgtcctggtcatggagctgtgtatggttctttcatgtgtttgcatctagaacaggggctggcacatagtaggtgctcagtaaatgtttgttgactgattgaagatgtggaggatttgtgtctgacatggttccaacgtttagggagctcactgctgaccagcgcctggtgggcagagacctggagtgaggtcacctggaaagtggtcccatagggagcatccacagcatgagtaccatcctcattttctaggtgaggaaactgaggctcagaagtacaagcaaccaaggtcttgcacaaaaatggacttgaactcagttcctgaatctctaaagaagagacactttcatcactgcttagctgactgctcagctgactgctctttctggtgaggaatgagcagatgaccctgtgctctaggggctctgaggggctcttgctggacacactccatggcagagaccctcagtgggtagcccccaggctggaccagccctccaaggcatattgtttagcccatactgtgtttcttaaaacttgaagtcaacatttagaaatcatccagaaattttatagagaacggtggatttcctcctccttcttcttcttttttttttgagacagagtcttactctgttgcccaggctggagtgcagtggtgcaatcttggcttactgcaatctctgcctcccaggttcaagtgattctcctgcctcagccccccgagtagctgggattataggcatgcgccaccatgcccggctaattttttatttttttggggcatttttagtagagacagggtttcaccatgttggccatgctggtctccaactcatgacctcaaatgatccacccgccttggccccccaaagtgctgggattacagctgtgagccatggattttcttctttaaaaaaaaaaaagcagcaggtgtgtttgcagtgctgaccatctagaggagttgagacccctccctgggtgggcttctgtgtgctcactccacaccccattcgcttgtacactcatttctgtaatttgtgtggtggtgggggaattggagttgagagcttctctccactcgttatccgagtgactgagggggctgtctcagccatcggagcctcagttttgccgtctgtaaaataggtctggtggtaacgtctccctgacaggggctgggggtcacgaggcgaaagatacaaaggaattggaagttctggcctgaaggaggcgattgccatcacactgctagtcctttaggttctagacttgctgacaactgaagatacgttctctggaagtttctagtcatttctgtgggcctctgcagagggttgtcctgtatcagtccctcatggccagacggagcagcccagcaaggcttgtgtgatgtagccgaggtcaggttcaatgtctctgacggaccttggcttgaaattccatccacagagccacaggcaccgatagggacaccggggtctccccagacagccatcaggaagttgcttccttatttaagaagccgaacttggacagcaaattatgtgttaaaatatttgcctagagctctgctgccaaggggaccctttaggctgagtgttaaatgttaccccgctgcctgcactgcaaatattttaaacctgaagataaataatggctgccttttggaatttggggccagcaatggatgcacaagccgagtgcggaattggggttggtgggctctttgcccagccctggccacacccctcccggggcctgcttgagagagtgttcatggaggagagggttcttctctgtgagcaggacccaaacgaacactgaatagaggctaagccagggctttgacctggtgctcagattcagaaaaggcatcttgccctcgggaacatgtttttaggaaacgtgcaggctgttagggtggaggatattttttttaatgaaaaagaaatgtcggcggggtacagtggctcacttctgtaatcccagcactttgggaggctgaggtgggattacttgaggctgggagtttgagaccagcctaggcaacataacaaaaccccatctctacaaaaattttaaaaattacctgggtctagccgagtgcgttggcaggcgcctgtaatcccagctactcgggaggctgaggcaagagaatcacttgaacccgggaggcagaggttgcagtgagccgagattgtgccactacactccagcctgggtgacacagcaagactctgtcttgggggaaaaaaaattacctgggtctgatggtgcatctgtaatcctgactgctcgggaagctgatgtgggaggattgcttgagcccaggagttcaaggctgcagtgagctgagatcgcatcactgcactccaccctcggtgacagaccaagatcctgtctccaaaaaaaaaaaaaaaaaaaccaaacaaaaacaaaaaaacaaacgtgttgctccagggtaaagactttggaaatggtaggtatcttcctggaccgtttttccctcagccacctacagagggcgggcacaagaacagtgggcttgtgggttgtaagctgatcacaccccttcacggaggaggtggctcgcaccttactcaggatcgcacagtctgggaaggggaggattcacacttggacccaggactttcctctcctgatggagtggattttttttcttttggtatgcatggacattttcgtgccttgcaagagggcctgtgccatgacattccttgtcctcctgcatcctcaggagcatgtgaggcctcctgccagacccctccgggtttgacgcctccagcttttgtctgcactgcgatgctgcacatgttggtttgaatcataacccagcagcaagacagtgcttaccagctaccattgtctcaagctgtactatgagccaagcatctggctttgtatatatcaccttattaaaattatgtgacttaattaaatgagtcccagagagggcaagtgacttgttcatggtcccccagctgctaaatggtggagtgtggatttgaacccagacaggctggcttcagagcctgtgattcttttctgttttttctctgtcatccccgacagtccctggaacatgcatccagccatctgctgcttgtatgtgtcattacttaatgactgtctttatttcaacaacttggttccatcagctccactgcactcctctaccccagtgtcccgatggctcctgtacagttgggttctctggtaacccctggatatgcctagaatgtggcgcctggtggttctgctttctgcaggggtgggtggtatggtctcccatccaaatctgattgggagaagaagtgagaggtggggaagcctttccagggcttgctggccttgctggtcctgctgaccccgctgccctctcactctcacctggcagtgttcctggctctctcactttctccgctccactggtctcccttctcccctgcaccctttctcctcccgtccatccctgctctggcctcccctatcccctcgaaaccccacaaggctcctatatcccctgatgtggagctgagctgtgtgcctgtctcatagtggccatgcattcaggtgagccccgcctccccactgtgaggttggagaggatggcgttcatgagattcaggcttcttttgggcctatgaggaatcagaggctcaggtaggggacttgccttggtcaaggtcactcatggttgggggctgaggtgtactggagctaagaccggaatctgggtccccgaccagccccagccctggatgccggccccttactacttagcgtatcctcttgggcattcatttattcatctaatcactcatttgcccaccccatatttattaagcatcttttctgtgccagcctttgtgtgggctttgaggccgccaagatgaatggggttggggagcaccccgtatgttgcagcaaatgtgcatgtgttatgcctggcacaccgtaggcacttaataagtatttgtggaaagaatgaaggaaagaatgggtgagtgcgtgtgattgttgaccctggtttgtcgcatgtctctcaagctctgtcctaggtctctctgtctcgggtgcatggaggcagctcctggccccctgcctccatcttgtggatactcagccatgtggccccagaggtgggacctctgatggtggctgggaggttttcagtgtgcccagggctctctgctgactagctgactcccgggacacgagagcaaggaagaggcatccttctgggtgagtttccttctgattcgtgtgctggccaggggccgacattggctgacccttttctagctggcccttgggagggtgaggccctggtggccctggctcatgaccttgcgaagccctgctgggaaggtaggaaatgtgctgttctcagacctggcagcctgtgggcagtctggtcccctggggcctctccccgttccccttttcctggcagtggacccagccagctgtcccctgccccgtgattttgcaggcattccctttctgcctttccgtatagtggttaagagtcaggatcagctgggtgcggtggctcacacctgtattcccagcacttcgggaggccgaggcgggtggatcagaagtttgagaccagcctggccaacatggcaaaaccctgtctctgctaaaaatatgaaaattagccaggcatgatggtgcttgcctgtaatcccagctactcaggaggctgaggcaggagaatcacttgaacctggaagacagaggttgccgtgagctgagattgcaccattgcactccagcctgggtgacagagtgaaactctgtcttggaaaaaaaaaaaagagtcaggatctagagtcagaagacctggatacaaattcctctctgcccttcctggcacgtgctttgaatgggctcctgagccttgttttttttttttcctcattgacaaagtgggtgagtccattgcacctacctgcagaatggggatatccattgtacctaccacatagagtttctgtcctcatcgaaatggggcagtgtgagtgtaaaatggtaccaggagatgctcacaccatactcagctcccctcagggtgtaggggaggctgtgccacctccctctgtccctggcaaggccctctgtccctggcaaggcctctgctgctccttccctctagagggcatggggccatctgtcttgctgcacagcgtttctgcagggtccgctgtctgctctcaacgtcatcatcttgaatgcaagccctttcttaagggcagtagctcagtgaggtgggaaaattcactacttttactttattttttgagactcttgctctgttatccaggctggagtgcagtggtgcgaacacggctcactgcagcctccaactcctgggctgaaacgatcctcctgcttcagcctctcaagtagctaggaccacaggcgtgcaccaccatgcctggctgatttttaaaatttttgtaaagatggggtctcactgtgttgcctgggctggtctcaaactccataggttctcctgtctcatcctcctaaagtgctaggattacaggcgtaagccattgtgactggcctgaaaattcagtgctttccagcgaaacatgattgaggtgaaaggttttgttattgcctctctttgctcatagaatgtcccccaagtccatatcttgggttcagggaagctgggtttgggtgggtgtggtgtagtggggtttcctggtgtgggtgtaccctcttcctcctggctgcaggaagaagctggcaggacagggcaacctcgtcatatgtgaggctgagccatttgagattgccaatattcaacttttttgacctaaaaaatggcacctttatatgattcaatctaatacttatcgtcagacaataaactgcactgtggccccttcccctccttctgcctctacctgtgtggggattcagaggcctgcttttttgaaaccaatcaattaattcactcatccattcattcaacatttattgagcccctactatatgtccctctgtatgccagggttgggggaggtggcactgagctaaattagacacagctcctgccctcatggagcttatagtccggtgtggggcgagaaggtcggctatccattgctacgtaacaaaccatcccaaaatgtaatggcctgaagcaataatttattactacttctcacagtactatgagctaactgggttcagctggcagtctcactgggtgtttcttgtacagttgcagccgcatggtgtttggagctgctgtcatccaaaggcttcttggggtgggatgtccaagatggtgtgctcccatggctgaagtcggtgctggaagctgggagctgttgactggagcccctatgtgctctctctccatgtggcttgggcttcatatattatggctgctgggcttgaagggggagtgtcccaggagatgcagggggaagctgcaagcctccttctgacctagcctcagaagtctagaatagcacttctgttgcatcctgttggtcaaggagccactgagtctggccagccccgagggggactgtggaggagaattcggtccctcgttatgatgagggagtcaaggtctccctgcagaagggcaggtggggtgggagatattgctgtggcagtctgtggaaaatgcagcctgccaagggagagagaaagtagacaaattagcccacaaaagcatgagtgcacgtgatgctgagagctctgactgcaaagggaagagagccctggggaaagagtaatggggccccaacttccgtaggtgcccaggctggtggagatctttgggaactgtgtgaagacttaacggaaatcttcctgctggagatcaggagtgggaagccctggaccaaagagacttggaagtttatggggttgaaagatgaccttcaaggctgtggagatgggcgataagtgagagagatcagcagagccgttgctgaaccttaggggctgtgaccaggaccctacatgggactttgaggggttttacaaactcccaacacctggctcaggtgttcattgcgtcttactgtgaggaaaccatgtagtagagtggttaagagtcacatgcagtgggcttgaaactcagccccaccacttctctgtggcctcacttaagctctgtcacttcccagagctctgctttcctcacctgtaaaatggggatatgatgacatcaactcataaggtgcctgcacttgattaagcattgagtgcttaatcaatgctcactgttcttggggcatgcctgggcaaaaggatgcaggtgtgcacatcagaaaacagttgtccatcgtggaaagcatgagctctgggaggtagggaatcttgtcagctggacggacaggtcggcgttcacagcactggttcggtttctgtcccatgcacatggccctgagggagaggtccctgatttgaaatccatttggctcgggccttccctgagcgagctgtcttcatgctgctgcagacagcccccaggaggacaggggaggagccagagggaaaggagccagccggctgttttcgggaagccctccccagccctggaggcctctgcagaaaagcattgagccattggccttctcctcggcctgttgaagttgcttcactgggctctggggtgattggaggaaccagtgagctgcagttctagcccaggtcattgaaatgagccagcgcttgtgatgggactcacaaggcagggccaggtgctgggcctctgggccctatgttctctgagtttgcacaggtgatgtccagactcaggacagggaccagttgaggggcctctggggctggacagagcagcacacaggacaggcggagctgggttgaaggagtagggaaggtccaatcattccatccccaggacttactgagcaaccgatcaggtgggcctggaaaagaggaaccccagacggtctccaggtaggtctgatgtccttggagctccctgttgttagaacttctgcctcctgggccttggagagcttggggctccaacaggcccagggacttcaggaaaggtgtgctgcttaatgaacacgtgaacgtgtagattcgatcctggcatggctttgggtggccttgcagaggctcagttttctcatctgcaaatggaaaaataacaccatttattcttttgtcttatggtgaggttcagaaactcctgggcatgaaagtgcattgcaagaggcaaaccctgcctggggtggaggccttcctgttctccagcgcctgattctgctgaatcagcagaggggcccttgggtcttcagggaagtcccactccccaaaacttcttcaggcccctgagtcttccctgtcttgtgtcacctccctgagggccaggctgggaccccttgggagcccagaggatgaggtccgcgcctttgtgtggcctgagctcgccttcgtctccatccctttctgcacagccaccctcccttcccattagtagccggccataggggaggtgacagttgcttaaaacagatttatactcttggatgactttatgggtttttgccttataaaaacctgagagttgacattctgatttatctactcccgagtcaacaggatgtaccagatttaaagagatcaaatacattgtgatgtttgtggttccagttgtggattagatgagctattatagaaagtgctgccaagtaaatacggcaaaaaaataacgaggggataatttaaatatgtctattaaattgtgtgttaagtaaagtagcacaagtgtggtgctgattgtaacttattatctggagggtcggtgtagtagataaagccagaattatggctcttttattttccctttctacagaacattttttttttattaaggaaagactgtaaacgaggaatttcggagacgggcacttgactgtgtaaccatggttgtatgatgacttacaatatcgaaggctccaaatgatatttctcatttctttgctttctatttcttaccctcactgcagcggcagatcagattccctgagataaatatgctgcctgacttttaatgggatttctgtattgccaggagttggcgcgttctgataataaaagaacctaaaaactgtacatcccttaattggtaagaagagagatgttttgatgggccacaaatggaaacattgatttttactgcctccgcgcagttccaggcggcgtgtcgtgcaacgttccccgccttggaaggaagcagctggctctccgatgagccgatttgtgttcccaggttcttgatgtcgggtgcttggaagggcatgttctgtgcagacaggagaaatagagcccttataacattatctgtttccaaattgaaatattcacaggactgtggtttccaccttgaattgagtgcattctttgcttcgtgtctgtctttcttgctttggcgcccgccctcaggggtttgcaggttgtgcactgagccttttcctgtaactgtgatgttgcatgtacacacatgtacatacaggtgcacatacacgcacttttgcatatgtacatatgctttcaaaaacacctttatggataataagatctctttctttgatttaaatcagtgcagctagtttccggatgggtaaatctgttttccaggacaggctgtgggaagagacaacacacacttttattttccaatccgagggtctctgcattttaacacacaaattttatccattgacatttattaggattactgatatattctgtgggttatatttaccacacgcttttgcactttgatttacaagttcctggtgtgtcttattaatctgtaagattggggctgtgctccattacccacagttgtgcagggaagtgaactagaccaggagtcacgaagttgagctgagcctctgtagggtgcttgggctgttgcttcttctggttggatgccaggtaccttacctgtgagacaaagctgtccctctctgcagggggttggatcacatgatcctttgagccttctttgagtttaggatatgcaagactgtgaaatggggctgtgcatatataatggtggctttgaagaagcacggaacacagcacaattgcaaggcatcattatgattacgaattcacttttccctatagattagccactctctgcacagtgctaagcacagtagctgttttattttaaagaaatcagtgagatcattccacgactgattctaactgtctaggcctgtaccaggtcacaggtgacactatttattttattttatattttttagagatagggtccaggcccaggctggagtacagtggcacgatcatagttccccgtaacctcgaactcctggtctctagcaatcctcctgagtaggtagaactacaggcacacaccactataccaggctaattaaaaaaaaatttttttttttttgtagagatagagtcttgctatattgcccaggccggtctcaaactccaggccttcagcaattttcccaccttggtctctcagagtgctaggattataggtgtgagattccatgcccagcctggatgcattttaagcttgagattcgaccatccatggttcttcaaacatgtgtacttcctttatttcagagttggacatctttgcaaagaactgagccaacgtcactgccctgggaggcctgttgtgtggaaggcgaacttggctaagagatctcccagctctaaattgcaaggctgtggggaaaactaaaagtttaggtgtgttaggaacagctgatggaggctttaaaaaggtgtgtaactgaatctggtttttaggagacaaataaggtttttcacctctccgatgggtcacggcccccagcatccgtgcacagaggggagatgacaggaaatccccctagaagatttgcaccaagaattaaagaatctggttgagaattatggcaccacatgctacaaaaaaaccccatctattaatatactgagaggtgtcaaggataatggaccccgggaggtagagtaattaaatgtatcttaataaatgccgggcgattcttttaaaaccctttcccaagaccccatcagctgacatggactgtattcttcctgttggcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggaggtaatgcaaaacagccccaggactctgacaggtggttacacgggtaattggacatagcaacagcttgaagcctcaagtgagattaaagaattaataatgtaattttacagttaatgtcattttattgtggtgtcttgggtaccctgtatccgccttttaaatacaattaaaaataaaagcaacagctttccggcaggcaggaattagatggtggtgctctgtcccggccccctctccccgcaagctgtgctctggtactcaggccatgaatgggtggatgtgcaccctgaatttctggaaggccttttggaaacgcagtaattaagaggttgttagtgcaaagttaagcagcttaagtgtggaaagctgcataaaggagtaagctccgaggcagagcttctgatgggatgaggaaatttcaaaggccaaggacagcccgtgaaaaagggacctgtttccaactctgtgcttgacctcacacttctctgagtaggaggagaagggtagctgggagctgcttctgctagatttgactggagctctgttctccatttacttggtgccttggagagggtgtgtaagaccagttttctaggagctactgaagacttcaggagttttgtgtgtatatgtgtatttgtctggggtgattggggtggggagtcagagggcatgtgcattccctgggatgtggaagccatgctacagggatgacacatttctgggctctgagatctgcagagggagtccataggacctgtgttccttacacagtcttcctgagagaccttcttccatcagggttgttgatgaagctccttggatactggtttgtggaagaaagcctgaaatctcaggcctgcattctaaagggaacccatcacttgttgaggggaacatttactggtagggattagattggcacccaaagctcttgctttttctactcctcatatcatcttggaattttgaaattaagtgtttggggaactgctatgatttgccctctagtgacatctgtgcctgcacagggctggctagaccaagttcccattctcaacctctggaggaacagatatttttaaaataataataataataataataataataataataataataataatagacctaagaggaatcttacagttttggacattttggggcccagtaatccaaaccccagtcatttggaatttgtgatattgcaaccagaggcagaggtgatggttaattttcaattctaaatcagaattagaagggacctatgaggttagctttttaagtctcctcacttccccaagggaaatactagggcaaagggaggaaaaggtgattgcttggccggggtcacatatctgtttggtggccaagctaggacctcctctggacactgagctattgaccctcatcctacttgaggaataatattatagatgttggtatatttcttgatttagccaagaattaacatggaatcttaactataagagaataaaatattgccacttactttataatcaactaattgatctaatgaaaagttattctctttattttctaaatgcaagagaataggccattctgtgtagttgttagagcagggccccacaccttctgctaagctgtgctttcttgagtccctgcagctcttagaggctgccccttcctccagcccttcaaatcaaggagattctcctgtctttcagtctcacttttaagaatggtggcatttcgggctgggcacgatggctcatgcctgtaatcccagcattttgggaggctgaggcaggcggatcacgatgtcagcagtccaagaccagcctggccaatatggtaaaaccccatgtctactaaaaatacaaaaattacccaggcgtgatggcacatgcctgtagtcccagctacttgggaggctgaggcaaaagaatcgcttgaacccgggagatggaggttgcggtgagccaagatcatgccactgcactctggcctgggtgacagagcgagaccccatctcaaaaaaggaaaataaataaataaataaaagaatggtggcacttctaggtggaaaaaggaaactgggaaactgggctatatgtgagagtctgagccagaaataagaactggtagctaattgtgctttggtccccaggaagaatcctcctcccagtggcaaacccttctctcatcagcctttgactccaggtgaaatccatggcagccctgtttgcagggtccccagctgtccttattgatgctggtggtatccaccgacactcctgcccgcttcctaacaggaccctgctaatgacctccgtggggacgcaggagctaggaatacccccaaatcctggagcattggaagggagtcagaaattccttgaaagaatgagggaaacaaccttgcctaagcgcatccctgagaaattcattaccgcctggtaaaggcatgacccagcctgggatagtttcctagatgtgtgaggagttactttcccccaggtcttcggttcttaggattactcaatgatgggataaaccaccgggaattgcgtatgtattattcaaaacagttccctacctggaatgcctccacacccttccattgtgcagtggttttcgaactgtgttcccagaggtatctctggggctatggtgtggtgtgtttggggtgtaggaagtgagtactggggcctgtcagactgagggggcactgatgtccagtccagtcggagcgattcaccttaaaagtctgttttatacctggggctttagcagatgatgttgtttgaaaattggcctctgatttaaaggtttggaactgatataaatgtgcaatcgcaggctccccctggccaggctgatgggtctgctggactctcaccactggtcactcgatagaagcccaatagagaccgtgtccgagagggccgcgctgggcgcaggctgggcagaccatggtgccctgcagatgtttctgtaggaaccagagggtctgcccacttggcctggagcagagggcctgcttctcaggaatcgtgacctggggtgtgaacaaccctccccttcatagggactgttgctgctggaacgtggaggcagcacgtgcctccccaaacgggtgtgtcctggcagggtcagcccttgcaagccattggccttctggggagagtgctgtgtgttggggtgtcgggggtgtatttgtgggcggtgaccgtgaatgtggctcttcctgaaaactgcttctgtatctttctatggcagttggggtggtgttgagggggagattgggggcagcgttttgctccctcagaatctgggacagtgctgtggtgaggtttgggggttttctgaggtggggggatgcttacccctcaggggtgggaggggagcttcatgccagaatggccacgatggaagacccccccgtccccaacctggagcccggcctctgtgctaaggagccttcatttccagttgggagctcgagaaggcacctctctgttgtcctcagcaggagtggcatgccgggcccatgagctgttgaagcgtggactttaaggtctcggacaactccatcaagtcctgttcctctctctccctctcgctctcatttgtgtctgaggagaaaccaaccttaaacccatgaggtatcaaacattgcatttttatgacacaaactgaaaagagcaaaaatccagtcctctccattcattctcccgccctgatgtctgtttgatttttctttgttcctctccagcccctggccacaggatgccacacgttcgcatgcttggggttgtgagcacatacgttttcacgttctgtgtttgtcacataacatgttatgaaggggttcccatgtggttacctggtcttcgccatttttttttttttttttttttttttttgctagggggaactctgtcttttaaatagcagtgctcaagggcaggaagcttgggttgcaggtactgtgtccatactctgaaaatattaaatttagactaagatgtctgtagatgaggctttttgccacagtgtagataggggctgactgggtaagtgtgatgggcttctctgttcctaatggagacattgtttgtgggcaccaagtcaggaaatggcaaaggatttggtggctgtctgaattgccaaggatgggcagtccctgtcaattcaggtctcactgatttaaatcatgttggaacaaataacgtcataatttgtgaagcgctggccaagcaaatttgggtcctttaaactgcagcagggggtgtttatcatcatcttctaggagccaggaggacttggactgctttagaaagtttctctaggaactgcctggggtaccatagaagcaggtgcgagaggtttggtttgcccatggggtgatggtggttttttatgtgctcactgaagccagtcacctgtgggcctgtagtctggatttttcacttcctggtgcaaatactcccttttagagatactgcaatttatgttgacccctgctttggcctgaattaagaggctggcagctggagggcgtgtgggtgctccgtctgcgctgtcatgcttgagacctgactttcctagtgctgttcctcagagtgtccacagtgggctgtcagcaggggcctgtgctgtgccagtcctggaacatgccagcccaggtccccggggctggagcacttgacagcttttggggtctttggcctctttgctaaaggggctgctggcctgatatatggctttttgttgtaggtagtaagactgcgggctccaggcacttgccttggaatagaaatcgccttcaggaccagtttggagctcagcattggtgtcttcccttcagctccgttccctgatctctgagttgggccaggctcctggcgggccctagagaggtggctctgaagcagatggggtgcgtgctgccctccaggggctggcagtctggtgctgggggcaaatgtgtgagcaggtgttgcctcctccacactgcagtgaaggctgtagtcctgatattctttgtgttttcagtgcctactgcccgcgaggcactatgggactctgcctggaacacacgccctgcagccctccctgctggccctctgcagcccccacgcccacacagtccagagcacccatccctttctgtaattgtctttcacgtgtttctcacccatctctctccctactattaagctgcatgaggacaacagccatacctgttttgttccccgttatgttctagcccagcgctagagtagaattcaacatgtttgttgaatgaatgaatcatctcacctagtctttataacaatcacctttggtgtccaaggtgacgctgtcttcattttttttaattaattagttttttaagagacagggtcttgttctgttgcccagcctggagtgcagtggtgccatttgtagctcactgcagcctcgacttcctgtgctcaagcgatcctcccgcctcagcctcctgagctaggaccacaggcatgccccaccatacctggctcatttttaattttttcttgtatggatgaggtcttgctatgttgcctaggttgatcatgacctcctggcctcaggcaatcctcctgcctgggcctcccaaagctaggcactattttctaccattcgtcctcattttgcaattgggtgactgaggctcagagagctggaggaccttgctcaaggttacagatcgtgtcagtaaaggcaagctctgaggtcggaacagcttgcctgtgcttgagaacacagattggggactgtgagcaatttcaaactaaactccagatggcttttttgaatgctcaacttccaaaaaaacaagaggggggactttgttgaaatagcaacagcaaaaaatgtgttcctggtgggttaattttgcggctcccctctccgctatcccttcttgaggactgggaccaaagagtgtttccctggcccctgtgaaaggtaggccctccttttctggcgaaggtgaaatgctgctgtgcaacaagccgggtggaaagttaattacaccctggtttgttcagctgtggccagagtgacctgtgggccccaattacagggctggtgctgtgtggagctggcacctttgccagccgtgtgctgtcggccggctggccagcgcttgcctttttgtgctggctcaggcccctttcttgctccaaaagcatgaggggctccctgccttactgacttgcggcgctcctcgaactggctctgttttggtcgtgcagtgtggggctggggccagtgccagacactgtgctacctgatacacaggtgctgggtgtgggctccttctgcccacagggaatgcactcggggccttggtgtcagttgacttcacatggcgcaaaaggctaggggcttgagcacaattgatatccgccccctatcttaagagttttcctgcatgcagacagcttccagttaggaaacacagagcaagaaatggtcccgttatgtcagccacaaaatgtataaaaaccagggagcaaacccagtaagaaacattcaaacggcatggagaggacagacaaacaaaatcaattatggtggggggaagacagggaacacagaagagaccttactcttattcttgtggaaagattcagtatcataaatatgccaatttcctccaaacgaacctattggcttaatgttagctaatgaaagcaatggtaagatttgtttagaaatggatgtgctgaatttatagttcataagaaatagtgggtatgcaggcatcagaaggaatcttctggaaaaggaacagggagtggggacaggaaccagctcagattgctctggagcggaaaggattcgaagtggtgtgaaacagaaatggacccaaatacaactggaaatctagtgtatgagaagggtgtccctgcacgacagtggaggacagatggctctctcagcaactgggattaggatgaaaaggtggccatcccccaaaaaggaaattggatccttccctcactcctgacaccaaactcaatcccaagtggatcaggaatctaaacataaaaagaaaactttaaaatactaaaagaaaacagagagcttttaaatattttaattcaatagtatcagagtgaggaaggcctttctaaatataaccccagtgtcagaagccataaaaccaaagtcaaaacattcaactacataaaaataaaaaaattctacattgtgaaaaccacagtaaatcaagccagggacacatatcacaggcaaaagatgttttccttaatgtgtaaggaactcctacaaatgctaagaaaatagccaataaatcaacacaaaaaaacatggcaaaggctaggttgaggcacagccaagcctgcttgagatgcctggccttccccaaggtctgtaccgtctctgatccattggtgccacactggtggttagatgttttgaatatctcccatgtgcaaactacagaaatggacagaaatggaaccagagaaagaaatactagtgggatcctaaatatttaaaaaatatttattgggaggccgaggcaggcggatcacgaggtcaggagattgaaaccatcctggctaacacagtgaaaccccgtctctactgaaaatacaaaaaattagccgggcgtggtggcgggtgcctgtagtcccagctactcgggaggctgaggcaggagaatggcatgaacccaggaggcggagcttgcagtgagccgagatcacaccactgcattccagcctgggcgacagagtgacactcagtctcaaaaaaaaaaaaaaaaaaaattagaaccccgtttatagtaagggaactgcaaatttaaaccataaggaaataccattttaaaaataccagaatggcacagatcaaaaagtttgccaacaccatctcactggtcaggttgtgttccatgatgtccaggcttggggtcttattctcttccctctccgcaggattgctttggcctgtggctagaacacatagtaggtgctcaaggaatgtttgttcttggggctaaggaggctacagccctcctgcaaggcaaaggggtgtgtgcagtaagaaaagtggaaatgccatggatacagtgctttgggatatgagatagaaaaaacagaagttctggacatagtaggtcctcaattaatgtataatcagaagggtaagtttagagatggaagagatggttcgttcatacaataagtgtttctttagtgtgtgctattagcagggaccctctgggctctagggatgtggaggctattataaaaggtagctcagtggagaaggtgttcacttcacaaaaggatgctttgacttgtgtgatgaagtgctgtggtggtctttaaacagcctccttctctagtgtccttaagaggggctttgatgaacagagacgttattctctatagctctcaggaagatgctgacctgctagcaggcttccacttgggagggaagtggatgggcagggtggaccaccggccagcctgggtctgcttggctggtggcatttgtggaagccttccctaaattgcctgccccctgccctccgatggcttctgatggggaaccatccggagtaagctggggaaccagcaggctgcatagacggtggttctgagtcttggctcagacagctgtgtcttgggttccttcctggtggtaatgtggtggtggtggggacttgtttcttagttgctgacatttttattcaccgcctgcgaagtccgcaggttgcagagcatccctcccttgacttgattacatagagcgaatgctgttatcacactgttgggcctgtaaacctccccaaaattggatgacaaattaacaatatagaaggcaggggtcaaggtgggaagattctgcatttcttgtgttttccatgggaaaaaaggcatagaccgtgtctatgtgtctacagtctatgtgtctttctggaggttttgaggactctccaaagtggaggaggtttttgcttctttcctacccagcctgcttgaccaccttcatgattttctgaataattgagcttcttggattctttggtttccaagggtgcgccagagtgggatccagtgtggcgcctggcacgatgggtgttgctgctgtacaaagcccctgggatgagcctgggggttgattctggagatggttcttggggagcgaggtgggctgtccccggtttctgttaccttcctggcagcagccaaagcttccggtgtcctcctgggcccaggatgtacaccaaactggcctttaggctggttgtacatgtgttcccggtgtggtctgggtccagcctgctgttgtccatttcatcttgggagtttccagagggcacctgtcagcaagcagtgataccatacctgctgtgtattcggggccgtgaatgcctgtgcatgggtgttcattcattcccgttaagggaaatgtatagtctagctggaggatgaagttgctgtgatccttttggctgccagcacatagttggtcctcagttaatgtgctatctgcatagagacttggctcaaattgacaagcagaaaatagaggattcattggctccaggaactgagaaatgcagatgtaaggctggcctcaagcttggtcctccagggcctccagagacactgccccatgtctgttgacatgaaccccatcaccgtgtgtacatcagcagaggtgccccagcacctccaggctccaccttttcgactcagcagtgacaatggaatgagcagcctcttaccattgccagggtagaagtcctgaggttgactctgtagaatggccaggaccaagactcacccccgcccatgatgcggccagggagacaacatacatgttagcaagggtcagggttgggtgcggggaatcagggcagctccatgcagaccactgggcctgagagctggggaggggctcccctgaatggtggtcaggagccacagacatcttctttaggaggtaggaattacatgcagacaaacaggaagtagtaaaagagtgcaatgaaatgccagattgtcaggtatcagttatcaattgataaccaatacttttgcttttgacagtgtctagtcaggtaatcttagaattttagggaagcagaatccttggtgtgtatatcctcaaaccttttttggtttgaatgtggttgaaacaatggcagaaccagtctctcaaacacagccagggcactgactggaccaggctccttagtgaggtagtacttgtcccaggtcacacagggaggtggtagcttagccagcactctctgaggttatctgctaactgctggtggggggtgggattgcagctcccagggtggacaggggactagtgcagcctgcagggcacccatgttttctggcaggaggtgcccgtgtatatgcagctcctgcctggctcatgggtgcttctgggaatgccacatcgagctcactgtctttgaggtctccagacccacggacctcacactgtttgcactggaccttttctttgtttgcatcttgtggaagagtgactttgacccttgaattctaacaaacttcatagaagttgtgcccccaccttgggtgttccataaagccatggtccccctgaacctctgctgcttggtcctttgggggcagtgctctgggaggtggaaggtggggtaatggtgtgtcaagccctcgtggcatccaccagcggcttggcccctacaatattatgttcaggtctcaggccaggctggagagaggctgggcagccaccaagttagtcggagccttgagcctgagtggctcaggtgcccagatggtgttgagaggcaactctgaaatcagccagctatgctgaacctctctcgtgcgttcctgagaaacccagtatattagttcattttcacactgctataaagaactacctgagactgggtaattgatgaagaaaagaggtttttaattgacttgcatttcctcaggctgtacaggcagcatggctgggaggcctcaggaaacttacgatcatggcggaaggtgaaggggtagcaaggacatcatagcatggtgaatcaggagagatagggtgagggggaggtgccacacacttttaaacaaccacatcttgtgagactcactcatcaccagcacagcaagggggaaatctgcccccatgatctaatcacctctcaccaggccccttccccaacactgggaattacaattccacatgagatttgggtggggacacagagccagactatatcacccaagtgttaccaaaaaaccacatcatttgccatcagccagagggagaaagagggatgcagctacgtattctaaaattgcactaacaaggtcttttctttattctgtagatatttcaataataagttttttcccccagtgtattagtgtatagctctaaaacctcagtgtcactgagccagctcagggcccgtcacgtggagctgctcttcctttcccgtcaggtctgctttttcattaggccggcacttcctgccctccttatcctctgtctcacccctgggcgggaaaagcaaaggccagagccccccagagaggccctgctgcctttctcctggaggtgcttgtgctaattctggattctgttgggcataaagatctgaaaattgtgttccctgagtaatcaatctcggttactaccaatttgaggtttgcaaaagctttgagaaatgcctgtgggtgaggataggaatagcctccagctgggatcctgacctgattttggggtaaaagaggcaaatagaggggagttgttctagaagagtcctttattataactggctatggtctgaatgtttgcttttcccccaaattcgtttgttgaaatctaatccccaatgtggtagtattaagcagtgggcctgtaggaggtgattaggtcatgaaggctctggaagaatgggatgagtgctcttacaaaaggggacccagaggactgcccagctccttccaccatgtgaggacgcagcaagactgtgttgtctatgagaaatgcgccctcaccagacacagaatctcccagcaccttgatcttggacttcccggcctccagaactgtgagcaataaacatttgtggtttagaagccatccagtttctggtattgttgttatatgagcctgaacagacttaagacagagctgaaaagtgttgatgctctcttcttccattccttactccacaattccaggcactcaaaggaacaagcaaacttaacggatgaaagagaagtgtgttccttagaaccacagcatcccctggcacgtgtgcgttcattcacagatcttttatttttgagacagagtatcactctgtcacccagactggagtgcagtggcataatctcggctcactgcagcctccacctccttggttcaagcaattctcctgcctcagcctcctgagtagctgggattaccacacccagctaatttttgtatttttagtaggaaggggttttaccatgttggccaggctggtcttgaactcatgactcaggtgatcctcccaccttggcctcccaaagtactgagattacaggtgtgagccaccacacccagccacagaggctttttttaaaagcatctactgtgtgctgggaactgggtgagcaaaacactgggtgagcactgggtgagcaaaacagacaacagttcctgcccttgtgtagcttactgggcccctcgataactttggccaggggattcttgaatgtactcctatgagttggttggtcccctccctctgtggggtagtccagtagttcagtactggccaatgtgtgcatgagtggtgtggaaatgaagaacaggagccggttcactgccaaagggttatttactgtgctctgacgctatgtcagcagaagcagaaagagtgtctgttctgtgtgttgctggagggagtggttcagggaggacagagaaggagagatctcagggtcatgcttgcaagttggaaggttgggattccctgccgaccagtgtcagacaaccaaatcctaaccagctgaaatcaaacagtgcaatgtattggctcatgtaaatagaaacctaggtgtaggactatcttcaggtgcagctgaatccagggactccagtgaagggcgaaggacccagtcttcctgcatctcctggctctgaggaatgccatgatggcttttggctcaggtcaagtcaagtgctctgaatagcagacctgaaaagtttccccagaggaaatcagggtgctgctagcagaagaagtggggatggatgctggccgcagaagcagcctgaagagagaaggagctgaggccatttaacctagacagcaggtgacctgacctcctgaactgaggggtaggcaagagcttggctggaagtccagccagccctaccagttccatgggggcctgttcctatgatggtgaaggtatggcttgagtggctgatgcttttattattgcctctgggtaagatgcctctgtgtgccagggcagtgggggagtggggatgagacctgtccacccctttctccattaatgttgatactccaagggccagaccaggaccaattccagaagtccccagggacacctgcctggcctatgtgtaaggagtgatgttttggttggtgagagtctttgcaagcctggagatgaacacatcagagggtggcgggggaggagagtgggatgcaggcttggggctgagagatgggcatgtggatttatcaggttccttcaaaccttgagatcctgtgattgacatccctaacatgacaccctaatacagaaaaataaagaacatccccaaacaaaatgagaaaccaaccaaatttatctcccgctgactggggcttgcaggtcaaggagtgctcccagcagatcatcccgtaatgcggattccactttcctctggtcacagcctccccagcaccccagcccactggcctagtggctcagaggggcgatcaggaggaactgcttctagtgtcgcagcaaaagccggggagcagggagaggcgggggattcggaacaggaaaagagcaaggaaatttaactctggcactggtctaaaataaagcgctactattggttgagtgttttggcagtgtttttaaacactctgtgccaactcagagaaaaaatgtacaggggattataaaatgcttcattttgtgttaaacagttttattttggagttgactggctaggatttggctgcctttggaaatgacgtcatgggtatgagggtgcatgtgggaagactgaggcaggcgaggtggctctgcaggtgggggaatggcagccagcttgggggagcacacctgcacctctgtccccgcccttggatatggagtgtctcagcctctccaagggcttggctgagcaggttggtgctgcctcatgatgggggtgatgaggtcagatctgctggagcgggtctgacccctctgagggttggtggggtgtgttgtgggaggtaggtggaaggaaggtggctgaggggcaggcagcagggagacttgggaggggcaatggctggcatctgcctgtgggcacccagcctgtacccagccttttctcctcaactgccctccgctgtcctcaggacagcttgcatctgactctgctcctcccccactgccctggggatgaatccactcccctgcctggccctgtgcctcttgcggcttctcctcctcctgcttgattatcacagctcactgcagcatcgacctcctgggctcaagcaatccttccacctcagcctcccgagtagctgggactataggcttgcaccaccatgccccactgtgcccagctacttttttgattttttgcatacatggggtctctctatgctgcccaggttggtcttgaactcctggcctcaaaaattcctcctgcctcagctactcaaagtattgggattacaggtgtgagccactgtgtctggcttttgttgttgggagacagggtctcactctgtcacccaggctggagggcactggcacgattgttgctcactggagccttgaactcctgggctcaagccatcttcccacctcagcctccccagtagctaggactatgggtgcacaccaccatgcccagctaagtattttatattaattttgaaaaaatgtggtcttggtaagttacccaggctagtctcagactcctggcctcaagtactcctcctgccttggcctcccaaagcactgggatacttgtgccagctgccgtgcccggcctcagttcctcctcttgagccgtcaacaggccgtgctcattccactgcagggcctttgcaccacctgccttccccgggtgttctttcagcttttcacgtggatagctctctcacttccttctgtgtctccaaggtcacctcctcagcgcggccctccttgctgacaccctcccccgtctcctgcagcagcggctcccttcaacgccaaacacatcacaccatttatttcctttatggcagtgattgcttgatgtttttgaattattgtctctgccactcgaaggtgaccctcttaggagtcccgtcctgtgctgtctccctcatgcctgttcctgtctctggccttgtggcagacctggtgcatagtaaatgctcagggaatacttactcagtgatttgttggaagtggcctgggtggtgctaagttgttcccttggatggcacgaacaccaggaattcttgggggcttgcagctgggccgtctcctcgggactggaaagaagccttcccctcctcaaattccaccaagccacacccaactcacacctcccttcccattccagaaatggctcttcccatggcttcctgggggctggagagcaggggccgcgggacaaaccccagggtgcatttcggtcttcagtggagggggcagttcatatttcagaccacccatttttatttttaaattaattttttttttgtagagatggggtttcactatgttgcttaggctgatctggaactcaagcaatccacccatctcagcctcccaaagtgttgggattacaggtgtgagccattgcacccggcctcatcagttttttttttttttctcccaggctggagtgcagtggcgagatcttggctcactgcaacctccacctcccgggctcaagcaattttcctgcttcagcctcccaagtagctgggattacagacacctggctaattttttgtatttttagtagagatggggttttgccatgttggccaggctggtcttgaactcgtgacctcaggtgatctgctcaccttggcctcccaaagtgctgggattacaggtgtgagccaccgcacctggccccatcagtttttaatttagctcctagtatgtactaggccctggctgcgtgttgaaatatagcagcaccctgagtagaccagatccctgccctggttggggaaacagataataaggaggtaagcaccgggtgcttcgtcataccgtcataccatcatgtgtgaggtgatgaataaatacaattggctcccgcccttcggagcccatgatctcctgggagaatgagccgtctgcagggcacaggaagatgctccggctcctggggatgggatttgagaagcactgctggggcgttaagcaagagacccagagctgggcttcagaagcaactgtgcctggtgggttcactctctcctccttcctttaccacactgccgggctgacttgtctgccctgtgggaggcgtgatggagttgcagggagaaagccactggtcattgactccacacagccagatcacaggggagggatgggggccctggcagcgggggagtgagttactggaagattccctcttcgcccacattctctgggcctgcgtgtctgatcactgactttctgtctctccagtctcacggatggcatctttcacactgcttcctcgaatgcctttttatcacagtctcaacaaacaccttgcagacatatttacttaaaaattctttaaagaatacccccttggtcagggtcccaacagaaaacagatggcgcactcaaaccgggagatggaggagcatttaataaagggcccatttgcagaagcgggcaggggaagaaggggagctgtccaggagtggggcatcatcctgagaacctgccagggtgcggggaggggcatttaggccacctggagagactggctgtagggaggctgctgagggagaggggtgcagcagggcagggcagaggctgggagaataactaccccaaatctgtctcctcccccactgcagtcgctgcaggaacacagagcaggaatggaccaaggtgggggcggatctagaggggacagtggcaaatatcctttgtacccaccccactccctgggctctcttagatcctgcggatgagcaaatgctcagaagtcagattttggagatcagccccagtttatagcagtttcctgtgtgatttgtgtgggggagtgggtggtgccctgtttctcctggaccctgaggctatgtcaggtgactgtgggcttttagcttttggtggtcccttttcctgggacaagccaattgccagcactttggtcttgctctgtaaggccacagatgatggagcagaggagcagatttgtcagactggaggcccagcgcctggcaagtggaggtgtacaaatggaggcctgagctgccaaaactttatttgcataaatggcgacatgaatcagttatcattctgattaaatccattttctgcttaactcctggagaaattggcaatggaaggcattctgtggctgtcacctgcacgacggtgtcattctgtttgtggcttcatagggacaatggcagtggagaggtcaaggaaaagcaggaaggtcaaggatgcatccgcggagcctctttgttcattatgtatttccatcacacgtggtttccactcgcggatcgcgccgctcccgggacccccagaggataagacaagggaaccggtgctctgagcaccaaagctatttttatttgtgtgcagggcaaggtgatgtggcggctgcaggccgaggttcagccgtccctgacacacagaattggatattaaggtggaattagaagcttgagtctgaggaggtccctagcgagggatgcattcaggatggcattatgactttccaaactgcttttgcagagggcagtgaggggagatgaaggagctgttttgggggccaaccctcagcccctgagtagccctctatcagtggattatgaattgtttgtttcccgaaatcaaattctctttctattgtttcttttttttccaatggcactttcccctctggacattcctaagagctttttttctcctcttcacaaagctttgcggcaccccacctgctcaggcacgcgagccccaccgtgcattagcagtgcgggcgcccgttccttctgtgaccaatgcaggcccctatgttatcagcatcactttgcctccaagtgaggagcagagaaggccttccctcattattttaaaacaattaaatgtgatcaaatatcacagtaatacataaatgtattctttattattattatttttttaaatagcgacagggtctcgctctgttgcccaggctggagtacagtggtgtgaacatagctcactgcagcctcctgggctcaagcgattctcctgcctcagcctcccaggtgtctgggactgcaggcatgtggccccatttctggctaatttttaaattatttatttattttttctagagacgaggtctcaccgtgtgttgcccagggctgctcttgaactcctgggctcaagccatcctcctgcctcagcctcccaaagtgttgggattagaggcatgagctactgcgtctggccataaatgtattctgtttgtaaaaatttcaaagataggcttcaggctgtccccacccccttgttaactactgttattaccattttggctttcttgattccagaccttctcctacacctttacgtaatactgtatttcatagattctaagacacattttaacatttctgaaattgaggtgcatctttcaactagtggcttgtcatggtttaattgacagtgggttttgtttttctttttcagtggtctgtaaaataatggtgcattttaccatccacggtgtcttacgttcagtgaaatatagtgttatgtgtatccacagaaacaatgttatattgatttttgattaaaaaatgaatgataccatattggatctatcattctgcaacttgctttttttccatttagtattagacctcagagagcttctcacctcagcgggtacatctccctacttcttattagctgctgtggggcttgcgtagtgtggatgccccgtgctttatgcagcaggcccctggtggggggtatttagggtgtttccagttgttcactatagtaaacattcttgtacacgtctccctgtaggaacacttttttccatggttgataaggagaaggggcatcgttgggcccagcctctgtaaccttctctttccttcattccaacattctgttccattgcatcttattttatcccacctgctctactcatcccattccacccctctcattccatcctatcctgtcccatcccatcccatctcaccccgttccacagtcgtcaccctagtaccaacttggctttacatactgtgcttgaggggcccacagaggggagtcagtacctgcctacccggcagcttctggtgcagctgggagagaaaccctgaaataagacttggatctgagccccatgtccccaagtgaagcctgggggtggggcacaggtgttgtctggtgctgagggagacattgcaacctcattttacactcattctgggtcctctcaggctggcaagcccctcgggaattaaacagtgttccttagcattgccacgtgttgtcacctcttgactggtatggagcttaaatgagaatcttccccaggtgggttccttaaggctggacacctgtttgactttttgtggagtcccctctcttgttttcccaccattaagagccacctgtcattccagtggcacccggctgctctgcacagaggtgctgtgccatctcaccaggatgccggggatggagaggatgcagggatggagtctccctcactacttctgccgcctggtgacttttgagcagaaagtgccagagtcggccctgaagtgacttcaggcagtgcttcttaggcgtttaggtccttatgatcacttggaatcttatgaaaatgcagttccatttgaacagacctggggtgccggagagtctacatttcttacaaactccctggggatgcagatgctactgaaccacaccggagtagcaaggactttaggaaggataggccaactatggaggcagggaggacctgggaagtgtggaagaagaattttggtgagagctgaggtgttttagggtccaaaactagacatgacgagcaggtcacctcttcggactatagattattgtcattattgttatttgtacttttggctcgctatctctagcaactgtgtgcaagtcaagggagagtttgttggtttattttaggctgatagatttgttctagagtttcaactgttctacatgtggcatgtagtggagcataattcttcattctgaggactgttccttgcttggcaagacattcagcatccttggcattgcccactagatgccagtagcaacctccctgattattgtggctgcctcagtccgctctggctgctataacaaaatatctgagactgattgtgtgatttacatgcaacagaaatttgtcgttcacagtcctggaggctgggaagtccaaaatcaaggtgccaggagattccgtgtctggtaagggcccactcctcatagatggagacttctatgtgccctctggtgcaagggcaaaaagggactaataagctatgttggggctttttgataaggaaactgatcgcactcgtagggatggaaccctcatgacctaatcacccgccaaaagccccacttcttaataccatcatcttggttaggtttcaacatacaaattttggggggacgtaaacattcagacgatagcagtggcacttgaaaaatgctcctgaagggcggttgctgcccctggctgagagctgctgaactagatgcaccccttgttgagggcggggaccatggtctcgtttccatacctggagtggctggcatcgtacctggcgtggtgtaggaacctgataaacgtgtcttccatgaaaaaaggcagcctctcgggcactaagatgatgtcattgtgaagaacccctgcttcagggaagagtcagatttgtgtgcctctgttacaccgagcagggtggcacctgctgagaacagcagcgtcctgacctcgagggatggttgggggagacaagaggcaggaaatgatggtgcttctgaagtcagctttgtttccttggctttcccccagggctccgaagctccgttttcatatatatatatataaacggctgctgaacgtttgagttttttatgcgtttgtcttttctgggccgagctgctggaggataaggcctgtcttgttcatccttatgtcctcagggcctggtacatagtaggtgtcttgtaaatgtttgctgaaataactatttgaattccttagggaaatcagctcttcccaggagctcagtgatggatctttctgtttcactgaagagcaagtttgtaatgtgaatctttaccccccgcccattcattcatggggttattagttcattcattcattcaacaaatatttactgagcacctactaggtcccatgccctgtgctgaagcaggaggaggcaggcattgtcctcactgtggagctgagggtgtgctggggggaacagacattagtccaagaatcagacaagcagtgggaaaatgacagcctccgcaagtgcttctaggggaaggtacatccatggcctgtgaaaggctgtgcgggtagcacgtgttgggtccctgtggcatgtgggcagtggaggatgtcggggaggggtccctgaggtggtagagttggagctaagttctgcaaggaagagcagggcatggtggctcatgcctgtaatctcagcactttgggaagccgagacgggcagatcacttgaggttaggagtttgagaccagcctggccaacatggtgaaaccacatctctactaaaaatacaaaaaaaattagctggacatggtggcacacacctgtaatcccagctactggggaggctgaggcggttgaaccctggagacagaggttgcagtgggctgagatcttgccgctacactctagccaggggggcagagtaagactctacctcaaaaaagaaaaaaaaaagaaaagaaaaaagtggtgggtgtcgtatccacaggctcagcagctccgccgatccagccagttcttttccaccaagaggttgatctttggagccatctccatgctgtagatctgccggcaggttccgtagctttcccctgttgctggtggcatggcttctcatggcaccgctgatgtcgaatgtcctcagcgagcccattcatggccacgattctgtgttgggtcccgcacgcacctttcacggtccttttctgtaacatcacagtcctggcaatgaactccagatgttttgccctgaccttggatttaagtctccactctgcaggccctcatgagctcagtcccagcccgccttcttttttaaggctgaatcatagaatcgcttgaacctgggaggtggaggttgcggtgagccaagatcgcaccattgcacattagcctgcgtgacagagctaaactctgtctcaaaaaaataaataaataaataagtaagtaaaataagatctgcaaatctgcaaggaagtgcttagggcactagtatttttttttaaagcattagaggatgcataagtaaataatacgtaaattttatcaaggcttctttatagttattttataatttagtgttttttattttgaattatgagtagggaaagtgctctttgtttttttttttttttttgagacagtctcactctgtcgcccaggctggagtgcaatggcgtggtctcggctcactacaacctccccctcctgggttcaaatgattctcctgcctcagcctcccgagtagctgggattacaagcgcctgccaccatacctggctattttttttaacatttttattagagacggggtttcaagatgttgaccaagctggtctttaacttctgacctcaggtgatccacccgccttggcctcccaaagtgctaggattacaggcgtgagccaccatgcctgacaaatgctcttttctgtatataggttctccccacatcttgaccctgggtctgagaggagcaagaggtaagtgggtggagcctagtggggagagtactgcagacagtggggagagcatgtgcaaaggccctggggaagcagaggtgacacagggcgtcggggtaccggcagggaccccgggggtaggtacccagggagcggtgaggtgagggcatggcatggggctggggccagatcacatagtgcctcgcaggccatggaaaggggtggggattttattccaagcctagtgggaagccattggaagaggtcagcagaagggtgacaggatccggtgtgtgtgtttaacagatccctctggctgctgtggatagcatgggcaggtgtgtgggttgtcctgggggtttgtttataggtttctccttcctggctggcagtcatgggtcctgggaccacctgccatgtgaggccgaaggtgcccttgtgttgttggtgcccggagccattacctcactttgtctgggttctggactttctcttctgtttctgggtcaatcagacctggccttttgaagccagatggaggcagaagaccttcgggtgatgtttagatctctaagttgctgtaaatctcactgaagtgacctatttttcttccatgttgctcttgtattttttatgaatggatgataaaaaatgtggcagggtcatttgttttaatttccttctgacacctggattctgtgtttggtggcagccatcccaccagtggctggaagtctgcctccaggcggtggagtggccctgggcccagttcacacctggctctgttgtgaatggtggggcagcatgccctggtccccacaaggcagtgagccccctttagagcacaggactggagggtcaatgctggtacccagggatgggattcttccagcgtgtctgtctgattggccaggcagctgtggccatggctggcctggaggtgagaacttgaaggctctatccttttgggactacagtcctgcccatcttacggagggtccaattgttaaatggaaactagttcttcaaggcaaactggcttcacctttgatggggagtggtgaggggtcagttctgaggactgacagcctccagtgcccatgagaccaaaattcattttttttcctagggtggccatttgtggtcatgtctggccctattttccaggctatcttaccactccccacctcacccttgcctttgaagtgtgtggtgcccttgcccacgctgttctctctgcgttaaacaccaccccgcagtgtgcctccctgtaaagccatcccatccttccagtcttcctggaagcctttcctgacctctacacagatggtcgtccacgtgccttctctggggttcccagaagcaatggagcacttggacactcccttgtttctcaaaatacatttttcttgttttatgcttgctatataaacttactgtggggccgggcgcagtggctcatgcctgtaatcccagcactttgggaggccaaggtgggtgggtcacctgaggtcaggagttcaagaccagcccagccaacatggcgaaaccccatctctactaaaaagacaaagattagcctggcgtggtggtgggcacctgtaatcccagctacttgggaggctgaggcaggagaatcgcttgaaccagggaggtagaggttgcagtgagcctagatcgcaccactgcactctagcctgggcaacaagagtgaaactctgtctcaaaatcacgcacaaaaaataaaataaactcactgtggaaggtctattaagtacagagaagtgaaaagaagaaaatccagttataacctagagatccagagagtcattttggcattcatccatccacattcttgttctgcaatctgctttgtttttgtttacccataggttgtaaacagcttatcatattaatattgtccaaaagcctccttttaatcggctttatactgttccattgtgaggttgtgctcaggtgtgtattacagtgccctatagctagacagagggcactccccatcccagtgatccacctgccatgctgtgaccatggcaggctttgtgaagggctggggccttgactctgttgaatgaatgaattctcctgcattcacatctgtctcctgatgtaccagataagcctgtatttaaggccttcttattctcccatcccaagtgccctcccacctttttcccagaaagaagacaggacagcccaccgtgctgtcatttaacctttaaaagtgcaggccaatagctcgggcaacaaagaggctggaagggctaggcaggagtgggtgcaaagggtggcctcctggaggtggcagtgttggcacaggtttgtaagtggcttccaggccaggagggagcccagggagttctaggtggcctggggctgctgatgagcaggagagactccagttggaagtggaggtcccttggagctgggaagttttcatgcctggttccaagctctggcagccatatttgaaggcccacagtgcagctgaggtggcactgtggtgtttgggagtctggtgtgtgtgtgtgctctgcatagcagttacatgggagtggaattctgtcctctgtgtgtgatgagacacaaaccttcatactccctccagatctactggagcctgggaacaaagccttcatttattcaagcatgcatgcatggagtaagcaaatgttcactgcatcttcctctctatcaggctctatgctggttcctgctctcacagagctcacagtcttgggggtgagggtacagctatcccagtttgctcatgactgactgactaatgggcttcctggtatgtatgtagcattttcagttctaaaattggggaagtcctagacaaattgggacaagttggtcactgggttactgtcatccaaggagaaaggtgtcagagccctgtgggtaggactgagggacccagaggagggaggtcacctctggatttcctgttataggtgtggcatgcttagtgggagttttcgtggagtgtcatggagtggagttgagatgccctagaagggggttctagcgaagattcttcccttctccttttcagttctttatgcccctgctcctgtgttccccctctggctatggcacagccagggtgttccagaggggctaagactgccctctggaaagtggatccctgagacccgggctcagtcatccctttctgcctccaggccctctttgaagaacagggttctctgaagtccactctgaaggggaaacctgcccttcctcccttgcactgaatggagtctactggggtagacttaaatggcttttatttatggcctgggcgcatcactcatcagttgcttcactcacctcttcactcaccacagggctcctgttcatctcttatgtgccgggcactgggctgggcacaagctggtgatgcattgaacccagggtggggcatagaggagctgggagataaacaacccctgccagcccagcgagttagggcgacctaggagccagccagctccagaagccttagcagcttctcacccaggacagctggtgggaaggaatccattaagtcagcagagccggatccacccttgctgggcctccctgggctgaccccatggggctcccctgctaggtgcctctctggagcctttgtccctagaagtctgtgaggggccttgggagagtggaatcttgcacccttctctaggaagagccatttgtccattgaaatgtaattttctcctgaaaggaggaaaaagacaggaagggccaccaggttgaggataggattctggtcccagatccagagtaaatttccagcctgcaggtaaagtccctgaaaaatgtagggctgggtggatgggcaccctgccctgggaaacccccaccccatccctgactctaaatgccgttgtgcctaaaaattaaattgaagtcagaaatgatttttactccttcacatgctttaaaaaaaattcaatgaaggaaaaccccaagctgacgtaatggatagagtacagttcaaaaagaataaatgttttcaagaaagaaatttctaaaggagatttctttgtgtgttccagcggccatgacacggttaagcaggtcgcctctctggtcctggtgcacctgtggggaggttctagcggtaaccgcagagcccaggagggaggagggcccagcattggaatgcgggcgtgtgcatgcctgcgcgcctgtgttggtgcatgtgttcgtatcaacacatgtacacatttatcaaattacatctgcttttacctttaaaattttatgaacatgagcatatggtgctttatcctgccatggagtgtgtgtgtgtgtgtgtgtgtgtgtgtgtgtgtgtgtgtgcgtgtgcacacaggcaggttggcttggcactcgctcctccagcacacatgggtctgtggccgagaaactcctttggagatgagagcttggaagcgtgtggggctgtgggtgagccagcctccccagggccccagcctggcccttggcccaccaggccatgaatacatttccatccatctctggcccccatcacctaggcagctaattcctcggagcctctcagccttattaaagtcacagatcactttcttgagcttaatgctgtcaagaccaagcgtgccccttgttctgaccccctcccgccatccagcctctccttgagggctgggggtggaggtgaggggcccgccagccccccgcctccaccctgccccctcctcaatttgatcggcatgacgccttgcagtgatcagtgaggtcgcctcaagattccttcagtaaagccctcggcagggatacaagggccgtcacagctgtgctgcacaaaccagcttccaaaggcgaggatggggctggcccactcgaagtggctcctcggcagaggggtgcgaggctcgctgctgatttggagaacacttctcccgtccctggctgccttggcctcccctgttatgaaatatggatggtaccggttccagcgttcagagactcgctggcagtgtgagcgtctccaaaggcccgccttgtgcatgcacctaaacacttcactgagcaatctgtcaacatgtcagcaacacatgttttgtaaaaagcttccagtgggagtaatgactcccaccaggacttccaaaatgctttgaattcagcagatttctattgcgggcatcccctggggtgccttttacaatgcctacatttcagaaatttgagccacagacccctgggggtttcctttcataatgcctcaaaatgtagggttatattgttggaagtccccatggggtctttattaatacctgaattctgaggaactggaaattacacagggcactgcaggggcccagatccacaccaggaagaagagaaaaactctgtggggagattttttttcttcatgcaagagtgaaagagaagaatttgctaaaggacaaaattgagtgtgtttgagcttccttcatttaatctgccttctagaacgctacagtaaaatctgcaacggggaaggggggaaatgacttttctatttttaaatctcactttgatattttaggggccagagtatgttctctttaaacacccagtgtcgaagaggtattgtttaaaaataaattatttttctttttggtaattgaaaacacctctgccgtgcccctctcctgggtctcccctcttccttagagctgttaagctcctgtagcgcgctgccgtctcattatcattaaccgtttggggtcggtttgagatattggcccacttgctcccctcccctcccctctcctcctctcacctcccctctgcacattaaagatgagaaaatcaaccttggagatggtccaatctcccgtgcgaactggtttcaaatcctcgtcgctggttggggccatcagcgtaggaaatatcaaggctggctgctacttttttgcaagcattttgctgctgaagtcttgaaaagacagaggggtgccttcctgtcccccaccctacacacacacgtgcgcatgcacgcacacgtgcatataccggcttccacgtgtgactcatctcagcctccatcacctgcacactcacctttggttctgtttttttaaaagttacaagacttaaacatgttaagccttagggttaatttaagctgccttttttcattctaaatctggcactgactagcttgctgaaaagaggcctctctatttctattacaatctcattgactgggacaagaaaataacattgagagagctaacttacagcagccaaggccaagaaattctaagttgctgataagaccctcctcccttctcctccctcctctgccctcctccctcttccctcctccctcctcctttctcctgcctcctccctcctttctgccagagtgactggatcacacaggggactcaggaactcacattttccccccttggtgagactcccagacggtgttcaaccatctgtggtcccgtgggcccagcagagggggcccaaggaggggggtttgcccatcaggagctggttgggtcagatgctcacagagatcctctgcacccaccccgagcaggctgattaattaagcaattgcatcattgattcaaggtttgtgatttggtgccagggcgctggcggctgcgttcctgagcattgcttcccctccctgggctgtgagttgcaggatccctttcctttctccagcctgattttcctccccagtgccaatcctggatgttccatcaggaaaggaacggccccctgtattccagctgcccctccgccccagtcaggaagccctgtgcctcctggggtgtcatgatgggtggggctgtgggccatgagcagacctcaggaggggccttttctgctcccagcaggccctgtgggcttcagcaggggcttggagacggagagggcagggagccctgtggtgctgatttgacatttttagctgaagacctttgttccgaccaatttccaagtagcttggggttggagtgcattctgcttttttctttttctttttttcttcttcttcttcttgttttttttttttttttttttttgaaatcctgggcctctttttcctttttctttcaaagcgatgaaatagaatctgaccctgggaatcccattcttgccatctctttccccaagccaccctcttctgcctgatcaaggaggcctggatttcctggcagcctctgggtctcagagggtctttggccttgaaaccctgcttctagcccagcccctcgcccctgtcttctgagggctgcagactccccagggaggctgatatcctggcctggggccctggctcgggagctgctgtggggtggggtccactatttttctgtcctcctccctcttggagactttggccctcacttggcctcagggtcagtgggtggaagagccgtaagataaaaatttagcccacttcccaagaacacagacttttcctaaggaggcctgaaccaggcagccagagccccttcaattttcatccagtggggatggcatggtaagagcactcaaaaataaacaaatcaaaactgaaaacatcaaaacaactaaaagccggacaatagaaattccttttccttgtgagccccaaagtaaacaatgaagataccacctctgggaaagaggacatgacaaacttagattcttttgaaaacacatactatttgccaaatcagatggcaaacctccttccagcatcaaaatccatgtggttccagggaagaacgggggcagggggcgggggacggtgtgggaggagcctttgcgcccccaaacagatgtccagggaggcgaggccagaaagcttccgtggagcagtgatttattttattttttagatctagatgttttggccgcatttatttatttatttccaaagggctatttttggcgtctgcctgggctcctttgtagcaaagcccccttttctagaatttcctttcctttattagagttacagctcagctttgtgcggcccccgggggagccggccagccgctggcaatttctctcagacacccaattaccccctgacgtcagtgccgcctcgcccagctcccctgggtgcttccatttttccctttgtaacactaatagctgactagctaagtgcctgtcggctccttggcagaggaggtgattgtgttttcggctggatactaaatccaaaaactatgtaaaaatgtcaataggtgagtgcacattgattttggttagtcacagtgatatttgagcccctttggggactctgtctggggaagtattttacaagaaagataatataacagaaaattactggagctccgcgggtctctggtgggtttcttagaggcctgctaaattgctgtagaatcaacaaatgctttattaatctaaatttgtggttttgttctttcttctcttcagaaggttggagttttaatgatgcaggcggctccggcggccgggctcggcagcgcggcccgcaccttggctgacgggctggggtaccctggctggtaatgaactctcagagggtccgggagcagggcggctgtgttcccagctggcttcctggggaatgtggagcaggcgccgggcccaccgcttgccaggccgaggtctgtgcgagcagataaagtgaggggctgagggcctggaacagctgtggcgggccagactgactgggagaggctgataagagcccagaaggagcccaggcgggcggcgtggcagcgccagaaatctgacggggtatcacgactggcaaagaaagttaaacacggccggatcgggggatggttggcggacctgcggagaaagataatggtaattgatggaatcaaagtcgcagcacagccttgtgttttcttggcaattaattcccccacccctccccagtttctaaccccctggcattcttagagcccaggatgccccgtgagcaggctgcacactcagataatcagcacatgccctccttgcttcggggggcgggagcaaaggagatgcagccaagaaaagacacaattagagacctggtttaaaaaaaaatgttacaaacaaacaagtcagaaaaagaaaaccccactgaaaagttaaggacgtgtcactccgggagctcatctgatcttgctctggaagggaaggaagaaaatcgatgtctttgtaagagtgccgcactctccatctcctggctgggcaggacaatgtggagtcgggctggtccctgcacacacacacacacgcacccccagatgctgctgtggggaaaggcggcgtaatggggcagtggttcatgccacagacagatgtgcccgcctctccccgtgtatcctcctgccccctctgccttttgtcccttgaaaggcattgctccccaacaatgggctggttaaggctgattcgcatcaccgcgggctcatgccgcctgcccgcaccgtaggtaaggctttcagctggccttttgttgtgtcactgacaacgtgcacacgctgggacacacctgcttgcagaaacacgcgtgaacgcacaactctggcactcctgcccatcccactgcacggtccagggtactgcttcctgggccagtcctgttgtgccccagggagcccctgtgtttgctccaggatcttaagcaaataaaacactccaaaaaatttccctagagtcttttgaaattaaaatcagtgtgctgtaaacctgcgtgtcagtctggcatacgagacgcaggcctccaaataactggaaattgtatgagggaattgatcaggaatggccttctaggtggttctacctggtgcttggcttggactccaggagcctacttggtaggtaattagcattttggagtgagccctcctattagaaggtgatgtgataagccagagggacttttaaaaaacatcatgtgcttgttcccttgcacaggattcctggccttctctctctttctgggagctgctctgctcccagcccatctctggttaggtgacatcagttctgtacccagaaaccaggtgacagaaggacctggtgggttagggactgagaggcttctgacttattctgaccacttgtcctgtctactccatcccaccttggtgagggctgaaatgagtcttgcttggaagcaaggtcctgagccctggggaattctggaaggtcgaagaaaggtgtgggccagcccgtcaccagccagcctcctcccccacgatggactgcattcctgcgtcaaccctccggcgattccctgtgagctttgtctccttgacagggtgggaggaaggagggtttggaaaggaggcccccctggtgacttctgagccatcaaagccagcccccctcctgaaagcgctctgcaggctggcagctgttttggggcctggagaggagacagggggctggtcctttgtcccttcgaggagcctcctggaggcccaggcctgcatggcgggcagccacattaaccttccaccctgggtggggggggcttgcctgaggtcaggcacttaatgaggccaggtccctggctgtcccccgccaggactctggcaacaaaggcccagtcaggctgcacaatgagggggaggtagccgggtgggggtgggtaggtgccgtcacagcctctgtggcccagggttttccttccagcccaccccatgctgggcacttcaaaggggctaggggagaggccagccaggcctggcgggcctgggcctccttctcccaaagccactggaggtagaaaaacaccttgagagcggggctgatggagtcaggtttttggaatctggcaccatggggagcccctggtatgaggtccttctctggtagccttgtttcactttctttgtttggagctagagcttggtgtggcccaattacttaaatcagagccttctagcctttcatgtcaataataacagcaataataataccccatgtatgaggatgcctgtcactgaattctgagcctgctaccccaccccccaccatcgcaatgacttttctacctgctttgtgaggctggggagcaggcgtgaagacctttgtcattcaagcgagaggaaggaaaggaaaagaacagttccagggctccatgccttctcccttcattccctttgtgggttctcacagtaacagtgagagttgggcatgggttcccattttacggatgagtccactggggtcaaagaagctgagtaaacctatctgagatcacacgtctggccctagcacttgcagactttatgactctggtgaatttcctgaaggtctctgtgcctcagtttcctcatctataaaatggggataataatagtacccacctcagggttgtagggaggatgcattggaataatgtatgcaagagcttggagtgtggctggcacagagcaagcactcagtagtagctgttgtccttcttgtactaaattgtctagtctggattccagtccacactctccaggctccagagcgagtactctttttgctttatgaacaaacaaaataaaaaccagtaaggggcctggcgcggtggctcacgcctgtaatcctggcactttgggaggccgaggtgggtggatcacctgaggtcgggagttggataccagcttggccaacatggcgaaactccgcttctactaaaaatacaaaaattgctgggtacagtggctaacgcctgtaatcccagcactttgggaggccgaggtgggcggatcacctgaggttgggagttcgagaccagcctgacccacatggagaaaccccatctctactaaaaatacaaaattagccgggcttggtggcgcatgcctataatcccagctacttgggaaggctgaggcaggagaatcacttgaacctgggaggtggaggttgcggtgagccgagattgtgccattgcactccagcctgggcaacaagagcaaaactctgtctcaaaataaaataaaataaaaatacaaaaattaagccaggtatggtggtgcatacctataatgccagctacttgggaggttgaggcacaagaatcacttgaacccgtgaggcagaggcttcagtgagcccagatcgcgccaccgcactccagcttgggcaagagtgagactatgtctcagaaacaaaaacaaaaaccaaaacctgtaaggttgctgagggatccttcgcctgagctgctcggtgcagaactggggaatggaagcccagggaggggaagggactggctgtgggtctcagggtaagtggaatatggatgtgggagccagaggctgcctctgaggaccacactctcacgtcttcactaggtggacaagtatttgtaaggcttggtcatattttgcctggtttcccttagttgcagagagacatttcttcacatgaaaccagaccctattttgtgtgttggaaatgctcacaagtatttcccaaggctctccctaccctacctcaagatgctgttaggagtaatcctccaccctcagtgtggctggcggtgcctgccctggccagagggcatcagagcccttcctggatggaggagggcagggcctcccttcctttcccttggaggccagtggagttctatgtgtggtgtgtctgttgcaggagaggaaggcataggggatttgactcttagaagtctgggggtattaagaatgggaaagaaaaggtatcccctgaaggcagctgagcacaggggcggggggcatgatttccaatccctgcttgcagatgagcagaggcaggatgtttttaccatgtggccaaaaaggtgttcagggctggaggcacaaaatcatgtgtgtagctttacaaatccaattctactgctagtgcccctagcaattgggggatttaatggaaccctctctgtttctcttggcacagcaaagactcatgctttgttctgtgcattcagcccgccacacatctgattatttttagaggggtctctgtatggcaggcactgtgctgggcacttggtgataccaagctgagtaagaacaggttttgatctctgggaattcagtctccctccctctccctcctgctcccccttcctacttccctcctttccattcactaagtatctattaagcatccttatttcctatgttaataataggggtccatagaaatgatcacggcatggggagaacctcgttagacagactgaggaggaatgttgcactggcagaggagttttcgtgagacttggctctagccttggcattgacactgactatgagcttgactaagttactgacctgctctgagctttcatttataagagaaggatgttgaactgaacaataatagtattgggcaggcatctttcatttgcaaggaatagagtcgcatctcaaactggcttaaggataaaccttcaggcctggccggatccttaggagttcatctctctagtgttcttgtctctgctttcgtttttgttggcttcattctctgccaggctcttcctaaaagagggcaagttaatcccccttcctccggtggccccaagctcatagcctccttgctgaggtagagcatctctttcctgtagtgtaatgaggtctcaggattcacgctgattggcctggattggtcatgtattcatccttaagccaatcactgtggctggagggtgcagtgctatttggccaggcttgaagtacctgaatcacatagcgggtagggagtgtttgctcaaggaagacagggctggtctacagaatgcagggatagatgctggccaggctgaaaagcatggagcatttcaccacggtcattgataagcatcctttgaaccttattcacgcataagacaggaccaggagcctgactgtgggttctaatcccacgtatgcatccttcttactgtgtgacattgggcaggtaacttaattctcttagcctcagtttcctcatctgtaaaatggaactaacgatagcatatacctcatactcacgggttcttcccacaccctgctcatttctgtggacccctattattagcatagggaataaagatgcttaatagatatttgatgaatggaaaggagggaagtaggaaggggaagccggagggagaagtaaatgtgttaatcaatttaaagtgctcagaacaatgcttggcatgtaataagcacttaatgttagctatcactctttttatttattcacacatttattcatgaactctatggctcatccaagcaagtgaatacatcataatgtttgcccttgtggaactcacagaggcattctacgattgcttttcactcgttcattcaagaaacatttattaagcacctactatgtgcctggcacagtgctaggctaagcttaggacacaggggtgaaggaaatagcccttgccttcatggagatgtaagaggtatctttgcttattcttcacctctcatctaaacactagagacaatattgtcttctgcagagagactgcatagagagaatagatgtgggcatatgttaaaaactcgaaagtggccttttgtctagcatgttgtgagtgggtgggcatttgcctgtccttcaggggtgtccacccaggattgtagcttcccctgcctcctcctcatcctttctccaagctttcccctgtgtggctgttcccttggcttctgtgcctcctagcaagatggacgaggcggctgcaggcttctcagtctccaccctgcgtggtgaaaggaggcagtgggggtcaggcatgggttaaggtgctggttcttgggtccaacaccgatcggacttcagtccctcgtcccacgtcagtttgggtggggtcttgggcctggcttcactctggtttttttgggttgtttcctggggcagacctcttggctctgcatcgggctgtgtgctgggggtctgccagagaggagtggggaaggagaaagcctcatcgttttcccccttatagcccatgggaagaagtcctcatatgtcaagtgctctgcataagaaatggggcaggtcaggtgtggtggctcacccctgtcatcccagcactttgggaggctgagacaggaggatcgcttgaacccaggagtttgagaagagcctgagcaacacaaagtgagatgcctgtctcgacaaaaaaaattcaaaaataagctgggcatggtagcattcatctgtagacccagctactctggcggctgaggctagaggatctcttgagcctgggaggtggaggttgcagtgagccgcgattgcaccactgcactccagcctgcgccacagagcgagagaccctgtctcaataaacaaacaaacaagcaaacaaacaaaataagaaaagaaatggggcagtgtagggatagggggccacagccgccctgtccctcagcagcaggaggaggccaagtgctcagccccaggcttatagtcactgcataatggcgcttcccttgtgcagccacccaccccatcttctataccctcaacatctctgttacttgtgaacgttgaggatcctctatttttttttttcttgagatggagtctcgctctgttgcccaggctggagtgcagtggtgcgatctcggctcactgcaagctttgcctcccaggttcacgccattctcctgcctcagcctcctgagtagctgggaccacaggcacccatcaccatgcccagctaattttttgtatgtttagtagagacggggtttcaccatgttacccaggatgttctcgatctcctgatctcgtgatccgcccgcctaggcctcccagagtgctgggattacaggcgtgagccactgcgcccggccgaggatcctctgttttaacctatgaggaaaccgaggctcagagatgttcagtaacttgctcacgatcacccagccaggatgtgttggagcttggaggcaaacccatgccggtctgatcaaacagcccaagttcttggtcaccaagttgtaccatcccacagagtgaatatttgcacagaccccagcatcctcccaactgggagggggcatagaaggtggccacttttctagctacaagttggaaacttcgaagatcagaacttgccaagagggcgagggctttgatagatgaacccactctctatgtctacctgtctgactccctctgtcgggccctctgccctggtcggctgattcttccccactaagggccgctcagccccctccgacggctgcttctgagaaggatgtcatcagtgtctctggtcagatgcctgggcctcaggctggagccatgggctgccggggagctcacctctcctgtctccacacgctccccaggcctgcggctggtgaaacaggttgctttagtttgctcaccgacctcctggctgtctctggagctgcagcctctttctacctgccacactccacccgggcctgccatctccttgtttccaggtctccatccccctcccatcctccagtgactcctgttgggagcgctcgggggtacctctctgtgtgcccctatagggtgtaataaggcttccaggaggcaccgcctgtcgggcatggataatccatttgtttatccaatggtaacccagtggtaccccctcgctgcctcctccagaacccctctggtcagtactttctctgcaaggggatttattaataggggtggaagctctgaagaattcctgggagatgatgtcacatcatgaaaagaaaagcagataaattgaattattattgttttttgtttagagatagagttttggtctgttgtccaggctgaagtgcagtggcacgatcttagctcattgcagcctcaaatcctgagcatgagcgattctcttgcctcagcctcccaagtagtcagactccaggtgtgcactactatgtttggctttttattttctagaggtgggatctcaccatgttgctcaggctggtctcaaactcctggccccaagtgatcctcctgcctcggcctcccagtgatttggatcttgacagttctgtgttcacattttttctctgcccacagtctttagcagttaacgtatttgtgagccacagtttacccctctgtgaaatggggccactgaagcctctcttgcatggcgatgagggttcagggcagtaatgggcatgaagggctggcacactgccttgtacactgggctgcacttagtagatggtggttctgtgcccttttgtgtagaacaggacacccctgggggtgcagggaggtggagtagggtgtggagaggaagcctttcctggggatggcaggtggggcagagtgaaacagtccaggctaccatcctcagtggacctgggagagtgtccttggctattgagctatctggtggcagagctgggtcactgcctgggagcctttcaggacttgtgagatccagagatgtggccattctgagggaggactgccttggttttttggtcgggggaaggacagccacccctcccagatgcatctccagcctggatgcctcctcaggtaccacctgcctgttcctgaccttggtaaagttgtgtggagataccagcaatggtgtaccatgcctttggggcccccggggtgccacacgggattgcttgcagtaactctcaaggcctcttggcctctggctgggtgttgtggagtgtagggagagggcaatatccttgttccgtcacagacactgtgacacccctcgacctcctggaggtcacggaggtgtggggcacgcttttaatgtttctgaaaatacttcaggaaagcagcatatctttgcaaatattggcctaaattctttttttttctttttgaggcagggtctctctctctgtcgccgaggctggagtgcagtggtgccatcatagcccactgcaaccttgacccctcaagcgatcctcctgactcagcctcctgggcagctgggaccacaggcacgcaccaccacgcctggctaattctcctcacccatctttttttttttttttgtagagatggggtcttgccatgttgcccaggctggtctggaactcctgggctcaagccatcctcctgcattgacctcccaaagtgctgggattacaggcatgagccactgtgtccagccccaaattctttattatacaacacaatcttagacccatgccccgggtaaacacatgaatcaacacatcagtaggaacaaatccttctcatccctacacccaaacctccaaatcctcacctgtgtggctgtgctcctggccaagatctcctgaggtgcctggtatgctgtctcgggagccagggtagtgcaggtggctcctggtccagctctaggctcttgctagtatctggaggacagccactggcccaggagcttccgtggagtggatactagcgtggccattctcaaagaaatgggacaccaaccacagggtaactggaggtgctgaaagaagccaatcctacagcttgaaatctgtcttctgctccccacccaccacactgcctgctggcatcgggagtttgtaagttttccttttttattgagtctctcatttatcacgtgaataacacaatcatcttccattgtttgtggatgtgttttaagagcatgagtgctgtaaatgctttaattatttaagtcactagacatttgaaatgtaccgctgttttggtcaccttggcctggcatttcttccttgataaaatatacatagagtctcccaacttaggaagacctaagcctcattcagcctccgggggagccgcccgggctgccagcaagacatcttcctgaaggttcccgtcactcggggatctcgctggcctccctggcccaaacctccagcggcttccctctatggagcaagagggcgggctcctatgtcttttctgttgaaatgatttctcttgctcctccccttgatacaaaagacccaagtctgggtccagagtaagttatttgtaatgcatttttagagtccatattgcaatattagccatgactgtctgctgtgtagaaaaaggaggagtttgtgtttgaagtttaatccagcttctacttaagctcggtccctgggcaatccttttttctgccgctgagctcaaacagccgggcctcaggtttgatctgctgccccacggagccctgcccaatgtgaatttgaagagttttttttttttttttccctctcaaccagggagacttgcgaaaaaaaaaaaaaaaaccgcaccgtggtctgcagcacccgctcccactgtgggtccctgggtccctcctggaggccctctggctgttttttgggagggcagatgggttgggacccaccaggaccttccaagatgcagccgtgtccctcccttggggtctccaaggagcccctctgagctctctctgctggaggacgtcaagcactggggagtctgggagtcctgtctcacatgtggggggcagagaaaaaggagggaaaaaagggagggaaatgaaaggcacgagtttgtcgggaactggtgctggctgtggaaacaggagccgcagcaggacggaacctggtggccttcaaaacttttcttctcccctctctccacatgactcggaggatgcaggcagtaattaaaggcccccctggttcctcattttctgtgcccatgtctttgatctggctcatgttgggcagctattttcattgttcctgcctttctttcattcttttttgatggcagaaatgaagatctttgattctagagtcggaggtgggcaggagagtgttacaggtcttacataatgcatctttcacatcttatttttaaacgcgggcataatcagggctgggcagaggctgggcttggtttgcacccgtgtgtggggagaggcggttgcctgccctgcagtgctagcccaggggtaggtggggacaggcagtcctgtgcaactgaatgaaaattactagaggaagcttcccccacttccaccccttcctaaatataacctggagggagtttttcctaattgttcccttatggtgaaaaatgtgttgagagagggcaggacaaggaaggccctgcccacccagccaggggtctcttggtggcgccctgggaggcctgcccactgtttattagtggatgttaataaactataggggacaaaccacgggggtggtgtatgaacagtaactcaggtacccaagatgaaataggggtgctctgccagatgtggggaggtggcagacatggagggggtgtcgccatctggttcttctgtacacccttcctggggcttccctccaggcaggagaccctggggcagacagagatgagaaggtgaggccttctccatggttaggaacatgcgatccaaggtgggatggggatgcgaggctggtgcagggatcgcaggttctgatgatgatgggggttctgcctgggaggtgaggaagcatgggtacaggctggcggggctggtgagtcgagatcatgcttgctcctccatctgttcctgtccatggcttctagatttccaagagaagccagtcacttgggtctttatgggaaatctcttagagatgagaagaagaggtctgccttggtcaggggacagtgatagtaaggtaggtaggaagcctggcaggtaggaagcctgggtgtggtgggagagggggtgattggagcgtccaggccactcaagtgtggtgggtctggcaggaaaggctgggagggcactgacaggggacctgcatcctccgtgtggggcgtacgcaggcctgtgtactccgagtggctgcagggctgcttcctggcagtgagctccacagggccagaaggtttttgtacatgatacctgaggcttcatgtcacctccactacgtgcctggtattcatgacggtgtggtcccctcctgccccagcatggaagacagagcctctgtgagacccgccttgcactttggatgatgctaaggaaggttgcgaggctggccttcctgcctgcctacccgagactcaagcagcaggactttcataattaatatgaattaatgcatattaattgagcacctactttgtgccaggctgtgtgctgagtgctgggcatacaacagtgagctggacaggcctggactctccccctgtggagcttccagtctgtgggggagaaggacagctagacaaaccaccccataaatagctacgtttatcttctaggcgtggaagcatctggaaggaagagcatggggcatgagagagaagcaaaggcttctttgaagaatggacactggaaacgagggcgaaacaatgaatagaaattatggggatagccatccagacggaaggtttgaagactgcaagtcaggagggcgctggcatgttggggggattggtggtaggcagcatgggggagcgtggtgagccagcagagcgtgtgtacgggtgggaccaggtggggcatttgtattatgttctaggagcagtgtgggtggtgggggtcttggcatcctcagactcatccttggcagagttcctgccaatgccctgtcaaggacgggcgtgggcaggtggggacatggagaggatggtgctgcaggcagtggggaccgagaacagagggtgtgtgcgagagccgtcctagggaccacgttgacaaggtgtggaaatggattaaattttggagaaacccaggaggatccctggtttcctggcttgggcatcgaggtgaacagaggggtctctcctgaaatacacagcgctgaaggaggaataggattggaggcagagaagtctttccccttttctgactgaactgcaccagggcaggggcctgggggacaaagctggtagggacagtggggtgtcagtccaaggaactagaccctggctgctgctcagtcccctcaagaccccatgctgcatgtgagcaggaacctccattgctctatccctagctgagcccacctagtccatgcctggcacacagtaggtgccttgttaatatctgttgtggagacctgctctagaaggctgcagatcagttaaaacttgctgggatggggatgctgcttgatgggggaagattctgccctgggctgcctcctcctccaacttcagatgttgagttttgggggctgctaccttccagagggaggccctgagcttgagcttgagctgttgtgcctggctgggctgccggatgcccgcttgttatggccccagatgggggcagcctgtccagtgttcctgactcccttgtaaaccctcttggctggcctggctgggcctctgagcctgaggacagccatcagccggtgttggtggttcgcgtgcccctgcctttctgggctgtagattccgcccgctgtctagattgcgtggaaatctgctttgcctggtgtgtgcagagcctggctccagccctcacacactccagctggccgcgtgtcagggccccctcatttatgtccaccaactttggcagctccttcttgcagctgggctggggtggaagtggggtgctgcttaacctggtggaggggcccagggctcaagctgaggggagggcttataggaagatgcgggttccaccccctacatgaactggactgctgctcttgggtcctagatttgctctctgggctgaaggagagttacgtcctggggccactcacatcctgaccagaaccttgaggggctcagcttctcttttcttcatcttcagcccaaagcagacttttaacagaggcatgaccaggtctgggcagaccatggggaggtttcttcatctgtaaaatgggaacatcaggcacccaccatagacccatttccctcaccattcaacatttaattaatggcatggacatcctcaagatggttacaaatgtctctttaattttccccagggcaatttgagaatctaaatatccctgatataatctggccatgtggctatagtcttacaacctgagaattcaatggatgaatctcagacaacacagttagttgtattttgagaaaaaaattcctcattacccaaacaccctattttcctgatgatatttcttttgtgttggtctttgtctgcacacatgagaatttacaggattccaaccagagggtgtctaatatattctgctttttttgcccagggagttcacggtctgacctgcatctgtggtctgtggtccttgtagctgctcttatttattttattttaattttttgagaccagatcttgctctgctgcccaggctggagtgcagtggcacaatcacagctcactgctgttttaacctcccaggctcaagcaatcctcctgcctcaccctcccaagtagctgggactacaggtgcacgccactaagcctggctaatttttaaatttttagtagagatgtggttttgccatgttgcccaggctggttcctgggctcaagcgatctgcctgcctcagcctcccaaagtgctgggattacaggcgcacaccatcatgcctggctaagttttaaattttttgtagagacagagtctcacagtgttggccaggctgtcttgtagctgcttttaatgccctctcgaggagctggtgctaggtgtgggtcaagtgttgagcatcggaccaggcatattggaatcacccagggggcccctcttcctcccggtttctttttggacagtagcccctaagggaactattctcaatgtaccttgtggcatagaggaaagcacttctttaatttggagtcaggagaactgaattctagccctgggttaccactaagcggctctgagtgaacttggtcctttgtcctctgggtgtcaagttctctgtctagagatgagggttggtctcctccaccgcccacatcctgaaatttgcgattccaaagaaggaatacacttatattaagtataagaatgtattttcaatattaagatgagaatatatttgtatttagttatttgtagctctttctccagtagtgattttacacttccagggtgcaatttgctggtcagtgtctgtctcctgcaggagacaatgggctccttgaggggctgccttgtccttggtcactgttgaatgccccactgatccacacgggagagctgagtatttgttgagtgaatagtcagatagcaaagttggaggcagacgccaggcacccctctgccacctgttcataagattattactggggagaaatacagggagatggccagggcgggtccccactcctctgggcactgcagctctgcagcctagagaagggccccttctttattggcacaggcggaaaagcggctccctcagccctgaggctcccttgcatgacacgggtgcccggtggggttgcggctctgcgctggttgtggtaggggcgtctcctagatacccactccgtcgaagtcctgacacccactcagagccgccaatacacagtgcagatgtaagaattgccatcatgacaaaataattgctgtttattgagttctttggacatcgttcccattttacagatgaggaaactgaggctcagagaggctagggaatttgcccaaggccacacagtcagggagtagcagggatggtgtttgaacctgggcagtcctcatgactgacctctgcttcttccttcggctcagcatccccaccaacctctcctctcttcccatctttcatgtcctcctgtcatactcggggcggcatcccatctgtcagaggttctgttcaggccagatgcaaggcctctcctgggatcctagaccaggacagttgctgcagagggaggtgaagggaattctcaggctgtgtccctgctccagaccctggcattgcaagtgtggaccgggaggatctggcatcccttggctctcccttggggccgggccttctgcacccaccctcctttcctgagcaggaggggtgggatgtgctcggccagccctggcactcacagcaagctctagcatggtcattcactctcttgcactttctttcttgaggtccagggagacggttggagaatggggggaaaatggggttgggggaaaatggggttgagagaaaaaggggcaggaggaaggctgaagacaggagcaggcagaaaggcaggacagaccctctgggagagcagagaggaaactggccgagtgctagcaaagacatgggtagggtgagagctggcttccgaaggggaaggggaggaggaacaggagactggggggtaattagaggacagaaatggagggaatggaggaaggatgaggggaggcagagagcaaaaggggagatagacatgggggctgtgaggggtgggagcttgttaggtacagaaagaattctgatatttgaaaatcataatgttgggcatggtggtgcgtgcctgtagtcccagctacttgggaggctgataggggaggatctcttgggcctgggaggtggaggctgcagtgaaccatgattgcatcgctgcactccagcttgggtaacagagcaagtccctgtcttaaaaagaaaaagaaaaagaaaatcataatatgaaaggccaggaagccagcattcagatccctgcagcctccaggaacccatgggcacctgggggagtggccgaggctgtgggggtgggcacgcctgtgggctgcccttgctggcaggccaggcctgggagccatccctttgaagtccctgatatcgtggtgaaacgatccggcctgaggtctcatttagtctctactttgctgcacacaccctgtcatttaatctcccagtccatccttccagcaccaaggtttatacatctgccccatttgctttataaagcctgtcgctgatgtgaacttggcagcgtgagtacatgagagtttttctcccctctctgtatccccaaaaagcactcagttaccaaagttctcctgctgacggggaagaaagctgccaaaagagagcccatgtttcattttgttatttagacatgggagctgtgtagtctggatgctgttggattttattttccccaaactagagcagctgcagtcatggcttaggataaaagataccttggtgttcagttggttttccccaaatccacccttcacttctcgcttcctttcctattggagtttgtactgagtccgccacatagtgctttctgctttgttcaccagaagtgggaatccctgactgtcgagtttgggcgagcctgttggtctcctacttggaaaggtctgctgctccaactctaaggtgtgcagagctgaggggccctgtttggacaccgacatttcttagaaaatttgcccttggctgggcatggtggctcatacctgtgattctagcactttgggagcctaagttggtgtcacaggatccttggggtgttgcttcaccagccagaaacctctgtggccagcagtgccttctgcctgactatattgctcatgcctgctgggctcgttctgcacccttgacctggcaggctgtgctcggctcatgctaccagcctggatcccatacctgccaagggtgatccaggtgcagagccgtgaggcaagtgagcatgaagtccggccacttcacacagccaggcatgctggctgctgtggtggggcgggcagctccatgtgctggttccatgtgaggctgtggctggaccaggtgtactgtaagtggcttccactgggagtactggggaatgcagtggtgtccggaagcttggagatgccaggaaccacagaaccccaaggaaggtgtcacagccctggcttggggagcctctaggtctgggctcaccgaagggctgcagctcttctgtccttctcattgcctgcaacatggtaagcagggagtgtttttccgtgctgtttgtgtcatagctctttccgtcctgccattcagcacgtaccaagttcttgtcccatgtccaggaagaatgaggtatgcagacaactggagagtgagcaaggcagagaggagcttcaatgagtgacagaacacctctcagacctcaagtgggccactccttcccatgggcaggtcgcccaacaagtgcccagctctcagctgagaggacacctgcagtgggtagctcctttctgcaggcaggtccagctctcagtggagaggagactgcagtgggtagctccttgcctcaggcaggttgtccccatgagtgtctagttctcagctgagaggagaccgcagtgggtagatcctttccacagacaggttgtactaacttgtgtccagctctcagctcagaggagacccacagtgggtagctcttttccacaggtaggttgtcctgaagagtcaggagacccgaagtgggtagctccttcctgcagctggtagttccaacatctctgtgagtctggctgagtctggtgtaatgggcttcagaagggaggaagtgcgtactgattgatccttgggtggtcccagaaacagcaccataagttctcactctgggctgggactccacctggaactgacagcccagaccccaggtttcaggccatttctggctagaacgtggggcttcactggggacccgcccctttctgctcaggagcctgtctgcttcctgccaccatcaatcatatcatccacagcacccagactgtttgtgccgaggggcacctgcaggcccacgctgagccacccttagctccctcttggtgtccctcccatgctcatctgcaccaaaagtctggagggggctgaggtggcagggggctggcatgtcagcactgccctgagtgcatgcacatctggccgggtcatgacagtgtctgggcttggcctcaactttgctccaaaatcagagagggtgctgggagcagggagaagccaggcagcaggagcaggcacttccgagcctgtgaggacaggagaggggggcctcccaggctcccaagagctaggtggctgcagctgtgctggggagggtggggatcccaccctgccaacttggaagggggcagagatcccacctgtttccggctcccgccagctccacggagggcgcagccctggccatgcctccccaactgcagctggcatctttgcagcggtcgctccagactgggtgctgctgccattagtgggaggatttcttgatcccaggggttcaagaccaacctgggcaacatagtgagaccctgtgtatactgaacaaaaacaatttttcaggcatggtggcacacacctgtagtccgagctattcgagaagctgagatgggaggatcccttgagcccgggagtgtgcttgcgagtcactgtgggctcctgacctgtgtaccactgggttgactgaggcccagagagcctgataggctcagggcagtgagggctggtgttgtgagccagtgctccaaggtatctctgagcatttgtatggattgagaattgattcctgtatctcatgtcagatcctcttcatgatttgtattcattcacttaataaatagttgagattggtttccccaaactgtgtgctgtggcaccccagggcacaacagctaacctacaggacctctgtgagatctttgaaaatttcaagtgaaagacagccatacccaacatctgtcagtgcaaattatgagctggaggttgttcccagtgcaggggtgaggagagggaggaaagacacccatcaggcacctggcacagggaggacagcatgggaggccagtgcctcacacatggtaggtggcaatcaatactttgccctgcttaatttttttattcgattccagttccctgacatcttgcccagtcacttgtttactggtttattgttgcttcccccactggactgtcaactccacgaggacagggactttgtgatattctctgctgttttgccatcacccaaaaccatgcctgatacagagctcgaacgccccactttcctagttcatggcaccttagtgtcggtaacttttttatggtgccccttaagcaaaacaaaacaaaacaaaacaaaacaaaacaaaaacctcacagttgtctaaacaacttaaatatttatgtcctaacagcatagtagctttaaaaaaaaaataaaacacatacattcaaataaaatgtaatattttattttatttttgagatggagtcttgctctgtcacccgggctggagtgcagtggcgcgatcttggctcactgcaaccttcacctcccaagctcaagcaattatcctgcctcagagtcccgagtagctgggattacaggcgcccatcaccacgcccagctaatttttgtctttttagtagagacagggtttcaccatgttggctgggctggctttgaactcctgacctcaaatgatctacccgcctcggcctcccaaagtgttgggattacaagtgtgagccactgcgcctggccaaaaaatgtcatattttcatttcattcttaacataattactaatggaatgtatgaaattcagattcttatttagcagctccaggtggacctgaaattctgcatttctaatcattctctctctctctctctcttttttttttttttttgagacagggtcttgctcttttatccaggccggagggcagtggtgtgatcatggctcactgcagcctttacttcctgggctgaagcaatcctcccacgtcagcctccctagtagctacttttaaaaaaattttatagagacagggtctcactgcattgcccatgctggtcttgaagttctgggctcaagcaatcctcctgcctcccaaagtgctgagattataggcatgtgctactgcacctggcaacaaaattcttttcttttctttcctttcctttccttttcttttctcttctcttctttctcttttctttttctttcttttccttccttccttcccttccattctctctctcctctcctctcccctcccctcccctcctaccctccccttccctcccctcccctcctcccctcccctcccctcccctcccttcccctcctttctcttctcttctcttctcttctcttctcttctcttctcttctcttctcttctcttctcttatcttctcttctcttctcttttcttgtttctatgttggagtctcgctctgttgcccacactggagttcagtggcgtgatgatgactcactgcagccttcgcctcccgggttccagcgattctcctgcctcagccttctgggtagctgggactacagacacgcaccaccacgccagggtaatttctgtatttttagtagagatggggtttcaccatgttggccagggtgatcttgagctcctgacctcaggtgatccgcccacctcggcctcccaaagtgctaggattactggcatgagccaccaggcctggcctaaattctacatttctaaaaagctctcatgtgatgctgagttgctggtccagggccacattttgagtggctgactcccatggccgctaagtccaccatccccactcctttctaaaccctccttctcacgtcctttgctctctgtagacagctttgccagccccgtggcatgagttagaaggtcagttgttcaactgatgtggtttgaggtgcccagcacagctgtccccatctccatgaacagaaatcctttccatgcccatctagggtgtcaagtggttgacatttgtgtatgagtgtcaggtcctcataaagaacagttgtttgtggctgcagaagtggccacctgcaaggtggtctcggtggacctggagcatactggacatgcttgctagggcaggattgacctactccaggctgtttttgttccctagagtcacctgcctgtgtgaaggccatgtgtctgatttagtcccagaatgtcaggcagccttgtggacctccaggcaccttcccttctgggactaaagtcccattaaaggtgactgatttctgtctcctagcctggatgactgcagccctcccttgccagttcctggttgttatggatgtccagatctgggaatgtgcattttccagccacatgcccgtgtgcgtgtgtgtgtatctcagttagtgcctcgtggagctctgcagcacagctgcaagggcagagctgcgcctccagtctctggaaaatccaatctgcggtgatgcataattgtacttgtgggctgttcccgtttgcccactgtatcattgatcagtggattcatttatttattcattctctccctcatgcagcaagtgtttatttactaaccatggctgatgttctgagctggaaggcccaaaaagctggagaagacttcctggagaagggggcactgtggggtgtgtgcatgcctgtgtgagtgtgtccatgcatatgtatgcaggtgcgtgtgtgcgtggatgttgcacacctctgcacagtgttgtgtgtggagcactcatggacgtgttcagaacacacacatgtgcatgcacatatggcttgcatgtgcacacaggctcgtgtgtaggtgcacacatatgcttttacatttgtgtacaggtgtgtatacaggtagggtcttatgagcaaagtctcggtgccagtaacatcaactttggaacccctgtcctggcctgcatcgatcccaggctggagcagaggagctgctgtttggtagaactgattttgtagcttggctccatgtgcgtgtgagcacttgggtgtgttttaattaactagaacatttgcctggaaatgagcagcagcagcagccggcgcacaggcagctggaggggggtggggtggtgcagcgtggttgtgggggccgtggcagcccggagtctgagttttaacgtgcccaattccagctgagggcaccgctgagggaggggtggggcagttcacccccagtgctggttatcaccccagcagggaggggattctgggagtggctgaatgctgtaattcccaagcctcctagtcaaagatggccaggttaatggttccagcacctgggtgggtacgtgcctctcctgcatgatccagggtgggcttcagacccatgagccatgcagcactgaccaactgcaaaggtcaccaactacagagcttatacctggcatatagtgggtcctctgtacatgagtgagtcaacagctagaggaagctgaggctcagagaggtttagtgatgtatccagggtcacacagcatgttagtagaccagctataaatgttgactttgtttccagtgttatctttccaaccctggtcatgttgcatgaagaaatagcatcatctcacagcagatgaattccacacaccacaggcctcccgctctgccctgggcggctgttcagttgcctgcttgccatcctgtctacctgggtggtgggaaggatggacttcccaggacatcttggtgtgctggagttttctctcaccaagggcaagatggaggaagcaggggtggtcatgattggaggggaagggctgggactcagtccctttctaagacaaaccggccactgggagctcacaaactgtagtcaccgaagaaaatctcactcagaccgcagagtcccctggtgccctcttccctgccttcccatctgttccaaggcctcagagcatccctgtggctgcagccccgttccgcccctctgcacagcactgcgtggctgcctctcgggctttggtctgtgccttcactttgtcccaccccaccttgaggacccctgcctgattattttccctgaagtacagctttgttcacatctctgttccgcctggtggtgcagggggtggactctgggccacactgcctggggtcagatgtgggctctggccctgactggttttgtgtttccagtagagtgacatcacgtctcagagccaccctgtcctcccttgtaaagtgggatgacgcaccgtgtacacatcggctgcagcacacgtatgcacatggccaggattaccgactggactgctccccagccgagaacacactgcgtgctctgcacacacacacaccacaaatcccttaggcactcggtgacacttgctttaggagaggttactggaacatcagctgttggactgcacagcaaaattttgtttgcgtttcacactcattcctatctcagatcctgtgcacaaattttctttttgctcagcacacagctaaattcatataggtttaaaaaagtacccatgctagaactcttgtgttatctacatttacccgttttccacctgcctatttttcactcagaataatttttgttctcagagtgccagctacctttgcttgcctttgctctggctattttctctacctgctccatggccttttatatttttttctataaattaagacccagcagcaggccttcatgtctcagggtgtccctgatcaccctgccagaactgagctctctgggcttcctaaggacccttttaaggtcccaccatggactgtcttaccttgtgcactttcctcagcctcctttagagctcatgctcctgaaggcagggccctgggtttcttcctgtggggcacgtggagtgcgtgatgcttggtgaatcctcatcagggtagactgaatggatgaccagatggcggtttgtagccccccatgggcagaagggtttgtgtgcatgtgcaagtgtgtgcacatgcatacatacgtgtttgcacaccttgcataagcatgtgcatgtgacacacgtgtgcccatgtgtttgtgcacatgtgtgtttgtaccatcagcttgatgctaattgggtttctgaggaaagatgcctgctttaatttttaattagaaaccagggcagtgtgggagctgcagctggaggttttcctcaatgctggagttctccttaacaagcacccgcagtccaggccagcctcggttagcgctggacaccaccgctcacgctggtgggagtgtcttaatgcctatgaaatgatcatgtaattatttggtaatagaatgccaggattttgcctatgcaacaatctttcccagtgggtgaaaaaattgccaatcaagagaagttggagatgaccaggggagtcgtggggctccaatgtcattttgatgggatggggtcaccactcctcccaaaggcatctgggagtcctgctggaagcctcagcccctgtcaaatgggatttacctgcagcatgtttctcctggcctggggctgtgtttagcatatttgttgtgggtaaaatgatctgtgcagactgtgtcaggtagggagtaattacctgtgtaccacggcggggtggtgagcctcacctgctggtgggagaccgccttgggctcctgggctccagcaaggctctgggcaggtgtgggaatgccactcagggtttgtgtaactcctaggtgagtgcctcctggtggaggctggcccatagatcacaccgcgtggtggggcaggctgtggacactcggtacatttacagatgctccactcttttttcggaggcttttattttattttattttattgtacttatttttaaatttttttgagatggagtttcactctgtcgcccagactggagtgtaatgacgcgatctcggctcagtgcaacctccgttgcctggggtttcaagtgtttctcctgcctcagcctcgcgagtagctgggattacaggcatgtgccaccatgcctggctaatttttgtatttttagtagagacaggtttcgccatgttggccaggctggtcttgaactcctgacctcaggtgatccatctgcctcggcctcccaaagtgctgggattacaggcgtgaaccaccatgcccagcctcaggaggcttttaaactgcagctccgtactttggtcaactatgggacaccctggggatggagagtgcagaccctccaggccagatggccatggtttccgccctgctgccccacagactatggggaaattatttcttaacttctttgtgcctcactttcctctctgggaagcaagagtagcaatagtacctaccccacagggtcaccaggaagattaaagaggcagtggaggtccagaatcccctattcacaattctgaattccagaaagccagaaacctgaattttttttttctgtaatgtatttggcagccaagtttgacctgagctgatgtgaagctatttatggtctttatttcgttcacattagtgaataccgatatgttttgctgcagaagtatcagtgtgcctgactgctgctggagtgttcccaaatttgcagcaagtgcactgtctcacctttctagaatctgaaaaagtctgaattttggaccacatctgacggtttgggtttggggtagggagttgtggacaggcaaataaaagatgtgggctgagcgcggtggctcacgcctgtagtcctagcactttgggaggctgaggcaggcagattgcctgatctcaggagtttgagaccagcctgggcaacatggtgaaaccccatctctactaaaaatacacagattagcctagcctggtggtgtctgcctgtaatcccagctactcaggaggctaaggcatgagaatctcttgagcccaggaggtggaggttgctaatgagccgagatcgcaccagcactctccagcctgggcgacagagtgagactccgcctcaaaaaaaaataataaataaaaaataaaataaaacgtgtggggcacctctcccggaataattgctcagcagacattaggtggagccatcacctgacccatcacacagagcagcactgccggatttcttcctattcctttcttcctcccactcttggccatgcagggcggggtgggtggtggtgggagggctcgtttgcttggaagtcatgtgcatgcacacatgcacacccatgctattcctcttggctggaggtgggacaccctgtagcgggtggacgcgtgcttgggacctcatggaactatcaaggccgggcttggtcctagggtgggctacaggacccagggcctatggtttgtctgttttggacgtggctgctgccaggccttgagctccctgcaagaacaagatcagaggggacccccttcacacctcgtcccttaccctcactgcctctcccagggggcagtcatccttgtgttggagggcactgccaagtgcatgctgacaccatttcttctgtgccccctgggtgaccaggcacagctaatgagggaagctgggccttcctagtcccgggaatcctgttggcgctgaaacacctgaaggggctgtggagtgtggaactgcagctgcatgtgaaggaaggcaattaggagggttgcaggtggacctcccttcttttatgtatttacttttactccccaataagacatctccttcgagaggtttgtcccctggcgttgctggcctgactccctaagggaagtagcctccgatctaggctgcaagcacaattccattcccatcataccagctttttaaagagcccacacacttaaaaaggatgctttaaacgtctcgcctcaagccggcgttgtcagctagctgtaatttatctttgcgattgggttgtaaaacccagcaattaagaaaatccctgcttcagattaattgtagcctacgttggctgagaatgaggcagcgtgctgttttgcttgggtttcacagcttatggggcagggggagccggagcatgtggggaaactgagtccccaacagaggcgtccccgagatgcagatggcacagggggcaaaagtgggcaggactagaatgcagccccaactcctcctctgcctattccttggcactaggttggctgcctgcatctagttgagcctgcctgctggcagagttgggcaggtagggacagctgctggtgacccatgaagtgggaaaaccatgccttcccatccttacagggccacagccatgagggggtctgaggccttgggaccagcctgctgagctgggacacatggtgcagtctgcttcttttgcaaggagtcatatttttttctggcttccatctgtgggcatctgcactgaactctcgcagaggcaggttgtctgagggttggcggctgggagaactcaaccagtgggtgatgcctactgtgtgctgggtgccgagccaggtggccgcatcccagagacccatgttgtctgctttccccttccaatgtcaccaaacagaactgctgggctgcagcagctcctgcctgcactctggggccctggagggagcatccagccctggcgtgagcctccctgactttgtcttcttggccttttttcctctgttctcgtggtggggccactgccctgatgcaggggaacggacagatggggcttgcccttggcgtctcctccccttcctatcctggttaccctcaataatcccgtgtgtggcaatggctctcgacagtttacaaagcatctccacagccatcattcccctctgaccctcactgcagccctgtgaagtaagcagagccaaggaggggaaactgaggcttggagtagagtagaagggaggcttgtgtagggccatctggctctggagtagggaagcaggagccctggctagggcccgatttcccagcccagctgggctctgtgtggggggtgacctggatggtgagggggtgcagggggagatatcaccaactcttttttcatgtggttctcttctgaatcctgatggtaagagagggaagttttgggctttccaaggggtctctaggtccaactcctgcctggtgggcccagatcccgtaaggaagaggtttgcaccccacctggcctggccgtgtcctctgggctgccctgtcggctgcctgctgggcttagcttaagaatggctgagatgaatctgtgctgggcaggggacagtcctgctgcatctgaaagaagggtgccccatatcccactcattggggatggtggcctgggcctctagggtcgccatgtgggagatgagatggatttttttttcttttcttttttctttttctttttctttttttttttgagacggagtttcgctcttgttatccaggctggagtgcaatggcgcgaactcagctcactgcaacctccgcctcccgagttcaagtgattctcccacctcagcctcccgagtagctgggattacaggtgtgcgccaccacacctggctaattttgtatttttagtagagacagggtttcttcatgttggtcaggctggtctcgaactcctgacctcaggtgatctgcctgcctcggcctcccaaagtgctaggattacagacatgagctgccgcgcatggttgagatggatttaagaccatgctgcactccccactccccactctctgtgcttactaagggttaccactggggaagggggaccagacactgagctagaaacgtcccttcagtcctcaagtaaggaaggagacatgcactgtcaccatcttcattttatagttgaggtttgtgactcagagaggggaggtcacttgtcccaggtcacacagcatgtagatgacagagccaagattcaaacacgagcccatgtgcttacctccctgcccacccctccttcctcctgggggcctggtgcttactgggggtggggctgggagagcctgcaggctgtgggtctgcagcgttagtgggttagcgggaactgtttccccaggtcctactccctgtactgaggctgcatcaggtggctctgaccctcctgccaccttccctgtatcttggctgacctccaggcataccaggggtcagcttgggccctgccaatcaagtggaaaacaggatccctaaacaggaccaggacagctaccactagcccagtgggaccttctggatggagcctgtgtccaggttctttttctgagcactccctggggtctcaacaatgctgctcacctaatagatcccaggaggacctgcctgggcaagagaagggcaaggaaggtaggagtcccatcctgggaggactcaaggtttgcagagtcagcctctgagttgtgggagtttgagcctcccacccctgccatttcggggcctcagtttctaagtctgtaaaatgttttcccattttacagtaaggcctctgtgtacaggttctttcccacctcctactcagcatgggaggtgggtggggggtaggggcttgaggacttggtgaactcctgcaaggaaaagggccacactcctgagtttgggttgggtggtctgaggctcttgtagttcccagagccagaagccaacttcaggctctcctacctgctggagtcctgctaaagaaagtttgtagttgggagaacaggttgcctcgggaaggaaggtggagcggggctgggcattagcatgcagcttgcagccacacagacctctttgcacactgcctctgccagcccaggcttctcacctccctgagcctcatgctcctcttctttattatcattattatttttgagacagggtctcactctgttgcccaggctggagtgcagtggtgcagtcatagctcactgcagcctcaagttcctgggctcaagtgatccccctgccttagcttcccaagtaactgggactacaggtgtgcaccaccacacctggctaaattattttttaattttttgtaaacatagggtcttgctatgctgcccaagctggtcttgaactcctgggctcaagggatcctcctgcctcagcttcccaaagtgctgggattataggcatgggccactgtgcccagccctcggtttccttttctgtgacatggagataacaattgcttttaccccagggtgttgctgtaaatacctatagagcaggtcttcagaagataatggtctgactctgggccagaagttttctgaaggcttccctccatcccagttggttcctctttttaccctgtttaatttcttttatccagttttaaaattctccccttcctcactcgggggatgagggttgaataagaaattgaaagtcaccaaatggctagctcttgtctggctgtgccccgacccactgtctgatggtctcttctcgggcctccatgcccacacctttcatttgccagagtggcaaacactgacccagtttgttctggactaggcattttactggcatctctaatgaaatcagcacaactgccccttgggatagggactactgttgtttcttattttttggatgaggaaggggaggctcagagttagtaagtggtggagttggatttcaacaagatctggctgactccaggcttatttccctgtgggctgagcacccaaggaggctctgggcctaaaggcagagctgcagactggccagtttacaggccatgggaagggaatttgaggtcggtgttggtgatggagtcggtgatggggctggcctccttcctccccactgggccatgggcttgtgcttacccctggcatcatgctttcccaccctgcccttttttctggggtcccagccccactcccctggccttttgtttcccctcctccattgccctaatgatttagcccaggtggcaagttgcgtagagaaactactccagggaaataagagtccttactaccagcctgggcctcaggtgtgcacccagcggccctccctgggggtctggtgagctgggcctcccccatctccagctgttaggcaggagcttgaggagctgtgtgtattgtgtgcacatgtacttgtgtgtggtgtatataactctgggaatgtaactgtgcatgcatgcatgtaattgagtataaccatgcatatgtaatgtgttatatgtgactgtgtatatagaactgtgtgtctgtgtaactttatgtgtgtggaataggcaaccgtgcatgtatgtaactgttcacttataactacgtgtatgtagctggtttaatacgtgatcatgtgtatagaactgtgtgtttgtaactctgtgtttgtgaatgtaactggcgtgtgtaggtggctgtatgtcgtaggtgtgtttacgcctctgtcgaaggcaggtggggaatggagaagtattaaaggcgtgaggattgggagcagggccccagtaacgtatggtaggggctacagttacctcctctgcgggttaaaacactctttgtagaacagagttacacacatgtttagataattagaacaaaagccaaaagaacaattcctttcaaagggacgaagctgggaggcgggggccagccaggatctggggggccgcattccgtctccccagctctccccggccttcgctgcgttttgatcgcactatttagaaaatccctttgttgtaggataaactgacattggcctgcgcagttctgctgtgaagtttgctgtgttccggggcccactcgggacagccaggccattaggagctgattaaatgagctaattttaatttgttcagtggttacagatgcagagacctttccatgcccttttcttgaggctctatttatttattaattttctttttttctgaaaagaaaaagaccttcaggtctcccttctgtcttcccatccccccttaaaaataaacatatgaaaacatttttaactagaacttcagctgggaaagagacggctggatgatggctttgtgggattggcctccagaggtgctgatggggggctccccgagtctgtgagctggggtggggggcggtgctaccagggctgggccacccactgtggctgagagtgaggagcggaggaggctccgtgaaacctgtcagagacctcagtctcacttccaggcctttgctcttgctggtcctgccgcttggagctcatttctgccccttgcttccttcacttggtgaattcttcatcctgctggtctccacggagagcctgctttttccaggagggctctggcacccttactgcgcccctgttctccccccaggccccacacacttctcctagcaaacacaggggatcaaatgttgtccctccacctaggctgcgagctccacaggccaagagctgccagtgtggctcaccctcctaccctcaccacctaagtgcctgctgggttgtaggcacatcagagacatcctgtgaataactaaatgggtgaattaatgaatgaaaggatgtgtgggtgacatctatatttactgaatgccgctacccaccaagctcttgatggcagaaccctggtgtcccaccaatttggaagtgccaccccttgggcctcaatgcaccgttgagagttgaatttccaaatatggcgggtgtggggacttcaggcctgcctagccaggccagtccccagccccaggcccagctcagctgataacctgaccaaggctgagcggagggaagccaagggaagaaaattgcgcagttagttggctttttacagcacttacaggcaagcaggccttgggagtacaatgtgcccacaatgaggggcgttcagagcacaaaagagcagggatcgtggggctgtagccaggggccacccccgatctcgctcaagctgcctggcccctcctagctcgttcattttaacatcacctttcgctctggttggggcacctttcggtgagcagcggggttttccctggagctgtgccctggctgtggcccggccagtttccaaggcctggttttcatttgctgagagctgcttcccgcagacagctccccacccaccccacccaggggcctcccaggggccgtccccccaccctgtcctggcagacaggggcagtgtccgagagagaccccttgctccctttctgtggtcctccctttaaccccagcctcagcaccaggccctggcatggcgccggccccaggccctcctccatctctgtagaatctcagagctggcaggggagccagaactcctcggtcgcccccggggcctggatccctcaactgggtcaacatctggccgcgtggcctgagccctgggcctcctctgtcctctccctccccatctgtgccttttcccagccccttttcttccccaaggcccttcctctcccgctagctgggtcctccgccaagcgccgccgcgggagcagcacaccctcggcccatccttctccgccggcccaggcggccgggtggggatgcgtcccgtggctgagatcaccagtgggccggtgggaagcgcctctccagccctcgcctgccctgccgccgggtgctgggaacccgggctcaggttctggccctcttggcatcggccagtttgccctgggacgccctggtgagcagggggaaaggtaagcggaggcatgggacagtgatgagggggtggctgggttggaagggggaagaatgaataaaacaggctggtgtctgcaccggaacgccgagtccccttagaggctcccggcgcgttggggagtggaatgtttgctcagagtggaatgaaatccagaaggaaggaaacgtttttttctggaatgagagaggaaaagtgggcggccagctgccaagcaggtggtggtggccagggtgtcagacctgggtggggccctgcggcatggggatggggagggccctggggtgcaccctgactcctaggtctggagtccctcccttgcctctctcctgtccttccctctgtgccccacccattgacctcctgtcccctctgtctcccgtggggagggctggcttgcatctgtgatggtttttgcactcaagtgcttgcctgcctctggctcctgccctctcccgtgccctcctgaagcctcatgtctgtcccacttcctgcaccactggccgggagggaggccaccagagtgcagctgccgggcctgactttgccacctaaaaagccatcccatcccgggcactggtcccctctccagtcacaggggcggcatgccaaggggacattgagactagcctctgaagtactgaatgccagactatgattcctgatggattctgtagggcctcgaggggggtgggctggggggcctcagtggtaatcgggtgtttctcgtggccagccacttgttctcctcaggaagaggctggtgagtttctttctgtttatgtggtaaccaggctaccgagatggcaaacttaggttctgcaattacacagcgtttcagaagcaaattgataggataacgtgttattattggctactgggttaatagctattttggcaggagtaccaatcctgcgtggtgttgctggcgcggggtgtgagaatggcgcgatggggtggagaggaatggtgggtgcgctttgcatagagctgcagactcgggaggactctgggggcctcctctgccagcgcctgcttggataatgctcagttctgattagctgttgccgaaaccaagaccagagaggttgagagaccagagtcagatcatacagtgagttgatgctggggttggattttgggtccctgtggggttttggatgacagcttggcctgtgatcttagaaggcagggcacatgccttcacactgagccccacgtgggcatctcagaaaatgtgccctgaaaagtttgcatgctctggctttggggtgcttgcacctgctagatccctgcctgggatcctctctctctagattctgccttggcctgctgccttgtttgcttctggtgtctgctcaagtgtcgccttgtcacctgtccagagtggcaccccacccttcacccttttcctgccctgcacttcttcatagcaacacgtgatttactacggactgatttattccttcttcagcaggaagatttagtctcctctctttgcattgtaagctcactgagggcaaggactttgtttcttcataccctatccccagagcctcgaacagggctggcagagtaggcacttattcgtatttatagaaggaataaatgaatgtaaattgcaatgtcattttaaaaaatggctgccatatcgcaggtgactcgctgtttgtccttcctcttggaggatggttggagtcagagggtcctgttattcctgtccctgagaggaggtcagcaggccctcctttggggctcatcaggagatcatttcttcctgcagactaagggagttcagaagggagtggattccccttcattggaagggaccaaacctctttgtagaagggatttaaggactttttggggtggaccagagcccttcagggggactggctttctttatgacatgacattggcaggaatgacataaggaggtggtaaattggggatgcccgcgagaagggtaacctgggagtgggggtggagttccccaagggcgggggtctcacagtgaaccacggctctgcccagcggtctctgtgtttgctgccactggactggaaaccacacacaatgatctgttcattgagcatgtgccatgtaccaggcgctgggccagtgtgcttaacctgcggtatctgatctcatcctgtgcacaacccgaggaggcagaagggattctgcctgttttccctcttggtgaagattagagaggtccattaacgtatcctggtttacaccactggtcagtggtagagctgagatttgaacggaggctctctggctccagagccttcctggacatgatcctgatgcccccggaatgcagcctccatggtgcagggctttgctgggtgtgctcactgccccaggaattgcagcagagcctggcacagaagaggcactccataaatatttcaacagtgcagtcgctggctgattgagtgagtggatgcgaggtgtttcccaagatgagcgggaagtgctcactttttactgttggtccattggacagagacagggaagcccaggctgggaaggaggtgacaccgacttgtgcttggctggcccgaattcctcctgaaaaaattacaagggcactgcttggctgtgtgttccttgtggaggggtgcatttgttcacaggtcctggttaggaagtaaggaggtttctggtgagttttgggggtcccccctggtggggaagacacacatgcctgcaagcatatacatgcatattcacatacccttattctccagtgtggtgtgtgaagaaaggcatccacttgaggggtgttttcccggaaaaatatggagactcccaccccaaatcccactgttgagtctgtgtctttttttttttttttttgagatgaagtctcactgtgtcgcctgggctggagtgcaatggtgcgatctcggcttactgcaacctctgcgtcccaggttcaagtaattctgcttcagcctcctgagtagctgggattacaggcgcccaccatcacacctagctaatttttgtatttttagtagagacaaggtttcaccatgttggccaggctggtcttgaacgcctaacctcaggtgatccaccctccttggcctcccaaagtgctgggattataggtgtgagtcaccatgcccagccccagtctgtatctttaagagcatggaatctgagcttattatcttattaaatctatccatttgtttggctctggtctgaataagtaagctccccccccatccccccacaccctgccccagctctgtgtctcctttgttttaatgtcatttctctgggattcaggctgaggctgtgtagctgagctgttccttctgcctccgtccgtgcttcctgacccccacacccttgctgcttccctggctccaagaggctctttcaaataaaatcataacaaattcagaccccactgaagactggagtaattgcattctgccataatgagagggggcccgagggaccttggtgatgctggacaggctctgctgggggcagccccactggacccaggtggtcaggagggtggtcaggtcaggcttatatactccctggcttccagctggaggctctgtccccaactcctaggccccaccttacaggggcctcttgagtggctccttgctgcttctttgtgattagactattcattcattcattcattcattcattcattcgttttctcattttctcattctgaattcattcataccatagttttcaagtgcctcctttagacgaagccctggacttcagtatttcatccatccatccatccatttattcatttattcatgccacagttaccaagagcttcccgtaggccaggtaccctttcatccattcattcattcagtcattgagcagatagttattgccaggcaccttgtgggggctcccagggatccagggatccaggaatccagggcttatcagaattgtctccaggcagttcgaagccaggagtacctgtgaggaaaccttaatcacattcttggaagaagataaaaaagcataagggaagtggttgagaggtatattgcgggtggaggaggaggaaggaaggtgcagctcccttctggccctgcaccccaccctgacgagtggcctgactaaagtgtgcatccattgactcatttggcaaatattgagggcctactgtgtgctgggtgctgggaggagctggggaccatttggggaccgtggagctgcctgtggcagactgtaggcccagcaccacccacaggggtgccgtcagcctgagctgggctgggggtggcatctccccttcccagacccctctatgaggagggtaccagtgcctgcagcggtgggcacctgaagcccctcgtgtgccatgtgcaggatctggggtgactgatcgctctccatcagtttctctctcccctgcattacactgtccacccggcctcctcttgagagtatgtgtgtcaggggtgtgtttcccataaaccccacatctcaacatttcatatggctgatgagtcaggtggccagattctcctggctctgccggactctgccctggggcaagtccctccctcagacctcaagggcctcagtatcccgatgtgtacaatgcacaatacatcgtaaaatggggggtctagtgaaaggattatgtgtggcttaaatgcattaaatagtaaaacggccgagcacagtggctcacgcctgcaattctgacactttggcaggctgaggcaggaggattggtttagcccaggagtttgagatcagcctggcaacatacatagcgagtcctcatttctacaaaaaaatataaaaaattagccaggagtggtggcacacctgtagtcccagctacttgggaggctgaggtgggaggatcacatgagcctaggaggttgaggccacagtgagctatgattgcgccactgcactgcagcctgggcgacagagtgggactctatttcaaatttaaaaacccaaaccaccccccgctaaaacaagtaaaacatcaaagactaatatgagtgagtaaataaataatatagattttaagaaagcccggcacgtaggaagtgtctggtgagtgtggctgatattcaggtctgtttgtgagcaggagcacataatgaggcacacagatgagggcctggttccagtgggaggaggtggtggccactcgggctgagaaagcagggacaggcagggtgctggggcgggggttccaaggaaagagtcagcgatgctgggaaagggtgggggacccacatgccccagccttgatgcctaggacttcaggggccctgccccacactccggaatccagtcaggggaatgccctgccacagctgccttcagggacctgacgtgctggccaaacaaactggaactcctcctcctcgtggtggtccagggccaggtggctgcctctctgctgctgctgccatatcccagagccttccccaggcctgatgagtcgttttcatctcctgcccatcacgggcagggctggggcagccttcagccatgaggctcaacagcccagctacaaagtccacgacgacaattactctaggggtggaaacatgaaaatcgggaaaattggaatttcctctgtcgtgttgtagatttggatgagtttaggggtgagtggggccctcagaggggccgcctggctagcccagcacatccttgaaaatgctctggctcttctcttcctggccctcctcaggccccgggctccttgcagcgcccagcccacctcttctctcctgcctgcctctggccaggcacggtgctggggacacagcagctatgaaggtgcgccctcgtccctgcactgccctgtctggagggggagagggacagaccaagagctgcagtcactgcagtatgggccagggcagcaggacttgcgccacatctagggctgcccagcccagtttctggtggttcatgcatgtttaacccaattacatctttattttaatgggcattacaaaaacatcatactcatgatttcatcaatatcatgatttaggattacacttgggtacctgacattgttagtcctgaggtcgttgaaaggacaaggttgagtaatagtataggacacagaccctgacggtggcctctcagtgacttgagcatggcaaatcctggcaggtgcagattaggggctgtggaggaggctatgcaggctgaaagacatggcttccaagtctgacaccaccatctgtggcagttgtaccttagtcagtgttgcagggaggacccctgaacacagagcctgaagcaaggacttagtgcacatatgtggcgaggaggcactcccaggaagtaggacggaggagacagggccagggaaaggccgattttggggtgcagtgttgagcctgctgctgtagaccactgggcttgaaactgccaaaaccttcgtgtctgcagggtgccccaggaatggtcttcagaggagcccactggctccaggcccttttaggtgaaggttgcccctgggggcatcacctcccctccctttggggtcagacttgagacaggcagacacctggaggtggggcctcaggctcttttactcagactgtccctgcagctgctgaattcccagggggccactggccatgatgcacacatcaggtccctgagttcctctgtccctcagcgttcccttccataaaattggaccaagctcatgactgtctcctggagctgctggagggcacctggcacatggctggagacagggagtgtttttggggagtttctccatcctccagatacttggggtgggaccctggggctaggtcctggatgggatttgactgagaagcaggggatctgtgatttgaggtcacacagtgtgtgccgcttgtctgtggaagtctccagccaaaggagcgtgtcaccctgagaggtgtccaggctgagaatacggacccaatccagacatcctgtcaggctgggctccacgggaggccacctccttggcagaatgcttgtgcccctgaacgggtgtcactccctctctttccctgggacatggtggttcataaactcatatcccgcggtggttaggaacacagcctctgaggtcagggaatccatgttcaaagccctgctaggccatctccacctgtaaggccctgagcctgtcaattaacctttataagcctcagttttctcatctataaaatggggctggtaataggaacacatcagattgctgtgaatattaaaatgagacaactcattttttttcttggagacaaaaaataaaatgagacaacacgtgacatggatcaaacacccaagaaatatgtggcacttaataaacatcattgattagacctatacgtacatatgcaatgtatgatatagaatacaaagtataatctattaattattcttcagtgtcgccagttggtctaagctcagagttctagcttggaggcattatggggttttctctgatactggcttttgggaaaattataagatgaacttggtcatccatttacccacttgcctttttttttcttttttttttaagacagagtcttgctctgtcatccaggctggatgcagtggtacagtcttggctcactgcaacctctgccccctgggttcaagcaatcctcttgccttagcctcccgagtaattggggttacaggcgtgcaccaccacacctggctaatttttataattttagtagagacggggtttcaccatgttggccaggctggtcttgaactcctgacctcaggtgatccacccgcctcagcctcccaaagtgtgtgggattacaggcacgagccactgcacctggcctccgcttgcccattctttattcgcattgagagcttcctctgtctgcatctctggtaagaaagtcacataaaccagctgcattcagtcctccgtctcacctacactgccccaacgtggggcaccactgtcagaaggatttgcagtgtagatgggatggaggactggaagtcagaagacctttgactcgggtccctaggtagccagggtgggggtgggaggagagagggaggtgggacagacacttggagagttggagacttgccctggacccgatgaacaaaaccccactggagttacctcgtgcacccacttagcattcagtgcttcaattgtatgtgctctgcaagggaatgactgcgtgggtttgtggaagaaaaataattcagtggtgtgggttcaggggcgaagtgaccgtgagatggatgctgttctgggctttcggcttccacactcccctcctgtgggagcagacacctgttcagcatgttgaggtccatggtgtgtatttgggaacaccttggctctttcacacagaggacatggcaatttattccaaaagtggaggaaaagctggctgggttggactcactgaaaggtggtgcgcccatccccctcagtgccccagcagggatccttgtgaggggagttgatacttctgctgtccacagtgacttgagtgttcagcccccacgtggaaggggaccccatgctgattgtgcaggggttttctcctgcaggggcacctgatcttggctgttgagagccctgggtcgttggggtcactgatcactgttttccttgaaatgggttctgcttataggctagtgattgtttaactctcagtcattcgcagacctggagttatgggaggtctagaaagagccctgggctggggagtccagatcccacttactcatgagctagtgtttcagatagtgttggtggttgccagggcctgtggaatggagttcttggctccttggcttggtatttaaggtcttgacgatgggctctcattgcaccttctaagctgcttctcccactgatacccaagcttcagccatggctcccgccattgcttctcccaggaggccttctcctcccatctctctgtatctggaggtcccaggctttagtcatttgcatatctctactgtgattcttgcaacatttgagtatcactgatgctatgattcacctagtatttgtctttgctggctcttttgtggttaaattaattaatttacttaattctgcaaatggaaaaccagtatcatttactgtaagatgacagtaaccttaaaagtaaataaaaaacaaaaccgaagaaaattccatgctcacactattccagacatgagctgctgtgttctggaaatgctaagcgtggactctgccctctcttttgctgaaatgctggagaggagttagagacagcctttctccctggcctaatctgaaggctgacaacagaatggaaagggcgctaactttctcatttgtgcatcagggttatttaagaccatcttggctgcgccctaaaatgatcacgggtcctaccaatgggaggtagcccatgtttggaagaacacagatcagtggagctcctactccttcttcaaagcccaatttgagtgctcctgcctcccatgatggcacctcatctgtgcatttccattcccagccctcccgggcttggagcttctggcacccagtggccttggctaagggaaagctccctacaaccctgcagggacagcatgagctccttgtccatgcccctgcctggggcctgtgctctacgccccccaggacgtattggactgccatcttctgtaggcccagatgaacaccaggaaaggaggaaatgaggacctactcttagccatgcaggagaccacccttcccaccaccacctgtgagatgcttggggaggtgggcagagctggcccccaagtcatgggttgggctttcgggggcagtgaccaccatggcctgaatgaaggctcaggagctggagcaggtgaggcatgctcggtatacatctttgatgacagtgggtggtcttgatggctttctggagatctatggagtcattccaagctccttctacttaattgctgtggaagtcagggccctcgccctctctatgtctcagatgtctgatctgtaagatgggggttaatggtggtagtggtcaccacataggatgcaggtgagagtttaacaaaatggagcttacgaagagcttggcactgtgtctggccacagaaagggctctgcagaggctaccagtctgaagttcaaaaagtggttcactatgacaatgccccagacctagaaagatgcaggagacacagggacaccccaaccactcaaatataaacaggtagtgccctgaagtcagggaggatgacagaggcagtcagggaaggcttccgggaggcagtgtcttgaaggatgggcatgtgttagccaggatagagtaggtttggcatgccacagtggcagtacaagcctccaaaagtgttgtccatctccctccctgcaaaggagagagagcatctgcttccctctaagccatcagatggggatgcagctctgcaccccacccacccctttccctggaggtggcaaaggggatgactgaacacttctcagaggctcctgagcatgtccagaccttagctgtaacttctgcagctaaaatgtgtggatgggaaaaatgctatccaaacatgcctaatcccaatcagaggattattttcttacagaaaagcttcacctatacttaatagttttaaattgttccgggtaccaattagacttttaattttgctgttccctccggcggctggaggatgtgtgtggtttgcgtttaatcagagttgaattcttttttttttttttttttttggtggttcttggggagggaaggagatgaggcgcctgttcagggtttccttcaggtcctcccaagacttgtgtagtgggtagaggtgctgggcagctctgagttaggggttctctgtctgggcagcaggggacgcctccagagtggggaccccaagtcccctcccacccgcctgaggttttgccgctgcagccctgcctggagaatccaatgccgcgttaaatatgtggattatccaaaaatttctgcagcaatagggtgagttattattgattcacagagcacgacaaaacatcactgcatgaattagcaaacagctgtttctaatttgagtttagaacggtacacagaggaacttgtttctctgttcactcctttcatttataatgaattttaatcactgctacaggtgagaaaaatgtagaaacaagcttgtatcttgtggaagaaacaaaggagaggcagatgctaacagatttccagtctgtgataaaagggatgttttggtacactttacatgtaattagagcgcagctgtttccagtcccaggtccacgaacacggccgaatgtgggctctgccgatctccaaagggagtcaagaaaaacagtgattcaaccccgaaagcattttgctttcactcgagtggagcagagcgccctttgctcaggcccttggcggtgttgcttcatgaagctcacggagatgacttcacaaggcgccaactccttgtgaagaggcgggcaggcgatgtcagggtgcgcaggaggtccacgccaggaggctggcaggagaaccttccggagctcctgagctcctcgtgcccctggggagtcccttgtaggggcagacttggggggctcttccttgctggcaggagttgatcactaggctcctctttagcaagtttgatcacagccagctctcgggtgagctgatgagcactggctttttttttttcccctttcctagtctgtttaatttctgcaataaaactcgagctcaattgcattttcaatatcagtgctaagtaaatttgtctaagggatggagctgcctggcaggctgtgtgttctgcgaggtcagaggcttcaaggggaaaggtggacgcgtccttgccctgcatgtccagcagccatgtgggggcgggggagggagtgttctgggagtctgagcctcatcccccaccccctccaccatgagctgagggacccacatccaagccatggatggctcccagtaccttagattctctgtttgtgtaatgagagcgttgggctccatctgtataatgaggggtcttgaagctcctttcagggctgatgtcctgggattgtaaatggcaggggccctctgagaattttggcaggttgagtttgctttgtttgaaaaccatcttgtgcacgggtaactgtaggtttagcttagaccctgttggttatcaatcagggctcagggaggtgacactgtgtcttgtgtcccctcaaaccattccagccattgccagcctctccttgtcctgtgaccaccttatggtgatttgggagccagtagccagtgactattttaggcattatagaacatttgtcatatataacgccttacagatattcactgatttcatctttaaaacaactctatagttgggtctataaatagtcatccccattttacagatgtgaaaactgagacaggtttctccatctgtaaaattgagcaagggtcattcacttggctaaggtcacacacatagtaagtgggggagctgggagtctaagccctgctgccggctctcagccaccaggcaaacacagatgtctccaaggcccgggacaccccctaatggtgagggaagtcctggggtgctgggcatgcaggggggtgggggtccctcctccaagaagccccagctgagctccatcttccacatgccagatgcagagtctgtgctcccaggccttcttctccttcaagaaaaaccgtaagtgggccaggcgtggtggcttatgactgtaatcccagtgctttgggaggctgaggcaggaggatcccttgaggccaggagtttgagaccagcctgtgcaacatagagagaccctgtctctacaaaaaaaaaaaaattaaaattagccaggcatggtggcacgcacctgtggtcccagctacttgggaagctgaggcaggaggatcgcttgagcccaggaggttgagtctgcagtgagccatgattgcatcactgcactacagcctaggtgacagagggagaccctgtctctaagaaaaaagaaaaaaaaaaagccaaaagtgactgtgaattaaggaacaacaacaacaaaaagttgggaattcttgatttgtaaatgttggcattttcacaaaatcactaatactgataactgggtggcccccagactgtccagtgggaggacagccatgatgacctatgacccattgctcagggcatcatttctcccagtccagctggctaagagccctgggttggaagttcaggcctagctcttccagtcactttgtgatgtcaggatgtgacctaacctctctgttctttttcctcattactggggtgaccacacaacttactgtgtaagctcagctgtttatgagggtgagagggattcactaactgaatgggatgctgggttccatcccaggatgcctgggtgtgtggccccccacttactcgtaatatggggataataacaataacaaaaccaccatgaccaccaccactgcacagagttgctccagatgtcaaatggataatgggtgtgaggtgctgcgcaaaatgttaaatgccctgtagattatgggatttacgatgaatgataatagtgtcagttacattaggaacccctttatcttatttagccaatgttcatccaatgtttagcagtatgtaaacattaaccactttgtaaggtagttacttttagtttccccaggacatgggcactcagagaggggcagtaattttcccatggtctcacagctaatgatggctgagcaagccagtgcacactcttactcatggctctgctgtccctcagggctgacgtctccctgcaattgactgagtttcttcaagcttagcagcctaagctaagttttgagtccctggaagttttgttaagggccttggtggcagctgttcactgtcacatggcatttcagcagcccccagagctggctggagaagggcaggcctggtcagtctctgtctttgagatgtccagtgacctctgagtcttttttctcccaaaccgaaggaatgatccctacttttccttgcttatactttggggatgatgagatcccattcgtaagaaactctcagctccctggaggaggaatgagtgaataggtgctgctattatttttgctaatagcataattctaactcgagatttcaggaagagccatgtcagcttctggtcacctttgtggagctccttggcttacctctgaggaaagaacctccaatagcctcatccctttcctttcccagggtggacttttgatgtcccaggggtcaaacttaatcctttacacttctcctgtcagatatctaggtgcagtactgatgttacaattgaagggattctctctctctctctctctctccctgtgtgtgtgtgtgtgtgtgtgtgtgtgtgtacttcaaagcagtaaagggtttctttagtgtttaatgtttaaacagtaattaattgacacggagattggacagataagagcatagaaacctaagaatgctgggtacctctacaccctttggaaaactggatatttagagcaggcatcctaaatatgtgctgaattaaaaaaccacccgaactaggagatagtagagagctgggatacctaccacctgagacttactctgtacccagggcaggcacagacatcattaagtgataacagactgtaagagctacaaagcctcttagagacctgttcgtcggattctctctatcaagagatggggaaatgaaagcacaaagaggggatatgcttgcccatggttacacagttctggaatctgaacctggtccagtagtgatctcatccactatggctcatggctccaccctctgggcttgaggttctgcccgcttagtcatcccttttttccccatgaaaggtagcatgtactttcatctgagtagttttattaacctgtttcctgcttgtgaagttttgggtgtccaacagacttctttcatcctgtactctctctgtcctttttggtttaagctggcagtgtttctgtcagtataaacttttcaagaaccttgtgagtctcctgtgtatgtcatgggtattttctccattattcaagatggtcctctacagatatttcctggataatcccttctctacttttgtcttttgctgagattgctccagagcaatacccccaaatttcctagatgctctctaatttgatctaggagatctgtgagtcacacccttaatctcaccaaagagcctttgttgtgactgaatactcaatactctggcattttgattttcctgagatattagcaatatgtgcagtcctaccttcagctttttctccggagcatgctttcttgtaagtaaatctcttagagttttttttttcttttttcttttttttttgagatggagtcttgctctgtcacccaggctggagtgcagtggcatgatcttggctcaccacaacctccaccttctgggttcaagcgattctcctgcctcagcctcctgaatagctgggagtacctggaattacaggcatgtgccaccatgcccagctaatttttgtatttttagtagagacggggtttctccatgttggtcaggctggtctcgaactcccgacctcaggtgatccgcctgcctcagcctcccaaagtgctgggattacaggcgtgagcactgcgcctggcctgcttaacagttcttttcttaatcttttttctttttagcagcaagaagaaaccagcccataccttccacagtttgcttggaaatctacttagctaagtatccaagtttatccatgaaagttctgcttcccacataactgtgagtcataatttcacttagctttctgccaccaagtatcaaggatcccccttccttcagtttcactgtcagtgcctttattaatatccatatttctcttaatagtctgttcatgatgatttagatatttcctaaagtgatttaggttttctctgatgtgttccttactttcttctgagtctttattaacagagtcattaatatctatgtttccattaatctgttcaaggttacctaggcttttaaataaatcatactcctcaaaattcttctaccctctgatcgctgcccaattccagagccacttccatgattttaggtatttgttctcatagcaccccactcctggtaccaaaatctgtattagtttgctattactgctgtaacaaattaccataagcacagtggcttaaaacaacaaacaaaaaatagtatcttagagttctgtaggtcagaagtctgacccagatgtcactgggttaaaattaaggtgttggcagggccgcattcctttctggatgctcttagggaaaaatccatttccttgcctttccagttcttagaggctgctcacatttcttggcatatggcctccttccatcttcaatactagtaattgctggttgggtccttctcatattgcatcacctcaacctcctcttctgcctccctcctgcacatttaaggacccttgtgattacaacagacccatgtggataatccaggataatctctttattttaaggtcagccaattgtcaaccttaattccattttaccatgtaacgtaacatattcatatgttttggaagttaagacttggacatctttggggtaattattattctgcctaccacaatctccaggtttgcttctgcataggctatttaagcagcaggctactttacctgccatccagtgaggaaagaggccagcaacattcattagtgcttggcatcagacccagcctagcctggtcatccaccactgactttgcctcaatggcaggtggggttgtaaagcttaagacctgtacctggttcaagtcacggggcctggtactgtgcttgtgcatggtggacctcaagaaagagggagcaggtccagcagggatatgggccttggactggctccagggcctggtgaagcagtgtagcctggtggttagtaagtgggtgggggcatctgccacttgcaatgtctgtgcgctcagaagttactttccttcttggagtgtcactttgcacagttataaaaaggggttgttaatagtacctacctcatagggaatgtgtgagaatcaattgagaaaaagctggcaaaggacctggcacatagaaaatgtgtcatacagctgggcgtggtggctcacgcctgtgatcccagcactttgggaggccaaggcaggtggatcgcaaggtcaggagttcaagaccagcctgactaagatggtgaaaccttgtctctactaaaaatacaaatattagccgggtgtggtggtgggtgcctgtaatcccagctactcaggattcctaccgaggcagagaattgcttgaacccaggaggcagaggtggcaggaagccaagatcgtgccactgcactccagcctgggtgacagagcgagactccttctcaaaaaaaaaaaaaagaaaaagaaaagaaaatgtgccataaacagtaaccactggatctgcctgtgacttgtcatgttgcctcagtttctccatcagtgaaataagatgagggaggagctatgcaccctctcttgccctcaatacactgatgctagttttacaggcagggatgtaattgagttgaggagtattctgggatggatggctagttctggcatcaggtgtgtgcaagtacccctggtttcccaagaagtgatcaggaatatgcccagatgccccttgagctcaatttggatcatttcgtgtctggaaagccacctgcttaggctctggctacctctgtgggaaccacaatctacagtgtgccctgaagcatattcaggtcttgcagctcttattaccccaggctctaggaaacactgactggctctcctcggttgtccgggctgctttgtgtccactttgggcaatcctcaccatcagctgatgtcacagctgacctatctggctggagattcctctccagactccaacacagttctacagtatattagttcattctcatgctgctgtgaataaatacccaagactgggtaatttatgaaggaaagaggtttaattgactcacagttgtgcatggctgggaaggcctcaggaaactaacaatcatgttggaaggggaaacaaacatgtccttcttcacatggtggcaggaaggagaagaatgagagctgagcaaagagggaagccccttaatacaaccatcagatctcatgagaacttactcactatcgctagaatagcatgggggaaaccacccccatgattcagttacctcccaccaggtccctcccaccacaagtggggattatgggaactacaattcaagatgagatttgggtgaggacacagccaaaccatatcatacggtatctgtcagggcctcttgtctctctgtgaccaacaggattttgggaacaccaaagcctcatctctcaaagagaatggacagctccttttttggaagaggaaacctgaaaagcatctagcattgggagtcaggagactcctctttccagtttgctcagtgccctttgactattccattcctacatgtctctgctcatggcagacatcatcagttgattgcagcactcatttctttggacctgagataaggccttggaatccttctgaacacaggattctaggcaaccactaccaattagctgggcttgtaagttttcttctcttttctgggcctcagcttttccatctgtatcatgtgggattgggtagttggttcctgagtctagggtcccattcctctgagcttagggaagggccacagtgattcctattcttggagctctgtatgggggcagcagagaagctctgcttggtgtattacaaagctttgtcctgtcgggaactggtctccttggcaattttcatttttctgaagaaacagttgagtggcaaggagtctttttggggactttgtgaagcactgtaaggccattttgtgtctatcatgaagatggtcttgatggttggagtattgtacaaggtgatctttatattcatatggcaggggctatagagagcatgaattccagcttcccatgagccagcagaggcagtggaggcccagcctcctgatggactctctgcccgttgccccagcatgactcccactggtgcctttcttgctctacttggcctctcctttgcatggtctggaatgtccttggggcaggaccaaggtgggatgcacccaggcgaccctgcagtattcagcacagtcctgggcacaagaggccctgaggactgggatggaaaccttattccaatggctggatgagctcttgttccctctgtaggctcacggtttttttttttttttttttttttttttttttttttttttgagtcagagttttactcttgttacccaggctagagtggcatgatcatagctcactgcggcctcaaactcatgggctcaggtgatcctcctgcctcggcctcccaagtggctggggttgcaaatacacatcaccatgcctgtgtaaattttgttcttttttttttttttaagagacagggtcttgctatattgctcagactggtctcaaactcctgacctcaaacgatcctcccacctcagccacccaatgttcagggattacaggcatgagccaccatgcccggctggatggtcatttttattcacacagatggaactgcccagctcaggaatgtcctagtaacctggaacttcctgggctcagctatcttccccccaaactcaatgcagagagtccccctagtgttctttttagggcctcttgcatagcttcgatggcaggagttcacttcctcttccatgtgtgccccccactgcaggaaggttccctttcggcccactcctgtgagtctgtgggccagtcactctcctgccttggcccgagcaccttctccagcatctctgaccttgattctctgtgacagaggagccgtgagctgtggctcccagccattctgggcggccacttgcactgctcagcctagatgaggtgtgtccgaggcagttttacacactgtagcatcagcctgctgaattcatgtcctgctccatgctggtcaccaagtgtgaccacatgagcttgggaatcacctggctctttctgctgctgacgtgttctgaagcccagttaatgttcttttttcaacttaattgaatttttatcaaaaattctctcctcttttatgcttgttttctttctcttcctgcagcagacagcaaaagcctcatataacccatttcctatttggcctttttgcaggattagtcatttttaaatgactttaatctccattttgcaagtgtgtgtgtgtttttttaactcatttttgttatagttctttgattgcatttactctggggggcaggggaagcatgggtctgtcattagtcattgtacttcccacttgattttctcatgcttctcctcccaaagtggggggtggggggtagtgaagccttgtgggtgaaaacactgactgaacaggactaagggggggttcacatcctgactctgctgcctgctggctgtgtggcactgggcaagtcactcagtcgctctgtgccctggttttctcatctgtaaatggaaattataacagtccctaactcattagcctattgagaggattgaatgagtgagtacacattaactcttagaagaatgcctggcacacagcaaaatcgatgcaagtatttacttgaaaataaaaatgtagcgactgaacaggactttccttgaacccaccttcttcctgaattctggaatgttcatgttggaggggactttgggattgccttggccacagttgcaggtgtgtgtgtggtgtccagcatccagcatgaggaaagtgtcattgctataagagaggagaaccttgggccaggcgcagtgactcacacctgtaatcccagcactttgggaggctgaggcgggtggatcacttgaggtcaggagttcgagaccagcctggccaacatggtgaaaccctgtctctactaaaaatacaaaaattagccgggcatggtgacatgtgcctgtaatcccagctacatgagaggatgaggaaggagaattgcttgaacctgggaggcagaggttgcagtgagccgagatcacaccactgcactctggcctgggccacagggcgagactccttcccctcctgcccctgccaaaaaaaaaaaaaaaaaaaaaaagaaaagagaaccgctttctctgctgacgcccctgtagatacatcccgagctttggccctagcttatctctctagcctgtttctagagcactgagctaagtccccccaaagcaaaatgcatttggagggggtgggatggcagcaggcgaggttgaatgttctttgaataaaagactttaaacagggcaatctgagtttgggactttatatgtcaacatgcccattttccctgattgggccttttcagtttaaggagccttattttcatttcaattcagatgattataatctcagcagtggctcagcttgttgctcccagaataatacgctttgctttagtttcaaaacttgtttgcagaaaaataaagccaagcagccagcctgcaatgaaccttgggtactctggtgccgggcaggttaagattctccttttcaaagcctactgggtgaatgactgatgtggggcctcgggaccaggttctgtactcctacaggatgaagtttggccagacactaaatggggcatctggcttggtactgggggccagttcctcacctccctgaaccccacttcctcatctcagaaatgggaatgttactgcagacagccagatatggttgttgtgaggatgaatagaaattaattgcgataatagacatacttagcacagtgctggcacgtgggacattctcaataaatggagctgttaatattgttagcacttgtggcactaattagtactaattcttattattggcaaaatagtgcttttgtttaacaactttattgaagtataatttgcataccataaaattcacttgtttgaagtgagcaactcagccagtctttggtaagtttacagagctgtgcagtcttcacccacagtctagttttagaccatttccctcatgtcagaaggatccctgtcacctgtgcagccagtccctgctcccatctccagcctcggacagctgctaacctgccttctgtctcagatgcgccttattctggacatctcatgtcagtggcataatagtgctttctcccattagtttttctcatccactcctcccagtgattcccttttttcagatgcgtaaagtgagtggttaagaggaatgttcagggcatggatgaattcatagaggagctgggagggctctggctctgagtgagtgtcttctggtcttcaggtggtgtgaaaggtttaggagcaaatgaaccctggcagaaatatctgttcaggcttgtcctagggacaagagtgatagtggtttcacctgcccagttgttgagacttctccacacatcagttgctgggtgggttccagccagttcctgtgtctctctgaaccctgatgagcccctcccagaaatgcaaatcatgggccagccccagccctcttcacaaggcaggctccaaggagatcaagtcctgaggaccctggaggctttacacgtgggcctctccccttcttacccacgcaggagtggtcttatttgactgtttggcccccagaagctggtccaggcccacatcacgatcaaggggcctgaatgtggacagtcctggcatcagtctctggcactgtcatttcccagagcaagtctctgaggccgtgcctcagtttcctcgtctgtccagtgggagtggacctggccactcatttgcagttgtgagaaagcacttagcactgagtgctgggcacacaggaagggctcagtggcagtttgagtgagtctgagtgaagacatcaaaataataagaagccagtccagcctggcctggagcgggggccgagtaggtcccctggccccagccatctcctccctggggtcccttttgtctgtgccccagagagcccagctggcaagagctgggaattggcaggcaggggctggggcgcctcccactgcatctcatctggggagctggccacgactgctgcatccttcccgtctgccgagcccgtcatgtgaggcccccgggggagaaggtgctggtgctctgggagggtgttccaggaggccccttgagctgggctggggagctgggcttcagaggtgggttggctgccggaagccttgcagtcgggagctttggagaactgcgagcttcggagagccgcatgcatcccggttgagctgtgccaatggtgccaggggggtcaggtggatcttcacacaatcagcgctgcgggggccagggggtgggggcggggcctaggaccaggctcagccccagctgtgagggacccctcaagaccccccaatcagcctttgttctctctttaagtcttaggatcggcctgggacagcagaggcagcttgtgtggagagccttgtagggaaaccacaggtctgtgatgtgtgtgtgtgtgtgtctgcaggtgaatgtgtgtacatgagcgtgtgcatgtatatttaagtttgtgagtgatagtgtgagtgtgtgggagtgatggtgtgaatgaatgtgtgtgatggtgggtgttgtgtgtgtatgtaggtaggcgtgtgtatgcgcatctgtgtgccagtgttcacccgtgctgggagcatggtgcgcctgccccatcccttcctgaaggtctgggctgcctctgggccaaggttacgtctgggttacgtctgtgaggctcttctgaagactcagccaggctggctggcggctggagaggcgggggcagtggtttatttcctcggggttacaagagcaaggtcagcggagccgaatctgagcttttgtttgtctctcccctgcccgcagcagcctgcggtctgtttcattcattattaagttttaaatccagccgaagagaaacttgagccttggaactcactccctgcccgggctggctctgctcggcccccgccggggaatgtctctagctttattcactgtgtcctgtgtgcctttgttttcccagaaacggcctacccttaggtttgtttagttttcctctgaggctagccgggccagcaaacgaggggggttgtgggggctgtccccagggagggtgggactggctggagtctgtacaaggattgtctcttccttgcctttgcagtggggttaagggtccgcctgggtctgagctctgtggccttccatgtcctcattcatcctccaatcactgtcaccatctctccatctgtcttgatcctgggtggggttggggcaaatccaggggtgcagtgggaacaaagaaaacaagggtctcaggatggcctgggccaggaaacccacagatgcctcttcagtgccctaggttcccttcccacctgagcactgaagtctgctgtctcttgccctgtgatttcacacctcctatgtcttgtctaccacctgaagcagcagcttccagctccatcagtccacccatacccagagaatggtgcattctatggccaatctgataagggcatttttgttgttgcaaaattttgcctgtgttcataaggaccagtgggatttccttccctccaggattagggatttgaggggagttgactcccaggtgtggatcaagtgacaggacttgtcttccttttggcctatgggactggtggtctgtgagttcgtttccagtgactttgtccaggctgcccctcctttccctatcaggaaagtggccgagagcctcccctctgatggggggtatcatgtcctgccaggtccaggcaagtgttgtgaagggaaaaggcgctcccccttcattatctgccgcccctctggcgtgccctctgcagacaggaaggccctggtgtccacttgcttccggcccctgcccctccccacagccccctgcagccgttggccagctgcacagcctcagcccgcgtgctgtcgagaagctggctctgtccttgtttctcggcagccctgggaattgcctctaatatcctctctgccttctcttgcagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccgggtaagtgcagtccacctcatcctgctccctgctcctctccttggggctcctctggtccccacaggagccacgtaccctgagtgccgtgtttccaagaagcggcgctatcgcgcagtggcaaaacagaactgctgtgctgtagactccttgagtttgaacctcagcactgccattgcctttccagccatgtgatgggctcatgttatttatctctctgggtctcatttgtcaaatgctaatgtataaaatgggaataataattgtcccaacctcagagaattgttgtaagaggccgaggacatcatacaggtaatgtgcctggcacagtggctgatgcacagtgagggcaccatgggtggtggcttgtgtctttgttgttgagctggggtatgacatactcatttgcttattgggtctccttaggcaagtcactgacttctctgggccttagatccaggattcttttgacagttcatagagatcacacacacacaaggggccgagagcccagcactcatggctcagtggtgctggctgtcatcaccagctggtactcttatcaccagtggcatcatttcagttagtgcagttgctggtatgtggaaggccctttgatgtggtttcaattgctgttattgttaatgactgattgattcgttcatcaaattttccctgttcatcaaagcacccattatgtttggaggtgcctgggagccaaggagaaccagaaatggaccctgacttgggacttgtggaccagagggagccacaggcccatgataagtggctttcaatgagctggggagaagtctaggctatggatgggcccacacaggccttgggtacaggggctgaggggcaaccaatggtgggcctggagtctgtgtggcccttgggtgtcagacagcacaggtgtggggttcccattgagtctgtgttgtctgtttccagaccaaggaggtgccaggcggatctcaggagtatatttccctcaaggaccgctgctggcaccattggcagggaggcaggatttggggaagggccatctgccataggcaccggctgggacacaggggtgtttgctgagggtgtttttcctgggaccctgtgattttgagggggtgaggagggcagagggggagagaagagggccagagagagtaaagggaggaccccacagcggaaggggcctcagtgcctgctgaccttgacttctggtgttacacacaggcccacgggagccaagagggccaggggacccgtccgtggatatcttcctgaagagaggacaacttgaatgaaaatagcgaggccgggtgctgtggctgacacctatagtcccagcactttttgagtttggaagatcaaggctgcagttagctatgatcacaccattgcattccagcctgggtggcagagtgggaccctgttccttaaaaaaaaaaaaaaaaaaaagccaggtgtggtggctcacgcctgtaatcccagcactttgggaggctgaggcaggtggatgacgaggtcaggagattgagaccatcctggccaacacggtgaaaccccgtctctactaaaaatacaaaaatttaggtgggcatagtggcatacacctgtagtcccagatactcacgaggctgaggcaggagaattgcttgaacccacgaggcagaggttgcagtgagccaagatcacaccactgcattctagcctgggtgacagaggaagactccatctcaaaaaaaaaaagaaagaaagaaaggaagaaaaagaaacagagctgcatgtctggctggggcctggagtctctcctcaaagtcctgtctggagtggagagctccttttaggggctatagcagtaccccaccctctcaggaccctttgtctgagccagggttctaaacagggccccaggaggaccccctccaggggctgagcatgggcactggtttctgctgccccgctctgtccccctcagcctttctaggggggcataggtgctctcagggaatgttttggccttggagtcaggtggcctgggttaaaatctccttctcccaggacccagcggtaatttgacctctctgggcctctgtgttccactacgaagccagaggtagtggcagtggtaatgaatagtgatagtaatggaatagtaatagagtctctcctgggctgacatctctgcatctagggagaaactggggggcctctctggttttttaaccattatctgctctgattggtcactgcctgttccccatcatttgtgaaccattgtgactatttctcatgctgaccttagcgttttgctctgaggattaaatgtgtaaattaagtgccaagcacatagtaaatgtcgctgatatttttcccttttacaatggcaatccacactcattgaggagtaaggacttgccaagcactttctatttaatccttacaatatttcatgttgtaaatgaggaaactgaggcataccacaatgaggttgcttgcctcaagcccccagctttcgagagctgagaggagacttgaacccaggcaggcagcatctgcaccacagcccctgatcttgaccaacagtccacccagcagctctggaccacatcctggctgcaggaagggaaaggccagctggggtggggtcccgggtggtcacagctgtgctcaggctgtggggcagtgcagctgggctgggtcactgtgcccgcttctcctgggtgcccctcaacccagatcacccctccctttctggcactgcccaccatggtgctgggttttctgatggccagggagctgtttctagagcctccaaagccttgggctgtgtgagcctccctggagtgctctgcatccggcatcaagcaccactttgtgaaagcccctactatgtgagtggtgctctgctgggcaccaacttttaggtcatctctgtagcaacaatccaggaaccttgctgtggcctgtgttttggtaaagaggggctccagctcagaaaggtgatgccatatacccaaggatgcacagctgtgcgcggctgtgcagggactgaaactcaaggggaccgtgtttcctgggggcccccaggccttcctctccctgcctttgggccttgtgtgagcagggatgagctgaaaatcatggctctgcctgcctggaggcctggggagatgggccattgcagaaacaaagcccaggtacctccccaggcaaggcggcattctctggggccttgccccctgtgtgggcacacctggggacaggggcccagatgtcagttagcccaccccttccctccctgaggacccactcatgtaagaacagactctgggggtttcacaggggcttgggggctggcaggctgggaccctcgggagtgtatccatagcaaccagctctcagaggactgggttcctgtggggctgaggctgctgtcggctggagcatgaagcattgaagttccacctccccctctgtttatgggtaatgacaacatcaccccaactcgagaccagcacgggcagaccctggccatccattgatcctgcagatccccacggtgcctttctctgctaggtgggacaggccaggtgttctcatacccattttacagccaagtaaacagatatcaaggttagagggcctatccagatcccactagctttctgtcacctagaccaggcctggcaggagatctgggacatggagctgagaatggcagctcagacagtgggcatcgaattccagttctcctactcaccagcaagaggctctgaccaagtgatgcagcctcttgaaactccacttaccccatccctagggtggagcttgcagagggtttgtgagtatttagcataaatgctgcccacacatggcaagtgctcagtgaacattggcagtgctcacgatcatggaaatataacagctctggctggcttttccttctctccttcctgtcttgaagggcctggccatttcttccctgccctccctctcctgtctttgccattctcaagtgtgttttcttcctgcccggggcccccctctgcagttgctcagggctgtgttgggggaggcagccctggccacaggccctggaactcagctctagttctcctgggctgggccccagggaaggggcttatggcaggggaggtgctttgagtgccaagttctgtctttctgtaattatatctcctagtgggggctgaagctgcaggaggagggggtctccaggggggttgagagtggggatagactaggaatagatgttggggtgaggactggagtccagccatgcttggagggtttgggggctggtgagcctgtgtgtgtatgtgcctatgtgtgagtgcacatgtgagcacttatgagtctacatgtgtgtacatgagggtgtgtggtacgtgtggggatgggtctgtgtgtatacttgtgtcagaagctgcatgcatgtctgtgggcgtatttgggagtaccggtgtgtgtactggggttgtggtgagtgagctgaaggcagggtctctggatgagtgtgaacatgcccatctgtgtggccttgttcacccatgtggatggccctgcttctctgggggttgcacatatgtatctgtgttacaggttgctgtgtgtaggggttgcgggtgtgtctgtgaaggtcttgtgtgttgctggtgagttggggtgaaagtgagcatgtgaatgcatacgtgtgcttgcacatctgtgtgtgtgtcttgtgtgtatgtgaggggtcagcccttctcccggcccttcccttgggaaccctctgaaccctatgaagcccagtgccccaccaggaggggctcagttattgggcagtgttcttcctattaccaaggggtggcagagaggcatttgagggcagcctgttttcctgcccaagcccctggggatgtattttccaagcacagtgagctccctttattcacctgcccctgagaagatcaaccaagtcactgtgatcatggactgttccctgcatgcctctggaccagccatggctgcagcctctagagacttgcacccaagcaaatcgccatccttggaggggggacgtggtcatctgcccgcagccattgctgctggttggtaccaaccccatcctcccacccacccacctataggcctgggcggtcctcatccagcaggcctcccatgggcttccttgtgatgaagcttcccttcctgggatgtgcttcattcattaattcactcattccattcattcgttcattcattcaaccaccaaaggctcttgcactttgccaagcagagtaggtgggggcacatgtgagacagaagggatggttttgatgctggagacacccgaggtggttcatctccacgaccatggccctggagttgacctgagatgtgtactctgggctgcatctcctgagaagacctcaggccctgtagtctccttgtggcctagacgtcttcctttgtctgtggcaaggctggactccccagccctgtctttctctccaccctgcccccgacttacctagctcttcccagggcctttccatgcagagtgcctgtgtctgggccccaggctgtggcctgtactcaggacacagcgaatcccccaggtcttctgaaacactgtgggaaaggcccctggttttgtcagagcaggtcctggagcctgacgcatccagcttcagcttctccagttgtttcttcattcattcatttgttcaagcagcattttcttagcgccaataataatcgtaataaaagttaaataattattatgcactgactctaggtaaggcctgcgctagggtggtgtgggtccaggacactgaagtcatctttggttctctttgtcacctctgcctgaatagactcctctgcatatgttattctgcaactttatgtgttcagcaaatgcttgttaagcacttcatgtgctgcctcaaaggtagacaaaacacattcctggctctctgggtgctcatggtgcaagaggggagcagatgaaccaatccaccctgacacaacaatgtattaattacccagggtcctttagcataagttcagggatgtggagggggtcctggacccattctggggtgaaaagagaagtcttctcagaagagatgacatttgaattgagtcaaggatggagggggtgttgcacatagaggaaccagcacaggcaaaggcctgtagttacttagggaactgtgggtgtgggtggaaagagggaaataggaacagagaacaggtaggataaaatagaaattaattcaaaagatggtaggatttaaaatcaaccatattgacaattacactaagtataaatggagttgaaatttcaatcaaaaggtagagattgtcagattagatgcaaagaaaaaagcaagactcaattgaaagctatctacagggcctggactataaatataaagacacaggtaggttaaaagtaaaaggaaagaaaagtgtgcaccatgcaagagctcatcataacatttcagaatgataaagagggaagtaggagctgagatggttaagctacctggtggttcatctggctgcatagttgagggttgggcctgggaccttggccaagaagtgtgaagtcctgctcccttttccagaagtaagagaagccctctcatcccaggaaccaaagtggtcttcaaaaaacttggatattgtgattccaataccacccctctttcttcaaaaaaccccacagccacagtccttccctcagatgggcaacaccacctctgtccctggggtgtttcagaaccatctgggattagttgtgtgagtgaggttcactctttggaacaactcttcaagaagctttgaagcttctcatctcagtttttctgccctcagctcccacaggcagctggtactagcccctgtgtgtggaaaccagctgtaggaactcttggggtcatttgtgcttagggcagatgaggagttccttagccacccttgaacaccagagttggcaggaacagtgtcccctgctcagccacatggttattagggtaagtaaatggatgagaaggttattggataggtagaaaaatagatagatagatggatggatggatggatggatggatggatagatggatggatggatatgtgtgtagatggacgaatgggtagacagacaataggtaggtggatggatggatagactgatgggtgaatagatggatggatgggtgggtgtatgcgtggatgggtggatgtgtgtgtggatgaatgggtagatgggtggatgtgtatgtagatggatgggtgggtagatagaggatggatgcgtgggtagatggaagatggatgaatgggtagatgggtatgtgtgtgtgtagatgtgtggatagggagatggatgggtagatggagtatgggtggatgggtgtgtgagtatgtagataaatgggtgggtagatgaaggatggatggatgggtggatgggtgggtatgtatgtagatggatggatgggtagatggacgatggatggatggttggagtagatggatggatgggtagatggagggtggatggataggtggatgggtgggtatgtatatagatgaatggatgggtagatggaagatggatgggtgggtatgtatgtagatggatggataggtagatggaggatggatggatgggtggagtagatggatggatgggtagatggaggatggatggatgggtctattggtgggtgtgtatgtagatgggtggatggatatatggatggatgggtagatggaggatggatggttggatggatggatgaatgggtggatggatgggtgtgtatgtaaatggatgactgggtagatgggtgggaatgtatgtagatgggtggatgggtgggtgggtgtttatgtagatggatgggcgggtagatagaagatggatggatggatggatggatgggtagatggaggatggatgaatgggtatatgggtatgtgtgtgtgtagatgtatgggtggggagacggacgggtagatggagtatgggtggatgggtgagtgagtatagataaatggatgggtagatggaggatggatggatgggtggaatagatggatggatgggtagatggaggatggattgatgggtggatgggtgggtatgtatatagacagatgaatgggtagatggaggatggatgggtgggtatatatgtagatggatggatgggtagatggaggatggatggatgggtggagtatatggatggataggtagatggaggatggatggatgggtgggtatgtatgtagatggatggatgggtagatggaggatggatgggtgggtatgtatgtagatggatggatgggtagatggaggatggatgggtgggtatgtatgtagatggatggatgggtagatggaggatggatggatgggtggagtagatggatggatgggtagatggaaaatggattgatgggtagatggaggatggatggatgggtggataggtgggtgtgtatgtagatgaatggatgggtagatggaggatgggtgggtattatgtagatggatggatgggtagatggaggatggatggatgggtctattggtgggtgtatatgtagatggatggatgggtatatggatggatgggtagatggaggatggatgggtatatggatggatgggtagatggaggatggatggatgggtctattggtgggtgtgtatgtagatgaatggatgggtagatggaggatgggtgggtattatgtagatggatggatgggtagatggaggatggatggatgggtctattggtgggtgtatatgtagatggatggatgggtatatggatggatgggtagatggaggatggatggatgggtctattggtgggtgtgtatgtaggtggatggatgggtatatggatggatgggtagatggaggatggatggtagatggatagatgaatgagtggatggatgggtgtgtatgtaaatggatgaatgggtagatgggtgattgtgtatgtagatgggtggatgggtagatggaggatggatgggtggatgtttggatggatgggggcatgggtagatggatttgcccttctaagcaaggaggcctcccctcagctcccttaaagcttcaccttgagatggcagttttcccagatctagcagagaagcagctcccttggaatgtagcttcatgccccttcctcagtctggtagagctggatttagaggaaggtgggaagagaatggcctggggagacctaggaggggactggaaccattctggaaagtcttgacccaggccccctaggaacttttgctttctcctttttcctacctcctgcctctctaaatcttttatttttggtttccaaacagaaaaagacataccagtgcatcaagtgccagatgaccttcgagaacgagagagagatccaaatccacgttgccaaccacatgattggtaagagagcatttcctcccagccatgctggagctactctttggggttttaaatttgcggttccaatcatcattttactggcttttaggccaaaggacagagtcactgctgctgtttctgagacattgcacatgggagtgaaaatgtcagaatgggggccctttctccatctgagccttcttgtcgcagctccactcacattataatcaaacttttgacaatctcttccattttccagcataaatttccctccgtttctgaaacaaagtgctttccaattgtcaagcactcaggagcaattatgcttcaattttgtgtgtcatgacattgaatagatttaactgctcacatttccctactcaacatggtgaattcctcaggcacattgtcaaaacagaacgcttacaaagttatttcagtacttttcccattcctcttcaagtggttttggactttggaaaattcagcctctctagaagggcagcttgcaaagttctatggagttcacacacttggcacaagagacctgggaagctgtgaagtcccctctaccttggatgggtggatgtggtctccttggcagctaggggtgccctcattgtaggagagggcacagctggatgttctgatgttctgataggcatggaggttctaagggaaggggctggcctgggatgggctggggcctgggagagcttcaagaagcctggtaccctgggtctttgttggacatgtgatcactttctccaagactctagtctgagcagtgaagttgcagccatgggttgaacttcatctttttgttaattttttattttagacagagcctcactctgtcacccaggctggagtgcagtggtgcaatctttgctcactgcaacctctgccacccgggttcaagcgattttcctgcctcagcctcccaagtagctgggattacaggcacctgccactgcgcctggctaatttttcaccatcttggtcaggctggtcttgaactcctgacctcgtgatccacccgccttggcctcccaaagtgctgggattataggcgtgagccaccacgcctggcctgaactacttctttacttcatctctgtttttcttcttctagcatcttttcattgttgtcttaacagctatgccatcggagtactggtttacaaaaccctttactgcgtacatttagaaaacttctcataagtgagaagcttaatgaattttcatgaactaaacacacttgtgtaacccacacacagatcaagaaacagactatttccagcatttcagaagcttccctcttgggctccttcaggccctcccttaccaccaacaggtcatcacgatgctgatgtctaataatataggttggttttgcctgatttctagtttatggaaatggaatcacagtttctactcgtttgcacctgacatctttcacttttcacattattgcctctagttagagatcatgcctctcattggtgtataataatctgtcacaggagcatgccaaccactctttatctgtttgattcttgatgggcccattctgaaatagtgctggcatattcatggacatgtcttcttttgttttggtttggtttggttttttttgagacagagtctcactctgtcacccaggctggagtgcagtggcacgatctctgcccactgcaacctccgcctcgcaggttcaagtgattctcctgcctcagcctcccaggcagctggtactacaggcatgcagcatctcccctggctaatttttttgtacttttagtagagacagggtttcactatgttggccaggctggtctcaaactcctgacctcaagtgatctgcccatctcagcctcccgaatttctgggattacaggcatgagtcaccatacctggccccatgtacatatctactgatgaacatatgtatgtgattttattgtgattataggaatatatagatattatattttgcgtttatatataatacattatatactgttatatactatattctttatatgtgtaaatatgtatataaaatgggaatataggatttggatggacttgctgagtcacaggttaaatgatgttcacctttagtaaatgctgacaaatacatttctgaagtggttgtatggacttaacgcccccaccagtggtgtatgagagttggagtttgctccaaatttgtacagccatcaaggttttgtttaaggtttgcattgcaaaggcccttctttagtgaaggtgctctcagggcaggtatgggtcccctggtccctacctagccacagcattggccagtccccctgacccccaacctatctgacagcctctacccccagtgccttggagccagtctcctgcagccactgactcccaatcgtgtgtgtggtggggctcacctggcggagagtggggaggaggggcccaggaagagcaggtgggggctgtgggagcttggcctgacagggagattggtggcttcttaatttctccgtctgaaagccccctgctgaaggataagaaggggcactcccctgtcagtcactggctgctgagagtcctttcacggagtgtcagggaggtgaagatgaagatatctaaaaatgtttgcttttgtagcagatgttaatgcgcgttcctgtttgtaagcatgaagggcgcaagcctggctaattggactgcagtgatttctgaggtgtttctgccccctccctcctctcttctaccttgcctttagtgcagagcctggaagctatgtgtcctcaagtgcaaggcaagggggttgctcttaactagagttgtgggaaacacaaaaggagggtgtgaggggcatttgggcctgtgtatgagctgtgggccgggcttctgagggaaggcgccttggctggggggctggacaggtccccttgcccattcctgccctgcagcgctgtcagctgacctggagcccaggaacgtgggagttggaggcctggagagcaggcagcagggagtggttggttggtccccgagtgcagattccagttcactgcggcatggaaccccgggtgagccagacctccggtggctgggcagtccctctcgctctaacctgcactccctacctgcctgccctccccgagcctcatcaacccagtctaccagaggaccttgactgagcacctatggcatgttgagagttgcagcggtctctgtgggtgacgggagtacaggggacatggtctctgcttcagagatcatcccatagaagacactgcacatagcatgcagcaaagaggtcacattgaataaggatgctaacagctgctactgactcagcctttctatgtgccaggcactttacatgggcactagttccccatctgacagatgaggaacccggggcttagagaggttacgtgagttacccaagtccttccagcctgagtaatggaggcagagtctgaaccacagctagggtccctccattgtgtttggagcccctgccagggcctgtggtgggagagacctcagggttccctctccaggggaaggctgatgggcatgcaggtaactgcagtgcagtgatgtgggtgctcccagaacagggccccctgggcattgaaggatgaagaggggggacgttgccttcggagagatggctgaacatcaggaggaggctctggaacaatgggtttctgccaggctgcgagggtgatgagccactgcctatagcaggatggggggtgagcagagcaggtgagtctggggggctgtaggtgcttggcttggccaagactgaggcattgtggggagtgagaatggggagggggttggggtgagccatggagcacctccgataccaagtggaggggttagggtttgtccttcaccccgtaggccagggtccaactttgggggccccttggctatggtttactaggcttctcttgaaaaaccacaagaggtggcagcaagggcttcacattcccgcaatcatcattcccacctggcgtgacttagcagcagcagcagtttcctgtatgtaggcaaggcatgcattcccaggcatcatggtcttgctcagttaagtctccagcctggtccctgtgggtacctgagtttaaaccttggacttaagcgctagggagccattgaaggtttcagagcagggtatatcctggcctgagccttaggaagaagaatctggctgcggtgttgagaaggaaccagttgggaagagaacgaagacccacctggtgtggtcctggggtgagtgaacagggcagggggagaagaggagttgatggaacttagatgtggcttgtgctgtgattctggctggccctggtggcttgggaaggctgctggggaaatggtgagaggcagacactgcaggcctggtttggggctggctctgcaatcccagtaaatcttttggggcccagtgtcccagtggatggcttctcctgctaaatggtctgagcccagagtggctgccctgccgctgacgggggtaaaagtcccccttagtggcaccagggggacttggtgggtagaagtggccctgttcagctctgcagccttctcataaactcagggcacttgggggtctgaggcaggcctcccctgggacccggactgctggagagctcccctgcggggcggtaaaccggcctttttatagcgggggcctctgcatggctctgcagcccggagaccctgggagttatgatgactcagggacatgtctccttggaaacattttcccagcacccctctcctggctgctgcttggaggggagtgatttggatctgatagaaaggcgagggtctttggaaacctttcaatagcagggtctcctttgaaatcccccctccgcatggagaatgaggccccttccctgggactcccccagcttttgaaatggctttgacacttcctcccccagaaggcacatgaaaaacttggagcagcccagagctctgtgctgtggcctcctgccgggttgacccagctctgcccagtcgccctttccccacctccccttcaccccctccgaggactctgggaggatgactcccacctctgccgccccaggaaattgctctgcaggaggcccctgccttgggctccccgggggggctgctgaaggagagagagggaggcttatggggggcttggcccagaggaagctggtcccccacggctgggaagggaggagcagtgggtctgcccacatgtgttgaacatatatgtataatgtatgtacactgccctcctggggcacatggcacctcaccctggggggcagggcctgagtctggagacccccaggaagccgatttgctggagaggccttacttttagtttgttttgggtggggatggctggataaggggtctgagaacttgtccttgagataacaaacttgccatgacccaggttggccccaagggagtgactcagcctctgggcccctggacgtcctcacgcagggcctcacgggccccttgggggagccccggggagggtcagggctgggaagggatggtcctcagggaatcttgtcaggaacgcttgcccttgctgtccttggaaagtggctgtggactctctggcgggcagccaggccagagccaggcctgtcccggtggggcattagtcattccggaggcctgcttttcatgctcacgccggccctttccctgggtgccttcaagggctgggctctgctgtcaggggcaaatacatgggggaggaagtgggtgtttggaaaatcaacccctcctgcctcctgcccaggctcttaaagtgtccccagtgccagcttctgtccttgtgtgtcctcttgtccccagccctcccctgtcactgtggcaggactggccctggccaacctggagggaggcatgtgttttgtgtctgtgtgtgtatgtgtctgtgtgtgtatgtgtatgtgtgtgtctgtgtgtgtatgtgtatgtgtgtgtatgtgtgtgttgtgtgtgtgtggtgtgtgtgtgtgtgtgtgtgtgtgtgtgtagaagagagagagggaaagagggagacagacagagagagggtttttctaccttacaagtctttatgaagcacatccctggagatactttcaaaccaccttgcagagccagggcccactgttcaagctgccatttggaccctggccccgtgctgaaggcccagcctgcagcattttggaggggaaggagtctctggtccaaggaggacagtctggagtggaagtcagtgtctcgccccagctccagggagatacaaaaaacccaaatagaaccacagaggaaaatctcatgaacatgaaaagaaaaaggggttcctgtctcctttctgccaggatcacgtgttgctgaaccgggctgtgtcaggctcttcaatggtgcttttgattcaggtaacaccagacccaaaacatctgtctaaccttaatatgtgataaaaatgtctccctctccctccagagatcatgtttcaggttctggaactgttctgtcagaataacaagcctgtacagcaagactataatccaattcttttttattcttttttttttcgttgccaaacccccaaactagggcatagtcacttccccctcaacagtcttcctggctgagagaaccagcccaaaggacttggtttccctgactttgaatcccgttggttcattcgaggaagctgtttaggtctatggagaatccatcagttctgaattttaaaatagtggaaaatttctcattttcttgagttccttttgtatgcgtatgtgtttgtttgtttgttttgggggaaggcctctgtcattgaggtttcttctagtagtaacctcataccttcatgttcagtaaacactattaaaatcctcggtgggctctgtgaggggccgctaacccagctcaggagatgataacctgcaaggtcaatgtaacgtcacaagtctaagataagggagctcagaggacaggcatgttgcccaatctgggtattccaggaaaacttcctggaagaggttacacctaatcagggtctcagagtataagaagtaaggtgggaggggaattccaggcaaagaaactagtacaagccaattatagagaaaagaggtccatgtagtatgtagggacactgtacacaattcagtactgcaacagaacaaactttgaggcaggaggtgggtggatcacagcaaaggggatgaggtagagtaggtgagagaaggtgaggatgttggataggaggatatgggctggagaaacatttaagagacataaccagcaggatttgcttattgagtggacatgggagggggagaagttaggaagactcaaaggtctcaggtgaccaggttttgggtgacaggtggcagatgataccatgccagaggaagagctcttagggactggcagagaagacaatgatgctagcagtggttcatgtagcagtccattctcacactgttgtaaggatctacccaagactgggtgatttataaaagaaaaaggtttaattgactcacagttctgcagggctggggaggcctcaggaaacttacaatcatagtggaaggggaagcaagcacgtcttacatggcggcaggagagagagagaagaaagcaaagggggaagagcaccttatgaaaccatcagatcttgtgagaactcattcatgagaacagcattggggaaaccacctccatgatccaatcaccttcctctctcgacacgtggggattacaggtctctccctccacacatggggattacaattcgagatgaaatttgggtggggacacagagctaaaccgtatcagtcagtaccatctaatgaagcttactcagcaccaggcccttctttccatatctgcaggtgttatcacacttcaccctcacaacaccctgtgagacgtgctgtcattacttccttttatccatggggagttgaggtgtcatgtccaatgttgctagtttcagggtagggacctgaactcagccagtgtgactcggggcctgcgcccttaacccctgcacctgaaggctcatcacgtttggtgggcttgagtgtttgtgataatgtggccttgcacaagatacccatggagatctgagggccagcagggccctgtctggggaagaggatccagcggcatcagcatagatggtgagaacatctgggaggagcctggagagtgaggagtgtagggtggttggtgctgaaggagcagtgtttccaggaatatcaattgggtgcagtgtgaaaagtgcactgggagggaggctgaagagggtctgtgtggctcagcaacaagtggccattgtgtcctgggtgtgagcagggtcagtggcatcagatggaaggggtcaggaggagatgggggtgggcagcagtgtcagtggactttccgggttccaggctgggagaggagggagagaagtgggagctggaaggctccaaaggtaacaggaagtatttgcatttttaagagagagagaccaaagtgtgtttctaggttcgggagagagatccagcagggaggggaagaggaaggatggaagtgagggagatgctgatggagctggtcctggaggggctggcactggagccctggcatcatcttgcttgagccggctcataagcatgttcttctcttcttgctgtcatgtcacatgggcttggtggcctggattgttgaactgactttgttgagcatcctttgatgtcatttggctgcttggcagcagctgatgcatgggcaatttccctcatacctgcttctggctgagccttactggaataacagcagacaacaagggtcctgtggccagtggccccagagcttggtcccctctgtcctgagcacccagtgggcttcagagcctcagacctggccttggatccttggggcccagcggggagaaagtggaaggcctcttccactggcctcaggagcgtcctgaagctgcccatgagccaatcgttatggccagggaggtggagctggttatctggtcaggctggtgacccctgcccttcctgggtgtctgccccccagcagtggaagtaggaagggtattattgaaaagaaagagggcttttatttccacaagaaggggcagcacaaacagtgcaactcaccacacctactggttggcactgtttggaggattaaataaattaaaatgtatgaaaaggtcccagcacactgcctggcacatgttaagttctgaataaattctatctatcaatattgtattagtgttattagatgatgatgatgatagagtcccagtttagagaggaaaaaccggccatgctaagcctatataccagatgtcagtgcttatcagctcagaggatgctcctgagggctttctgcaagaagaatggccccctctctctgccttgtcaagactccaaggggctgggcctggaggacagacccagaaggagtagctccaatcaagccgatttttcatttattccttcattcattcagttttctttttttaatttttaatttttatgggtacataataggtgtatatatttatggagtacatgagatctttcgatacaggcatgcaatatataataatcacatcagggaaaatggggtatctatcacctgaagcatttattctttctttgtgctacaaacaatccaattatactcttttagttattttaaaatgtacaataaatgattgttgactgtagtcaccctgttgtgctatcaaatactagatcttactgattctgtcgaactatatttttgtacccactaaccatccccacttcccctccctccctgctacccttcctagcatctgctgaccatcactctgcactctatctccatgagttcagttgttttaaattttagctcctacaaatgagtgagaacatgggacatttgtctttctgtgcctgacttattccacttaacataatgtcccccagttccaagttatttttctttcttgaatacctactgtgtgccaggcagtaagcatgaatattgcagcaagcagaacagtctttgccattttgtcccagagcatagtgtctggtgggagcagacaggtgttcactaagagaacaagtaagagctcctgattgtgtccaatagtgatgggtaccacacagaagagaagggcgggtcctgggtgtgtgtgggagcaaggtgaaaatgaaacgtatgcagcggcctccctggaactgacttgcaggctgatagcaaagtctcatcaaagcattttttgttttggtcaagcacgtggctgcccaccgacctgaacacttgaacccactgctcagcacgtcctttccctgtagggaggcgagaccatttgggtggagccaggtcatggcgacagaggcccaggggttggcctgggcttaactgggtgatgctcctggtgcctagaggagccccttggtcaggctgccaggccccctgttaccgagactccagcatctgctctttagacctctggtttctgcctgattgccccacacagggttgtttcaccagcagctgggggacttcaggcctcccagcttgtgactgccctctgcccccaccatgggactgcctagcctgcgtgcctttctggtcctctggcatccctttgctcattctcttttacttctccctgtttccaccctgcctttttcagcccactgtccctgggggctccagaaccctcctgtcccatccttcccctctaggtgtccagatttacccactaaaaatacaggctaagtaagtttgaattacaaataaacagccaatacatttttagtcgaagtatgtctccattcatttgcatgggacatactctactaaaacattatttcttgtccgaaatttgcatttgcctgccgtcctgtattttacctggcaaccctgcaccctctccacgcctcaagccagttagcctgggaagaatgctggtgctcattacccccctgccccgtgtgtgtgtgtgtgtgtgtgtgtgtgtgtgtgtgagatggagtttctttcttgttgcccaggctggagtgcaatggcacgatctcgcctcactgcaacctctgcctcccaggttcaagtgattctcctgcctcagcctcctgagtaactgagattacaggcaagcgtcaccacacctggccagtttttgttttattagtagagatggggtttcaccatgttggccaggctggccttgaactcctgacctcaggtgatacacccgccagagcctcccaaagtgctgggattactgttgtgagccactgctccctatccattcccccttcttttaaagcccctcctgggcttttatttgtcctttaaacatttttagcttaaagacaataaagttcttattttgagataattgtatattcacatgcagattcacatagaggtcctctgtacactttacccagtttctcccaacagtaacatcttgcaaaactagagtacaatatcacatccaggatattgacattgatacagtcaagctacaaaacatttccattgccacaagaatccctcccgttgcccttttatagccatagacacttccctcctacccataatccttggaaaccactactctcttctctgtttctataattttatcatttcaagactgttatataaatggaattatatttaagttttcgttattttgggggtaaattcccaagagtgcaattgctaggtctgtagtacttgcatgtttgactttttaagaaattgccagactgttttccacagtggctgtgccattttacattcctaccagcaatgtaggaaagatcacatttctctacgttctcaccagcatttgttctgtcactatttgtttagtttagccaatctgatagttgcattgtgatatctcattgtgcttttaatttgcatttccttaatggctaatgatgttgaacatcttttcatgggcttatttgccagccattcctctttgatgaaatgttccttcataaattttgcccattgtctaattggatcatttgcttttttaccatttagttttgagagttctttatgtattctaagtactagtcctttgttaggtatgtggtcagcaaatatttttcccagtctggagcttgtcattttatcttaagaggagcttttgcagaataaaagtttttaattttgtttaattagatttgtcaatttttcctttatggattatacctttggtgcaaagattttctcctattttttttttcctgaaagttttatagttttattttaggccatggtccattttgagttagtttttatatacaatataagacttaggttgaagttttttgtttttgtttttatttttgcctatgaatgtccagttgatcctgtatcatttgatgaaaaggctatcattcttctattgaattgctttgtttgtttttagagacaagatctagctctgtcgaccaggctggagtgtttgtagcatgatcatagctcactgaagccttgaactcttgggctcaagcaatcctcctgcctcagcaccaacttcccccctaacaaaatagctaggactacaggcataggccaccacatctggctaatttttaaatttttgtggagaaggatctcactatgttgcccatctggtgttgaactcctggcttcaagcaatcttcttgcttcagctttccaaagcactgggattacaggcatgagccacattgtccagcctctccattgaattgtttttgcacctttgttaaatatcagttgagcatatttctgtgggtctgtttctgggttccactgatgtatgtgcctatccctctgccaaatacaatatagtcttgattactatagctatagaataagttttggaattgaataaactgattccttctttattgattgtctttttcaaaattgttgctatctagctctttttgcctttccatatatatcttagaataatcttgtctgtatctaccaaaattcttgctgtaattttgactggaatcatgttaaatgtgtatattgatttggggagaaatgacatctttactgtcttgagtcttctaatccattaacatggtatgtttctccatttatttagacctgtgatttctttcatctttttttttttttttaaagttttcaacatcctaatttggtacaggttttgttagatgtatctaattattttaattttttgagcaattataaatggtattgcatttttaatttcagtgttcatgtgtttattgctagtatatagaaatacagttggtttttgaatgttcatttttgtattgcttgactttgctcaacttagttgtaggaatttttctgtagattctatgggattttcagcatagacaatcatgccatctgtaaattgggacagttttatttatttcttaactatctgtatgccttttatttccttttcttgccttattgccctggctagacctactggcactatgctgagtaacagtagtgtgagagtgggtatgtttgccttatttctgatcttaagggagacaacattcagtcttctacgattaagtaaaataacagctataggttttctttgtagatactccttatcaagttgaggaattctccttctatctaagcattttttgtttgtttgtttgtttgttttttaccatgaatgggtgttggattttgtcaaatgcctgaagtttttgtcttttttttttttttttactgtacctattgtgagaccatgcactttttcttaagtatgttaatatggtggattatattgaccagttttcaaatattgagtaagccttgcatccttgatatatatatatctcatttggtcatggtgtatacttctttttatatattgctaactgctatttgctaatacttcgtcagggatttttgtatctgtgtttatgagggatattggtctgaagttttattcttgtcctgtctttgaccgggttttaatatagggcaatattaatttactgaaataaactgggaagtgccctttcctcttctgttttccaaaagaagttatgtagaattggtgttgattcttctttaaacatttgttagatttatccagtaaaacacctgggtctggggatttctttacagggagttttaaattatgaattccatttccttaatagaataggactattcaaaatatctatttcttattatgtgtattctggtagtttgtattttttgagaaatcagatcatttcatctaatttatcaaatttatgtatgtagagtttttcatagtattattcccttattattcttttgatgtctgtagtgtctgtagtgatatcctcagtttcattcttgatattggtaatctgtgtcttctctctttttttgttagttttcttaaaagaattgtcaattttatcaatcttttaaaacaccacctgtttgtttaattgattttcaattttgttttactgttttctgtttcagggtttctgatcttttccttattattttctgcattctgcttgttctatgtttatcttcatctttttctaggtctttgaggtggaagcttaattaatgatttgagactttttctctttattaagcatttattgctatacatttccctcttagcctttacttagctgtgtcccacgaattttgacatgttgtagtttatttttttgttcagttcagtgtattaaaaaattcccatgagcttcctctttgatccatgattatttagaggtacgtcgtatagtttctattgtttggaggctttcctgcctttctgctattaatttctagtttggttccattgtgataggaaaaaacactatgtatgatttcagttattttaaatatgttgacatttgttttatgacccatgatatggtctgtcttggtatttgttctctacgcatttgaaaaaatgtgcattctgttattgttgggtggagtgttgtataaatgtctattagatcctgttggtcaatgattttgagttcttctgtatcttttctgattttctgcgtagttgtcctatcagtcattgagagaaaggttctgaagtttcctactataattgtggatatgtctatttcttctgtcagctctattagcttttgcttagcatattttgcagctctgttgtttggtgcatacatatttaagattttcttggtagattgacccctttatcattgtttaatgttcttttctttcttgctaattttttgttctgaagccttcattatataatattaatatagcctttttgctttctttcaatgaatgtttgcaagatatatccttttacattcttttactttcaacctgccagtattgttatattttaagtgagttttttgtagacagcacataggtgagtcattttccttccagtctgccaatcttcatcttttaattagtatagttaggttatttatatttaatgttgttaatgatatgtgagagcttcagtctgccattttatattttattttctgtttttcatttgtggtttacttttttcctttctgtgacttacttgaacatttttaagaattttattttggtttatctgtagtgttttcatttcttgatacagctttttatcatgattactgtaggtattatattatatacacataacttatcaaagactactggtgtcataatcttaccagttcaagtgaaatgtagaaaagttacctcccgtaggtccctttactcttccctacttatgactgtcttaactatttcttctgcatatatttagtactacatcagacagtgttaacattttacattagacatcaaacataatttagaaaactcaagaagagaaggggaattagtggtatctacagtaaaatttccttaccatgttctttcttactacctaatgttccaatcatttcctctctgtttagaaaacttcctttaaccattctttttagggtgattctgctggtgacgcattctcttagttttcttttatctgagagtatctcaattttcccttgattcttgaaggtcattttcactggatgtagaagaactctggattgacagttcttttttattcagcagttgaaaaatgctctgccacttccttcttgcctccatggtttctaatgagaaatctgctgtcatttgaattattttttcactgtgtataaggtgtcattttttctccagctgctttcaagattttttcctgtcctggagttttcaggagttggaatatgatttgtcttggtgtggatttccttgtgtttattccttttgagtttcactcagcttctcgaatacatctacatctcttgccaaatttgggaatttttcagccatcactcttttgagtacattttcaatcctgccctcttttttttttatctccttctgggacttgaatcacaaaaatgttatagtcccactggcccctgaaactctgggtgatttttattattctatctcctatttcactgattctttttttctcttctctcttctgctgttaggcctattcattgggttttaagattttctcctttatccatttctaaaatttccatttagtgcctccttgtatctcctatttctttgtcaaaactatctaggtctttgctggacttctttttttttccacttgtttcaaggatgatcataattgtttattgacgtaattctatgatgcctcctttaaactccccattagataattccaacatctctgtcattttgattttggcatatattgattgacttttttgccattgaatttgagatcttgtttcttggtaggatagatgatttttgattgaaatctttatgtattacataatgacactgtggatcttatttaaaccctctgttttagctggcttcctttgaccccactccagtgcagaaggggtgcagatgccatcttgctactgccaggtgtgggtagaattccaggctcgtttcctccctaggtctccactcatacctctctgagcagtcgtggtaggaatgcatcatttctgctctccacatggtctccactataccaggaggatgggttagggcacttgttactgttaggtaggaggggagtccaggctccccatgtggtctctactgacaccatggggaaaggccttgttactgcccagcaagtatgactgtcttggctccctgctagggtttctctgatgccacattaacagggatgggaagagcgggcggtgagtgcctcattatataagccttgccagcacggcagtctcagatctccattcagcctttgctggagtggatggtggtggggtcatagttttcttctgtggggtttgcctggagcagagctgttattgtctaaacgttttctgttttgccaggcaaaaatctttcctggtcctttggctagaaagagtggggtttggttaaggcttaaagcaaaatccttgttggtgtttctgggttgccagttttgtcaggtcctagtctgggatatatgaagcaaaaagaaaacccaggatcctcaccgctttgtcactccttgggtccctggctggtctggcttcttctctctgcctttctgaatcttcttctgtttctttcatatataatgttcagggttttagttgtacttcgacagaggaatagggaatagtacatctgtgggagtgatctggaagcagcacaggcaactgagaacctccataaacattgttttattccacagcaacttctgtgctagcttgtaggactcagggtgtggaaattggagctaagagtttgagggcttgagctcaggcccctcctccttccccctcccctcctcttctgactcgcctgttggtggcagttgtaaatcaagcctagcagtaaacgttgatactaacgatcccttgttcctgtgccagcattgctttttatattcttccctccgatggtccttctcactctggttttatcctcctaggagctgatgaggtagacaggctggggtggggtcccacctgacatatcagatgggtgcactcatagtgtagaccaggagctgggcaaaggtggggcataactggtgcttgggggttgaggggaaaatcactgatccagtgttgaagatatggggtggtagaatgatctccagtcattgatgcctagggctaaaagttgtcatgggagttgggaggggcagacggaaattccactggccatatggtggtcttgtccttcaaaggaggacagctctcgcactaacaccacttctcctgactgggcatcttgagccccctccccgcattcccacaggtggggccttaggaagctgttgtggaattgtagcatttggatggataatggaaaggggtggatgttcctgagatttcgaggcaaataaaaacatgccagattgtttttgaagcatcaaatgcaaattgtcaacatgaacatatttctggacttaacagttgaatgtgtgaattaattatgggcctattaagatacagaatgatccttactttcatatgactaaaacaaccccattatccagccctttcactttgggaagaggattccgtgggctgctcttttaaagctgcaggggctgattgaaatcaagaagctctgtgacacaaacccagcttcttcagttttggtgatctgcccccagaatctggcttaggattagattcccatcaaacatcaacatacacagtaaagaacccatagctttgggaaaaaggtagtcatttctactgataacatgaatccttaaaagatgctgaagttgaggtcctcagtccatgctgggcttagttaatcttcttatgtttatgaactctgaattctgtggcctgttatgcagggctgcagtgagccacaaaaggcacctttcactatgcaaggaccacaaaaaatgctatcctgagtggggttttcatgaagggtttatcataaggcctgcttccttaaaggaaaaacaaaacaacaactcagtagtcacctgtgtgaatgaaggactctgactctctcaactgtcaagatctgttttacaaaaaaaaaaaaaaaaatccaaaacatttaacgtttcaccataaaacattttggggcttctttctgcagcatcaggatcagaatctgggttcagacatctggctctgtctcctgctcctggggcagctcatttctttctcctggtgacctcctctccctgcagacccccacccggtgggctctgctctggttccaatggccttcacacggcttgcatggtccccacttctctgctcggagacttgggaggccttgtttcagagatggcaggagcattactcagtcagttaaaggaacatataagtgaaaagatagttagaatgttcctcgctgtgttctcacccatcccagggcccctgtgatcactgttcaccaaggcacctgtgtcaggacaccttagctggtatgcaccagtaccactgtactgtttgataaaacattcatgtgcttcctaaccacctagcaaatagtttctgccctgagacccctatccacaggttctccctctgggacctgagccccctgggcatccccagcacttgaggggataacccccagtccatcagggctaccacatcaccccctgggataattcaggttggtggggaccctggtgcaccagttgttgaaacattctgcatatcaactttgctggttaccctattttctactctttctgtccctccactcctcagcaagtgttactgaattctaaccatgggcttggcatgacaccatttcctcgctcttaagctggcttctctaggtccagcgtgtgtcttcccagtcacataccctcatgccaggccccttctgctgtcggtgggcattacagatgtttcttcttactgcacaggagagcgtctaagagaggactttattttgctctaactccaaaggatgggactttcccataggaaagtgactcctacatgtccttctgcagctttcactctgtttacagtttgatgacagttgcttgcttcttgttacatcctcagagctgctatgacaatggcgctggctgcaggtgcacgcggctgtgacagcggcccttccctctttctgctcagcccctgttgcattctcattacgaagtcttgatgactttgagctctgtgtttggctagtgtttttctcattcgtcccatcaccaggtagaggttggggaaacacctttcccgggaatctgctccttgtgttttcagtttggaaagttttgtcattagcacatctgctccttgtttcacagtctattggcctctgctgctcagcaagctgcaactgacacttgtcagtcaaccgctgcctgccagtgacaacgggggccttgggaatgactccactcttcagagtggcaatgtcttaataagtgaggcacatgcaggaagccacctcgcccagctcacagtcttccagggctggtgcagggccggggcttcatttattgaaaaatagtattttaattctcccgagggagtgtctgctgtcgctcagaagggggcctgagggtctgttctggggaatggaaggaggtgggatgggcttggttctcttttagaaggctgagttggagttctctctttgtttggagcagtgtctagaaggggcttgctgctctgttgaagccaagaaaaagctggaagcttcacgactaagtggtccattttacttttcaggaagctgaggctttgagagggacagacactttcccgaggttgcacagctggccagaggctgggatggatgcaaacccgcccaagttccatctcattcaataagtatttaatgaacgagagaagagatggaacttgggtgtgaggaggcctggaaatctgggtagccaacaagcatcctccacccccaggatttgtatctccagggaagtctgggaaattctggtcgatactacatctgctggtggtgagacctggagctcggtgggaacctgggagctgggactttgggacccagtggcccagacccagggccgggactatttctagaaccctcaatacccttggcaagaggagaagagtgggctgttatgggcatggaagccaatacattaagccaggcagcatccgaggcaaaagttgaaagtggtaatacatttccccctttcctctggggtgtgatttatttttctttcaactgttcctttgcattctgattctgccctcccaggatctggtgatgtggacagtctgggttctggaggggacagtgtccggctttcatcacaccagtagggacagtggtcgtggcagcccaggaatggggtggatgcagcaggcttcttggtgtttggtggtcagacacaggggcagagcaatgcaaaattctgagccttgaggatgggagaaggatctcaggttgcatgaccagatggccagactggaagttgggacaggggcagagggagcagggattgcactgaccgtgattgtgcatccctcaaaaaagctgagctcttgcacaaacccaggatgccccttttatggatacagaaatagagtgaggtttaggaaccctgctgaggtgatgcaactatttaatattgatggagactagaaacgaggccactagatcactggttctcaaactgcagtgtggcagcgtgttcaaggcaggtgcccgtgggccaactagatggggttgggtgacgccttgctctgttctgtcctttgaagttttcactggaaagctctgtcctggaccactgtgccactaccagggctaggggaggtgtgggtcaggcctgtcctggagggtggctgtggccagtcttcagccctctgtgaccccaatggtgagggcactctctcacaggtggctggtcagatgtgatgaaatgtcagtggccgtgggtgctttgagaggcctgggttgagagacagtggtgaggggcccgggtgcccgccagcggggtgctgatggtgaccctgtttgccgcctgcttgtgcatattatctggcctgctttctgttgctcatccactgccacaaccaggggctgttcttgcagctcagacaccggtatcgtacgagaacacccaagggcctttcgtctcaaatgggttcctgctatcaaaagcttctccctgtatcagggcttggctttggagatttctggcatccttgtgcccttgcctgtccccagggctctccaagccctacccctgctcctggcaagccacaaggggactgcttggaggatgaggaaggagggaggctattttcttacttttggtataaattattcaggcatggctctggtgctctcagacatggaggaaagatcagctgaataatttgtgggacctgatgccaaatgaaaatgtgggctgtatgtcagaaaattattaagaatttctaggccgggcatggtggcttacacccataatcccaggactttgggaggccgaggtgggcggatcacctgagatcaggagttcgagaccagcctggccaacatggtgaaaccgcgtctctactaaaaacacaaaaattagctgggcgtggtggcgggcgcctgtaatcccagctactctggaggctgaggcaggagaatcacttgaacccgggaggcggaggtcgcagcaagctgagatcacaccactgcactccagccggggggacaagagtgagacttcgtctgaagaaaaaaaaaatctagacagtgacagtagggtataaaaccatatgctgggcttttctaaattcaggaacctgtgtgactgcatgtattacacgtccttgaagccagtgctgtgtggaggcaagattctttgagtgacaggaaccccacaggacacaggcctgcaggatatggttgtgcaggttgtctactgcacaactctaggggacaccatttacattgtggtccctggcggccctgccagagatcactgcagcaggccccagatagtgacagtgatccagaactttgggacagagaggctgcttggtgatgggctggtatcctcccatccagacccttttctcgcaccagtgtttcggaacctcctcctcccatcctccctttctccttggcatttcagggacacgtttctctgcgaaaccgaggtgccagggctccacgcgggcgctgctggggaagcttccgctcctcggtgctgatcgcccgccggcagctccgctgttaacctttggggtttgctcacaaaatagaaactctctttgtaggtcagtttgtcagtaattttggcagccgcggggccaccgagggaatgaggcttggttcccacttgtctcttgtgctcggtttggagacttttgcggagcccttccctgggaggaacactcacccctgccggaaacaagagccggttttctctgacctggttttgaatcggcaggagcaattcctgcatgctggaaacgcatggctgctgagaaggaatttggtccacacccagcctgtgccctgggcctgcggctggagcccaggcacttgttttcctgggcagaaggcacttggatggggctgccgggttttacacttctgctcccacattaggctacctggaggaatctgctgaaactgccccccacccgaaactcgctgagtgtgccctggtctatggacaccttcatgacctgccagctgacctggttctgtgcagcccctcctgaccttcacccccaccctcagcctgggctgtcaaggctgtggacatcttctacggtgaaactcttcgagtgcagaaaagatgaggagggcctcctcacaccctgccttccaggggctggcagcaaaactgagggtgtgggcaattaggccatgagcagcttggggaggactggttgtcagaacagccatcagggagtgctgaagaagtcaggaggccttcctggcggaggcagtgatgaactggactctagcccctctctgttatttcggggcttccagggagtcagattcagaacagagcatctctggtccaggacaggaagccggggagcctaggctggcatagctttatggctcagagatgtaatgacacccaaacaataattgagcaccaactgtatgcaagacccagtgctgggaccagagttaagtcagagctggaacaagtctccacagccaaagctgaggtttataggaaagactccagatcacctagagacatgaaggttgtgtgtcaaggagggagaagaggaggactcagggtcttgaggaacaagcccctgcctgaggctgcccatctgtttcctccgccctggctcctgcttcctctaggaagacaggcagggaggatgctctccagctgcggctgtgttcctgagcaccgcctgcaggtcccaaagccaaggggggaccacaggctgactgagcccagagagaagcttgcagctctccctggctcacttgctgtgcagcgcagacccctgtgtcattgacgttgcatgtttacagagagggctgccttttatgtgaacgagccacagcctggactccagcctgtccccaccatgtgccttgtgaccttgaacaagtcactccccttctgggatccacacttcaacaataccagggctgaattggagtaaggagcatttcacaatgttaaccaggttccgttcctgtgggaagtttcagagttttaacacgataataacaacagtaatattgatcccaaatgagtgtatagcacttatatgccaggccctgttctaaacacttaattctcccatcagccccaaagggatacccctattctctccatttgtagatggggaaattgaggaatacagaggtgaagtgacctgcccaaggtgacacagccagcggatgtcagagccaggatgggaacccgcgtggtatggctgtggaacccgtgtgcctcaccaccatgccacattgtccccaatttggagcatctacctagagggagccgggttctctaggagacccttttagtccgtcgtcagcacatgggcccttccgaatccttgaatgccttgtccagtctcagacaaggattttgttccaacctccaaattcccaccaatgtggactcctgtggagttgcagagattaatagtccccattttttcttttttctccttctttataaacatcatatcagagaaattctccgatgatgcatccacccgagaaccccctcagtaaggcagctgagtgttaaggggaaattcgtgaaatgaagtttggaggccgccggccgggccggagcccctcctgagcgacggtgatttatttcggcaatgtggtagtcattagtatctttggtgtcggagccggagcactcactccggcctgggtctgtggccgagggagccttcggggccattacgagctaatggcgcagtgtgggcagaggagggctgcagtcaatcttgccgctggcgggtaataaacgtcggccggctccttcctgctccccacgagagaggggaggccatggcgcatggttccctgctgggcctcatctcccctgctgtgggggcccttcctgtcactttttgccatggaagactgagaccgagaagttgcccagaattgtgtctatctgaccctgagtttagaattgtgaggctggttaggggactcttgtttctgctggcttggctttggggtgtcttcctgcagggctgcacgaattcatcgcatcctgtggggagagctgcccgagtgagggtccttgctgcctccataacttgggaggatctgcccccttttattttatttttttaatttttatttattattttttagggacagagtcttgctctgtcgcccaggctggagtgctgtggcgcgatctcagctcactgcactgagctgagatccacctcctgggttcaagccgctcttctgcctcagcctcctgagtagctgggattacaggcatgcaccaccatgtctggctgatttttgtatttttggtagagacagggtttcaccatgttggccaggctggtctcaaactcctgacctcaagtgcctcagcctcccaaagtgctgggattacaggagtgagccaccacgcccggcctcttgccccttttaattgaggcttaacttacatacagtgaagggctcagatcttatggtattgcgtgatacagttttacaagtgtgtacacctgtgtaaccagcacccacatcaacaaattgagcacttcctcctcaccggtaattttcttcaggcttccttctagctgatacccctgtacccctaccaaaggcaatcactgttctgacgtcttccacggtggatgagttttgcctgtttctgagtgtcatttctgttgaatcgccccatgcatcctgtggtccttgtgtctggcttctttggctctacatttagttggtgagatccatccgtgttgtgtgtgtatcagcagtgtgttcctttgtattgctgtgtgtttgttgcactgtgtgaatatgggaaaatgtgcattttactgttgctgggtgcttgggttgtacctggatttgggctgttattcacagtgctgctaagcccatctgtgttccatgttgtctatgaatcctggctctggggtcttgggatccggctctgccactcacttgctgtgtgaccttctgcaggttccttaacctctctgagtcttggtttatacatttgtgaaatgaggggattaaggaatctatggtcaagtgctcagcacagtcccagggaacactgagggactggagccttttacatcaatgagcttcacttgggcgcagattgttgtatactgattgcagtggggtgagtgtgcagggtaggtttcccttgagttttaagggctgccaagtaacctagcctttttctttggaacatggaaatttgccattgcacaagcctagatgggtctgtgtcttttccctcccttctttcttggtttttaatttacttccaacctgtaagcgatttcaaaggcagacaagcatgttgtgtgcatgtctgtgtgtgtctatgtgtgtgcacacacatgtgtacagttagggagggatttctgctgagcccggggtgcctggtgtgaagtgtggcctccaactcacagttcagaaactggggctttcttcgaaaccatgtagcctttcattccagccaatagtcaccccactttcaggtgttaaagatagtaagttgagcatccagttttgaacctaccaaaatgacattttcatgtggttcagcctaatactttcagaccctttagaagcaaccatttacagtgctgcagtagttataaaccatctgcatccagtcctaacatcacccccgaccacttcagtttttccctggatatttccaaaagcatgtggaagtgaagcagtgagtttcttcagcagacagctcttaccttggactttcaggtgtctctgcacagccaggattgcagggccaggcctgggccttttggcgtgatggcctcccttgctcagtttcctgtacagtggaatgccctacccagttttgtccccagtgcgcgtgctcaccagccagctggggtctgtcagcagcgagggcccacaaatctccaggcagccccctttctcctctacacaggttttcactctggcctgacacctgtttcccttcactgcttctgcccccaggaatgatgctccaagtgccagctctggaatgacaaaaatgataatgatggtaaaaggaataagagccactgtttatgcagtgtgtgctgtggccaggcaccttacgtgcattattgcagttttccctcaaagttttataaagtaggagttattgttcccatgtgacagatgaggaaatggaggcaaggagaggttcagtaacacacctaagctctcacagctagaaagttgcacagcctggaggtatagtcaggctacctaactctaaatgtgtccttctcaccactcctgtcttctttctggctgttttcttcaaatacacacatgtgaggagaagttgaggaacagtttccaggaagcagatactacccagggaaggaggttgtgtgtgattgacaagctctccccatgaggacctgttctgcattgtgggcaggggagagtaagggagggtgggagtcacccaggaggctgccgtagggagggttgagctatgtttgggtttaggagaggatgcggggaaggtagctgtgattaccaaatattccagccctttttgactgaggaatgaacaaggccagggctgtggtcctgccctcttcataatggtatttgtaaagtctgtgttaaatgcagagaaccaatagtaatataatctctgagtattgtgccctcttagagctgtagacttgcagattgttggaatcacagaatcccaaactctgagaactgcagagctctagaatcataatgttgggggcctcccatttacacggtacctaagagaacggcaccgacatgcatggacaccaggcaggcttgcacacggcagactggagcatcctctacagcaggctgtccaaaggaaataggattcgagccacaagtgcaatttcaaattttctactagccacatttaaaaaaaaattaaaaggaaaccggtgaaattaaagagtatactttttgtttaacccaatatatccaaaatattatgatggtaccatataatcaacttaaaaattatgaatgagacttttttaacattcttttatcgtactaaaccttaacaatatggtgtgtattttggactgacagcacgtctcagggtagacccaccccatttcagttgctcagtagtcacatgtggctagtggcaactggagtagataggatagctctaggtaggagaccctcctcccccaggttcccactgggaggtgcattgtgaggcctgggctgtgggctgatcttcccctggccagaggagcaggctcttggggaacattggcagtggcgttactctttttgtggtttggaaacagacactcccaacttggagtgctccagccatcttgccagctgctcctgttcatcacagctgctccagggctgaccttcagagagatctctcgatgcccagagagagctcttaggtggttggatggagcccgaagcccaagccgacccaacagggcagagaggagccacgtggccgaaaccccaggcatccttcttgcttctgccccttgctggaacagaatggctgggctgtgcttcctggcgtgtggccctgccatattccatccctgcctgccaatccctagggggtgaagaggtgggagtggggaagcacacagccctgtgcctgacatccccctcctctgcacagcatgcaaggccaccttcccgggctgatgctgtgaaagcgattctctgtctctctcctgcagccacggggagataaaagccagggctgtggggatggtagagagggagccaaattatatttataatattaaagtgagtgcatttgtggcttgctgttctccagggtttttcataagtagaaaaacacaaattagcattttccatttccatatattgactagaaaaatcgcctgctctcaattaagacctatagcttttgggatgtatgcaacaattttataaaatatttacagcaagatttgcattttacatggtgttacagtttttcttgtgtttaggagtaagggctgaggccttcgagaggaaatacattctctggaatcgagggggaaggaagctgcgggctgttgtttttcttgccttctctatctactccggctgtccagggctgacgttgtctctggtaattacctaaggctgatccacccctgagctatttgttagtctgttttcaaagcccgtgctcctttgacaaatctattactttccctttaaaacttgccggaatggagctgtttgcggctttgtgcgagatgaagaagaacatttttttttcccaatgtaaaagcatgccgtaaagaacatagctatttcctggataatttgcagttgtatattttatgttaatttcaccgaaaatactgcacccctgccaggtttagtagtggctcactgtgatatgaataatttctagtgaatcatttttttttcttcatttaagatttggcacctttttaagattttaataatagcaacaaggaggaagatttagaacaagtgaaacattagtgccaaagaaattcacgttgagcgctaatgtaaaatagcaagaataattacatggaaagcagtttccacagatgtttttccttgtaatgtaataactatttactaaactgtttattttaggcctttggtttataataaaatatttatacattctctgctgtaataaaaaaatattgacaaaatactatagaggtttaaaaagacaattgatatttttattttccaggaagcgagcatggtttaaaagtttggtgctattttggtggatgtttcaagattagtgaatctgggtttggtttttgagttcatttcttagtttactgtttcagaactaactgcacagaaaaattttgttagcctatcattggatgcaggtactggtgggcactttattttttaaaatagaattcttacctgtgaatccctccagttgagtgctaaatatgagttgcagatctctccctattaatcagtcaggctaagctggtctgtggctgggaaggcaggaagatgctagtgagtgcgcctgggaatttaagttcaggcaggatcaggggctgtttggagggcagtttagccctggggtttctggaaagatttgaccttgattttcagcctctgtctgtagccactgaagtatgtccagggacaatgtcccagtgtgggtttaccacatgtgagctccatctggagctgggagtggcagggaaaccctaacttcttgagcccctcttttgtactgtcctcattggggaggaaaaccaacaggaggggacacaagagagacccccccacccccacctcagcagcactccctgccctcccgcctttagctgtgacgcagatcgtgctgttggggtcacccgggtgttcagggtgaaaatggccaaggtggtggggtggagaggaatttaaggaccaaaacaagaaagaggatgccaaggagttctgaaagagcctggctgggccttgtctgtgttttgggagcaactgaccaaggtccagttttgtaagaaccagcctccttccgccctcttgctctcccaagacatctgcgttgacagccctgtgtgtgcctgtcgtagctcctgagggtatgtctgtgagcctgagtggtggcctctgtgtatcatgttgttcttgctgctgttggccgtgtgtgctctaatttgtgttatatttgcgcctgtccatctgcatccccgtgagtttgtttcgagtcttctgtttatgggtttagatgtctttgtgcctgtgggtgtttttttgggctaacacattggatgcttctttctgtgctttgtgtttgtctttgagtgtgtttgtggtcttatgtgtttaatgctttgtatttggatctgtgggtttatctgtgtttttgtgtctatcttggagtgtatgtctctatattcctgtctgtgtgttgtgtgtatgttgggtgtgacagtgaacccctcttctgtatgcctgtgtttttctgtttgtgtcagtatgcacttgtgtgtgtgtgtctgtgtgagagaggtaagcattccctctgttgagagaggcctgggggcttcccagcttggaggcagctggctgtgttaccgcaagggtgtggccatctctttccaccaaactttctgatggaaggagaggagagaggaggcagggaagagattccagaggggccagaggggatggcgcatgggagggaagtgtggaatttttaataaagagagagacaactgaaccagggtctaacaccctgcacaatctggaagggaacatttactgctctgggttcttaatccagatatgtccccacttctgtttaccccccagctgaaaggcaggcagctggggggctgaggggaggggatggttctcaaggactcgctttgcactgctagtttttgagttctatcctgacttggtccatccccagtaatctaggacaacatttcctcctgttctcctgcaggggacaggaagctgcctctggggaacctgcgggttccatggggggccaggaggagcctcttacagatagagatttctgctgccttctgagcccctggcagagttcttggtcttctcttcagtagtgtgttgcctccgcggccccctctccccaaccttgtgctttcctaaataagctttactcactttgcaaaggaagtggatttcttccaggtcccacaccagcggtgctggtcttgggggcttctcggagatctaaggccattctcccttctctgtgagcaggcttggggcttgggtgtttcatgtatacagatggagaaacaaaggcacggagggcatatggcttggttgcaggcagagagtcagggtagagtttggaagttgacctgtgggaggtgctacaatcccaccagaaagagatctctgcaaaccctgtccgccagacttcagagagggttctggcgggagaggcaggggtgagacctctaagggacaagagtgaggtctgtgaatggcagagaaatttttttttttttgagacaaggtcttactctgtcacccagactggagtgcagtggcatgatcatagctcactgcagccttgacctcccaggctccagcaatccttccacctcagcctcctgagtagctgggaccacaggcacgtgccaccacccctggctaatttttaaattttttttgtagagacaggatcttgctatgttgcccaggctggtcttgaactcttggcttcttgtgatcctcccaaagcactgagattacaggcatgagccaccacgcagagcccagaggtttggctctttggggtggggatgagtttggggtcagagctggattgctgtggatagcagtcaccaccaggggtcccccttctcttcactcccccatacaacctttcctccaaatccatcttgatcaggtatttgaaggattttggtttggggagggtgagctgatgactgcacctggatgactgacccttctccagacccacaaccgcacgaaagctgtctctccacaccttgctaacatatcttcttccctgtttatggatggcagtgagaagttgagcctgtgaatctgggcatcgcagagtgaagactgatctgttagaaatggatctaaaatgagcaaggagcatgtggggaggggaggcgaggggatagccctcaggtccgccggttctggcagaggtgggggcatcacacacctttgctgagtgggtttgagtttcctgcctgctttgtcttttgtgtaactattctctggttgcacgtggctgactcccggctggtgtgggtgacgaggataggctttacagcgatgccctggcacacagagctgtcttattcacgttttggttcatggcttatggcccaggccagggaaaaagaattcactcctgcaagtgacttctgcaaaagaattctgtcactgtgttttaggggagcctgcattaagaagactctggggtcgaataggtcccaaactgcattttatgctttatttgttgagtagatgatgatgtggtggttgttatcaattttcctaattggctgtgttccttataatttcagctgaactgcccctcctgtttttaaaaaagctgtgttttaaaaaactcaaataatacactttccttacaagaaaaaaaatgctgataaacagaagaaagagatagaaatcacccttaatctcacctcccagggaaaactgctgttaacaatttgatgtttacctttcccaattctgtgtgttcacacatgcatagatacagttttaaaaagcattttgttgtagtttgatatttatacagaaaagtagacatatcaataaatagaaattaaaagcaactgcaaaaacctcaattacttttacaccaacctaatgtaataaccctttattgatgcattacatacagaaaagcttacttgtcataagcagcagatagcttgctgaattttcccagaccaaacccaggtaagcactacatcatgacacagtgtgacccacaccccagaagttcacctcctgcaccttcctgtcccagcccccagaggaccacaaccctgacttctaacagcaaagacagtggtgcctgtttttttttcctgtgtagaaatggaatcactgcctactcttttgcatactcatgtttggtttccagcagagttttaatgtctgtactgtttttgcacacttgtgtttggtttccaatgcagttttaatgcccatactgtttagtttccagtggagttataatgcacagacttttgcacacttgtgtttggtttccagtgcagttataatgcccatactatttttacacatttgtgtttagtttgcagtggacttacaatgtccatactatttttgcacacttggcttggcttccagtggagttataatgccctatttttgcacacttgtgtttagttgcagtggacttataatgcccatactattttagcatacttggtttggtttccagtggagttataaatggccatactgtttttgcatatttatgtttagttttcagtagacttacaatgcccatactatttttgcacacttggcttggtttccagtggggttataatgcctatactattttgcacacttatgtttagtttgtggtggacttataatacccatactgtttttgcacacttgtttgcttcccagtggagtcataatgcccatactatttttgtacacttggcttggtttccagtggagttacaatgctcatcctatttttgcacacttgtgtttagtttgcagtggacttatactgtccgtactattttagcacacttggtttggtttccagtggagttacaatgcccatattattttgtaatcatttccccccaacagtaggcagtgacagttttctgtgtcagcacacatgtctctacatcatcatttttagtggctgcttggtgttccattataagaagtgccacagtttaaatttcccgttggagcttttagtagtgtcactattagaaacaactctctattgaacatcatcctaaccaaatgggtgactttcccctccttctctggagacagagtggccagagtggtggtgggggaaaggccctcaccgggccggctggagcccaggttgtggtgtgaggatgctggcatcgcttcagtttgccagctggacctcatcaagtgcgggtgttaattactgggaggcccctggttctgtgagcaggcgggggacgctggggctaactcatgaaacagggtcaccttgaaacagacgcttccaggggaagagaaatcgaggagaagaccaaggggaagcacagggctgggggaacggcttcccaccagccttggctaagtcaccctggtgccctggagctcctgtatgggatgtgcagaggctctccctggccctgggtgataatgagtgtgtgtctttatccctgcttttaattggggtgagctgggagcaagaatgcccgtatctgtggctttctcttttccagaagacccttgccccccgaagcagccgtgatgcctgcatgtcttgaaaacgtggccggtgtgagtgctgtggcttgggtgtgagccggggctgggaatgggggactgcccggcagtgccaaacgggagtccagctgtgcagcatgcccgggtcaggaggtgctgcccgcagccccagccaggtacgcttagggctgcaggcgcagcagggccaggttggaggagaattaggttattgcatttcttctgtaattcttcatcagggctgctgcctggatctgctgcgggaaaatcaatgtgttctgactccataatttcccaggttgccttactccaagtaccttgcgcagggaaaggtgacatctctggtcacgtctgtatggaccaaatatatatatatatatatatattcgccacttcccctttaccccatcccatctccacctcccagcacaagactcaagactcgttggaatttcacaacctttgcatgcttttgtgaaaacactcatttgtgtttgcgccaggccgctaatggcggacgccaaggtctgcggagcctacctctgttcagctctcgttatggcgaggaatgtgccgttaataatgcatctatggaactcagctgtgtgggagccaagtaattatcccactgtagcgttcccggcttcagtgtcatcacaactggggcttcattaaaagtcctaacagagacgatgttgtgtgctgcagcctgtatatatattttttcatttaaattatcagccttgctatggctcagaggtaatttgactttttgaaaccgctgagcccctgtgaattcccctccccttctccctctcgctgctccaccagctgatcagccccagaagaacaaaaggtttatctgaagctatgaagcatatattcaccagcttctggcgtctagataaaaaaaaaaatcaaagtactccattgaacatgttaatactgagcaaaatgcacacagctagacactaaacctttacagggatttgggcatttgaaaagtgatacccagatcaggtcttgagctacgtttcttcgcccagagtagagcgagtagcagaggaggaagaaatcatgtttataaactaatattaaagacagcagatggatggctcaagagttcctaccttttgtcttatctctttgtctgattttggttgggtaggcagtgggaaagcttggacaagggcacatcctagagagctgggttttcccctttgtgatggactttgacctactgagactggaatgtggagtgggaagaggggtttcagtgactcttgggggaaatgccaagaatggggatggtggctgttgtctttgtttctcctgattttctgtggccccttcagttgttgacagaggagggctgctggggaggacctcagagaggggctgcatccaagcacattgctgctgtgagcagtagcttcttggggcctccttgaagtcatgcacttcacagctccttccagttctgttggagagcagctgtccgataaaactggcagaagtgatcaagttgcatgcatgaatcattcatcatgagatagcagataggtgcttgtttggccatgtctgccactggtggcgtagtggtagcaggcagcactttcccactattttcctatcaaatattcttgcttggctttggattgaggtagatattttaaaagatataggatttgttgctgccctctagaagctttcaacatatttgggaggcagacatagctaccgtaaaacatctcatgttataaacagtttaggattaaatgctagagtctgagtttttgatgggaaagagaatgtagaggatggaatagtcagaaaaggtttagaaggatgtagcctgtttgggtactgatgagaccagcttgggtggaatttaacctgctcatgaagccaagaaagtgcagcataatttgcaacagctcatacccagatggagtgaaagggagaagaatccagttttcacttgtgggcctcatgggacctggtgagagctctgtcctttggggatggggcttagcctcagcgtatgtaaggtcgggagccagctgccacccctctggacagacgcccccagtgtgccctgggaggaagatgttcatctcatgcactgagtacaaacacatggatgcccatggtcttctggtttctggccctgttggttcaggagttgacccccagtacaacttactgaggcagcctactgcagcagggaagattcacagggtctcagactctccaccctaggcttggaatagttttcctctcatgccatctggtctgtttctgccagctccatgccaggctttttgctgtttgctggggaccctgagctaaggcaaacacagctcctatcctagaggaatatccaatctgatgggagaggtagacacatagatgtgcaaattcctaagtagtatgaatgggttaggaagtgattgcctgtcctggttatgtgtgcgtgggaatagatatgtgaagatagggggtggtcagtggaagtttgaaagaggagaggcatttgagttgggtctctaaagtgatgaataagagttcaccagaagaaacagtgaaagataattcttaggtgataagtacagcaaaagttagaggcattgcaaagagcatgatgctctttgaaattctttttgctagagtcaccggtgactcctgattgtagaagttgatgacttttatagtctttccaggccattagaccctgttgactactccttagacactcttgtcctcaggcatgtctgaaaaccctcatcaatggtgtccagccctaacttccttctctctcctgttccaccccaacagccagctgcctgaaactgtcttcaccctctcccacaccagtgtcaaagccccttgtctcagtgcttctgactcagcagcagctcctagatcagctccttccacctgtccccacaacccctacccacatgtttgttggacccccgatgttcatagcctcactcttcccacctgccaagccccagctctgatccaggtctgtggcacctcaggttattttgccaaagaggcttcatctggatgcctcgaacattcgccaaatgcagggtcagtggcacttcattctttttgcttttgtttgtctaaagcacagggaccgtttccaaggcctgtctgtcattgtcaggggctcaggagctctgcagagggagagagattcagacctaaaggaacgcatgggaaactggatattgaccctcaagacgttacacaccctgggacttggcctcccaaactgaaagcctccacccatttctgggaaaatcggtctttccctctctttgtgacagcgagtttgtgcttgtgtaaaccgttgtggaatcattttggctgttaagtcttcacaggggctacttgtccctcatcaaaaccaacgagacattgtgcctggtgaagttacacccaccaggaatgaggttgcccctcctccaaggcagctggggctggggtttcagaaaacaaagtgccttggtgctgtcctcaccattaaggattccgaggtgaacaagaaaaatcagccaggctcatgttggcatccggggactggctcggaggtcccagctcccggttctccctggttcggagttggaaagaaagaggcggaagaagtgtttgaatactgtgctgtgaagggaacagtcctgcagcgaggcagttgtgatattagagcagacctcctaagagatcccctggctctgagctgtgatccacacgccacattcgcagacagctggtcgcccagcgtgggctgcgcctgccgctcggagctggcacactggcggggaccaggtaatgctctaatttccctcgtgcagatgcggccaggaatatcttaatttattggtgtgctggcatgcaagagggaatgctgccggtgcagccttgcataactattagcaaaaaatggagctgataggggcttgactcttcctaaagtggctttgaaataatcatcgccttttgttgtgtttggaagggcttgaacaattcttaattatttaattatagatatgcaagtaatacactgggaatggcccagtcattccagggatactgagcagaggaaaatgtttagttacaggaggaaaaaaaaaaaggtggtaattaaatcgaagtgtcgtttgtatcacgccacgctactctgtcagcgacgcaggcgggaagaggtctgctgggcctcacctcggaaattcttatgtaataataagaacatcaacagcatcaccaccttcttccaggtgaggccaggagagttagcagtgctctttcgttgctgtttggttgtgttgtgccaggttagcgttctgggaggcagatgctattgttcccattttacagatgaggaaatggagcccactgtctcattttactcagggcttgaaatcacagttgtatatttcagacgtcacggtggcctgctttcccaccctgtccagtgacagggctgagcctcctctggatcacaattccttttccgtctcctaacagcctaggccagccttgagaactttggtgactgtttgcctgaattgtgcgtctgactccatggcttgcctctcatgacggacaccttgtaattatcccttataagcactcattgtattcatatcattaattttgtttgggctgttacatttgatagatacattaagcattatatagttctctttatacatgaaattgaactgcctttgaacagtcagccggctaattgccggtaatttgtgttgctaacgagaggcagaatagtggtataacattagactcaacagtcagttaacaaatttgccgattcagattgcaaagcctgctctctgtagcacaggcagtatgcatctcacacatgaacaaatttttcaaaatgcatgcaactaaaaaatacctcccaaactctcatccccccatcgaggcctgtgtaacaatggctggctgtacagcggctatgggtgtgggggtggggggtctgaccctccattggtagctgtgggacttgaggggaccttgggagtgggagggaaggtgtgggctgctcctcagggggctgagaggccgagtcagtgcctgcctcctgagcgctttctcacccacacctgatctgtgttctgggggcagccacggctctttattatcataattttccttctgcaaggtcttccaatccatcaggtcttgctaccctgagggggtcttgggggaagagattggatgaagttaccttcaagtccctgttgccacagcctaaaggtaatttagaaagagggtggctggggagaaacagtcagggtcattgcccctgaaagttcatgagcacttctgacccttctgccttgagaaagccatggcagtgcttagaggagcctggtgcacttagctaatgaagtgagtgccggggaggaggctctggatctgacacagacaagacagctgaggctccttccttccggaataacagagacccaagaagacactgttctgggctgaattatgttcccggtgcattctacatattgaagcaatatgtagcaatattgaacaataaattacatattgttacataggtaatttaatcaaaatgaggccctcagttgggccctaatacaatctcactggtgtcctcataagaagaggaaaattggacagagagacatcagggatgcatgtgctcagaggacagatcatgggaggacacagcgagggggtggccacctacaagccaagcagggaggccccagaggaagctagctctgttgacactgccaccttgatcttggacttccagcctccagaactgtgagaagataaatttctgttgcttaggtcacctagtcttcatgtggttcttcattatggcagccccagcgtatgagtacagacaattcctatagctctaggaggctcggggaggctgtggtatgggctgttggaaaagtcccagaaaaccaaagttcagcagcccccttaaagcttgaaaaacacagtttttggacaaagtacaggatgccctaagcgtaggcagtagatagcagccactccaattcattccacaatagaggcccagctcctaaaagggattagatagacgttctttcgtatatccagttagctactaagggacacgatgggggctgtgggagggatcttctttgtcatttgaaatgggctccacagaggcctcttacacccttgcaccaaccagctataactctcattttcatgggaagtgtgggagaggtttgcattcctgcatcttccttctctaagcacatgggtgttggtgcctacaaaccaatatttacaaaagggactttttaagcttggaagacaatgctttgtggttatcagagcttattctagcatcttctaggcctggctggtatctgctcagtgaacaagctgggtctgtgactgacacattcctgagcaccccaggctccaacttcctcctgcccctagctccagtccataatttaaaagaatttagctttcttataacttagcaaagtagcagaaaacatttggattcccaactttggacagatagttgatatttgcaaggttgtggtacttggttataggaccactagcctaaacctgatcaatatattttattgattgttcattagcactatgtcacacttgctaggcacttgccattattggatatagatttggtacagtatccaccctttctccctgggtaatggtcattgagcttgacgacatataagtgtgtgtatatatgtatttatgtatgtgtatatatatatgtgtgtgtgaatatatatgaaatatgcatagtcattagtacttctgtagatggttaatgcatctgtaaagaaaattatgtcattagaataaaattgataggcttaatatttttgcgcacatgtatttgttctcaaatcatttagaatccatagacatttcttatagaatgggaatgatgctgccatcatgactttttttccccacttatggtgtgattagcatcatcacaagatgcttttctaatgtcaaatggcagctttatctggaaaacccaaatgtcagtgtcctgccagcatccctggtcatactgttcttgctattctttcatccaaggataggaacatacaggaaatgaaaaaacccaccattgcaagttggccaaaatgcctcaaacacatgaccatttgttcccatcagtccaggaaggttcctaggtcctaaccctttgctagtgtccaaaattgcggtccataggtggcctctgaggtctcatcgtggttcttcttggctggcctttccttctgtttaccagccaggcaggaacagaaaggggaaggcagagcccaattttgagtaggtcgctaagagaatttcatcttcagaggggttccatacatacaataaattaacagttgtgatgtcagcaagatattcacatatggatagggagtatgggtcatttagaaagttgtgtgataaaactgatctttggtgatagtggtttatcctgtgatagcattcattccagtgagttaaatgtagaaattcaaaatggtgctaataagtgtttttttcatcaacataggttgattttattgttttttcatccaaaagtaatgcatatttgtggaaaaacattttaatacatagaagaatataaattcttccttctctaacccctcttgactcctccctcagtttccactgcctggaagccacctaccactcttattgatgtttatgtgcctccaagaatttcctatgcccatttccatgtattattcagatgggatcaattacattggttattctgcaccttgcttccttcgcttttaggtttgcactgtggacttctttctatttcaacccatttggttctgcttcattaaaaaatagagtatgcatagtgttttattttatggctgcaccgtaacttatttaatcacacctttctggatgaagtaaaagcatttgcagaatgcaatgggagcacagatacaactcggatgctggggagggcttcagagaagaggtgacattttataacaggttttgaagagtggcttggagtttgtaagtttgatcaatgtctgcaatatggaaggaagccatgggggatgagaagaggaataggagactcaatggattcaggaagggaacagagtaggatctcatgcaccttcctgcctggaaggggcttcccctgggaggaagttctgcagttggagaatgggacagtttcttgcatccccagcttgcgtgtaggcgtcaggtgggctcaggagactatgtgagcgtggtgagttgcatgggtgtgcagacagagtaggtgcaactaaccagatatttgagccaagtttcccagcgtggcaaccaaaataaagagagcgagagagaaggaaaaaactcactcagcttgctgataaccctggttattgcttgggaaatgttgcacagaactgacgcctggtgacatgtcagctcctgacagaaacccgggttggcaggtcccgttttttaagctgagtgcctgtctgccagatcgcatttggattgagtggctggcattcctcgagccttgcttaataggattgaaagaaaagaaatgttacttttcatcacccaagacaacaaagagaaacggggaaacgaaaatattatttcgtttgaacaaattacagggagactctctggggcactttcagggagttagatgaggaaaagcacttaaatatcattccatcaagctaaatttttaactacaattttttacagataaaatgtgttgggaggattcaaagaagattagagctcacctaagaaacagtattcaaattttaccagctaatggaggcctagcaaaaactgttaatgcctataactttcctccaagggacagagatttcagtattcttataaaaacacattgagctgatttcatttcggtgtctctgcagacttcattcgtgtaatttcagtaagtgttataaatgttattttaagtattataatgataatccctactgacgatggggctgcgcatctcagcttccattactaaggtaatgtttacctcggatagcacataattgtttgctttttttcacagtaaactctccgctcccaattgcttaatcagccatggaaaagagaggagactttagaaatgtttaatgttcttctgattacattagagtaatgagtaagcccacatcagtggggctggaggaacataccgcctctcttccccccttgtttattttttggggagcgggtggtgagtatgtgtttgtttttgtccacggttcttaaggaggactgaggtgggctgtggcaatctcgtgaatcatttattgttataaatatcacggctggagcgtacatctactcagcccgtgaactctcagggccctttttctgtgcatgtggtgggcctggctgggcctcgggctgtcctcctggtgggtcctgtgaactctggtattctggtcacagtccacgtttctatgctctcacgatccacagagcaccctgtaggctctctgaatgcgttctccgctgcctgctcgttggaagcaagattttattaggctttatgaaagtgaaacttttctaccctcgaatgtggaatctctggggccttctcggggcattgtataacatttgcttctctggcttcttaaatatctgaatccaaatgtgatcaggaattaagaaggaacaaggaagattgatatgcatcacaggttggaagaatatttgtttctacgggtcttgagtgttcaaagctctcctttcttcatcccttggcaatggggaagttctgctttgagctaactggaaggcctgtgttctttaattcattcaacaaacatttgagagactgctctgcttcaggcgctttgctgggctctggggaatgaatacatgtattttccacacctctgtgtagtttactgtgttgatgggaaagccaggaataaacaggcaaacaagtaaatacataattacaaactaagagacgtgttattggtgcagggatagggaaaattgggaggatgttggtcaagctgaggtttaaaggatgagagggagccagctgggtgtggggctagagtgtggggagtgaccgggacagtggctcccatgacgtgagagaggccagcagagcccaggagatattgggccttccaggatgtggccaagaactgggattttattctctgcaataggaaattattgcaggactataagctgtgagtgacattttcctattttaagtttgtataaagattgctatggcctctgggtggagatgggaacatccaagagcaagggtggaagctcagggtcccgtgggtggccactgctgctgctgtactggctggagatgacagtccatggtggtggcagtggctggggaggctgcgtcaaggtataatttgaaaggtaggtggacaaactcactggtaaactgcatgtgaggcaggaaggtgtgttggtctggatgactctgggccactgaatttcttcagctgaccctctgccagccctccctgtgccctcccatgggagaggtcatctcgcaggactgactacctggggtgtcttcttctttccccaaagactgtttggaaccctttatggtggtccttgagaaaggatggagcaggggctggctggattccctgcctccccagcccctcatgaattatgttactcctacgcaagcctcagtttccccagcttttcctgagaagtggatgccagcacgctcagcttgcctggaccctcccttctgtctccccacaagcccaacaacagcccttcctccagccaccactcccaagctccccacggtctgtaatataatttagcttaagcctttagttaaagaccagggccagtaggtagctgattttcccagtcctcagggtggacgcttgacaggtttctgtgctgggactaaggagcggagggaagggaagtggagtgactgataattaaaggatcctgagggccctagtgtggtccagttggcccaagaggggtcctgccccatggagatctggtcagtgggcatgtgtgcacctgaccttctggagggtaggcagctaccaccaggggctggggtggggcagcagtgggtgggggtgggggggcagggagtaattgcttggacagaatattcccagtgcccagcttcgagttgaattaacttccaagaaaatatctaatatccctcccctttcccttggagaagcaacaactagttgaatccatccatctgtgtctctcccaccctctgcatcctggggaacatggaggaatctaaaaaagaatttgccaaaatcaaggtggagcatgaacctcccaggtatgcttgggagcagaggaagcggggaaaataatgtttttgtttccctgaaacacacacaccctctcagtcccaaccaaaaccagatgaatattttaacactagcgcattttgttcaagccaggagtacactgcattcctggcaaggccagagaatgacctgaaaacctgaatatttcagggaacaaaaggtccttgggtctacctccgtccagggttatttgatgactggtttggaggggtttcgggagtgtgggaggaagtgggcagggtttctgctggtccccctcccttccaggctgcctactgtgggagcccatgccctgctccgtggcaccaggcagccgtgtggagccacaaggtcccagctcccagccatgcaccaggcagaaaggaagaggtgggagagagaaggagagggcgagaggcgagggggctgggaaatagagaaacaaactctgttttctgctcatctgtggcgggaggctcccgcggcccacaagctctcggagtgaagcaatttcagacagggatgagtgtctgtttttccctggagcagaggctaaaaaaccccaaagccctcggtttctcttcccttaatatcctgttttagaaagtgcagttgtgagaaggtgaaggaaatgaagaagacccttagcaaatggaagcagtccttcccccgctggagccagggggctgggatgccttgttccagctgctatggataggctggacagaggccacctctgggattgggagagggagcttgttgctgaagggggtccctggcaggtggccatttgcagacaaggattcagattcccgtcctgtcttgggggatgtttactgggactggtgccatttgtgtggcttcaaaagccttggacaatggcatgcccagctccctgcccagagaaatgaggatcttggaatactgtggctctaggctctgttgatcctgcctttcttccaaatgcaggtgctggacattcaccccctgccgccttcttccacctgcccacagtgtgtgcctgccatgtgtctaggtcaagcaggcactggcctttactgcaatgtgagtgcagagtttcagaggcagcctggtccagggtggctgggagccgggtctctatcgctggcaaataggaactacagaggctgttatgtcctggagaggcctcttgcacctgcatggtggaaggaggacagaagctgcttctacagtggaggtctccctcttgtgccatcagtggggcgtggggaaatccttctctccatgagtgaggagggtcggcactgcctgtggctgccaacaaggtttcctgcaggccttaagtcacctcctggccttgctctcctcctgcacttacctgctgcaagttgagcggctgctggactgcctgccttaccttccaagtcttgcaccacatttcccttctcttttgaccctgcttggagggatgtcccagccctccttttctctgtttgtggagatgctggctcctggctggtcgctgggccttgctggacatggggccctggcgtctgtctgggtgtgagcctcagttctgcactctgctctctgggcaactaggcaagtcatgtaacctcactgtgcctgctttctcctcagtaaaacggtgatgataacggtaccctctccttatgtgctagtgagaattacataagctaagtatgtagagtgcatagatcagtgttgacatggagtagcaatgagtacataaatgtttgacattattatggctgtggtggttgatttcttttcctacaactctttcccattcttggagacttggctcacagcaccgctcctgcagggaccccacccccccacgccagctggcctgaccccaggtcttccattgtctgccctgggtggttggacacccaaccttactgcctcattgtctgcccgggttgtctttaatgttgtcacatccatttggcacatctcagttatttccagattcttttgagaacagggacttgcctgtcttctcatctgtgccctctgtttctggcccccaaattctggatttggtaaatgtttagtaatcacttgcttcattgaatagtattaaactacatttttaaaaaggtaaaggcctttcacttcaaagactacatataataaagaatatatgcgcatctattccttatcatacagtatctgctctgggctagaccctgggaatcacacccagtgccaatggaaaaaattcagctcagagaagaaaactaatttgcccaaggtcacagcaactggaaagtcaaaggtaggacttgaattcagggctctgaactctactggggcagactgtgtgggcagcagagagttgggctctgggggttttccaacaggaccagttttctgatgggtaggggccaatttgctaagggttggccttgagctacggactgcagtggcctgagtctacaagtctgtgaaagagtgcctgcctccaggtagtgtccacgagtggcatggtggcctccgtttttattggtagtgaatgtagttgcattggggctaacactcaatagacttgactctgtcaaggttcagggcacctggcagtgcccagcccagctactgctcttgcctgcacccctgcctctgcccctgcccccaccacgagttcacctggcaccatgagctcccttggacagcagctggccaggcaccccagtcagctgcctgagcacagggaccacagccacggttgctgttcccagtgttcccagtgtctatcttggtatacagtaagtggtcaatgcgggcagcaggaaatatgatgagggccaaagggatttgtctggttctggcaatttcctccagagagcaaaggaaacttctggttccatgtctgggtatggagtttgagaaacgggatgaacagggtaagatgagaacactgacctttgaaatagccctgcccctctgtctctcccaggagtcaggagcactatctggggtgatcaggagagagccaggggagaaaaaggaccccaccctaagacagagtttggcctttgcttctcccagcctgcactcagtctctgatctaaccaccctggagggcagcccgtgcctccttcaggctcctccaagtgtgggccagtgacctacaccatctgcagtgtctcagagtgtgcgagaagtaccaaaggccaggcctcacctggtcctgccaaacaagaatccgtgtttttaaaagagctccaggtgatttgcatgctcagtcaagtttgagaagggctggcttggaagtcgggacacccagggcaaatgctgccggaggtagcacggtgccctccagcctggcctctgtcgaagccccacccactgctagccatacagcttggggatgtggcctgtcctggtttcatttcctcctaggcacagtcgggcctatctccctgtgctgctgaacgaggactggggcagccactcctaacacatgctctgcacttagctcacagcccgggtgttgtgaatgctggccggatgtgatgttagaggcctgaagaacctagagagtgaaggggctgcggcaagtaggaggggaaactgctgatctgagaagctagttttgcgttgggcttgtttagtggagcttaaattaggagctaaatacccgccaggactccccgtggaattattacatgaaatggcagggagacggggagccagagttaatgctggtgatagcagttttttttaaatctaaaaaaaatgtgttgaaagcaagtgaaacccctggtgatcgcaaatgaattgcctaagttctcttagcatatccactttcctgagtgatgcctgggttcgcgtgaatgagccactttcttctcattacgaaggtgcagtgtggctcctgcaatgactcctggttccggctggcagtctggtatgggcccgacccctcgatccgcctgtggaagctgcatccttggtggtggcaggaggggctccatgggcagggccgggcatctgggccttctagcagtttaaatgcctccgattagcaagtcgggtgggaagaggtgctaaaaagaatccttcccacctcctccgctggcatgttttgaagggagttcagttatgagactattaaaatgttattttgataattaagcccacagctgttctgagggcagcaggggcaggcagcacacaggcagcagaaggcctggtgctctcccaggctccaggagagagggaaagcaggagggagcagggcagggcgaggtgggatgcacgacctggagtgcagctggctgtaggcggagagtgcccctgtcattgggttcaaggatgcctttgaatgacaggaggcaacagtggctccagcaggcttccagtcttaggtatggcaagctgtcccccacatggggatacctactaggtttcaccaagactctcagagcaggggtcactagatcagtggttctccaagtagagtccaaggaccagcagcatcagcatcagcagcagcatcacctgagagcttgctagaaatgcaaattcccagccccacatacaactgctgaatcagaaactctgggtgaggactggcaatcagtgttttgtctttttagagacaggatcttgctctgtcactggagtgctgtggtgctatcatagctcactgcagcctcaaactcctggctcaagtgatcctcgtgcctcagcttcctgattagctgggaccacaggcatgtaccaccatgcatggctaatttttaaaattttgtgtagacagcgggtcccactatgtggcccaggctggtcttgaactcctgacctcaagcagtcctcccgcctcagcctcccaaagagctgggattacaggtgtgaaccattgcacccagcctgtaatctttgttttaaaagactctccagctgattctgattcactaaagtttgagaaccactttccttaaagatcacctggcaaatggggctcagccgtgcagtgattccttagagattggtacggcttgctgtgaggtatggatgaaggcgtggggatgatcagcaggctcaccacatgtacgcatccctgatctagtcctattccttcattgaactggatagcaaagagaagcccagagaggggaaggggcttgtctaaggtcattcagcacatcagagcaaaactggaattggtaatcagctgggtctcttgattccagatctttctgttggactatctttctgaatgcagaggatggatgcaatggtttgaatgtgtcccccaaatttcatgtgttggagatttaatcccaaaatccgtatgttgagtcatttggaggtggggcctttgggaggtaattaggattagataatgtcatcagggtaggcccagatgatggaactggtggctttaccagaagaggagagacctgagtagacaggcacacacttgtcctcttgccatgtgatgccctgtgccacattacaacatagcaaggaggctctctccagatgtcgtctctgtgctcttggactttgcagcctccagaatcatgagctaaataaacttattttcttgataaattacttgtctgtggcattctgttatagcaacagaaaatggagtaagacaatggagctgggagagaagaggtttcaattggaagtgattaggtaagccaaggagataccccatggtttataaacccagaatatattcactggcctggagtctcccagcatcctctagacatgttctgctgggagttactgcaggacatacatcagtccatccacacatccatgcatccactggtccatccatgtatccatttactcctctacccacttctaccttccatcagtccattcatccacccatcatccatcgtccacatgttcatatatccatccaaatatttaagtcaccattcactcgcccatttgcttattcactccgcacccattcatccatctacctgtccactagttagccaaaccttcccgctctcccttatggagagcctacatgtactatgcactccatatcattctcaaccagtagaaacctaagttaacccaggtcacatgagttggtcacatgagttctgtaagagactattgagccaggattatgacaacagttgagtctctccacagctctgcctaggacctgctcttccattcctcccattgccagcatccctctccagtgtgcactgtgggaggcctcatgttctcgtcctttgtagcaccaccacctgctccatccacaccttcctcacagttccttgagctatggtagtggcgtgtcagctggtctccccacaagcagcctttcccaactcgtgccgttactcacaatctggaagtaccacacttgatcatgccacttctcaaagactccagtgggctcctcagtgcctgtagaaagaagcccactgttttgctcagctatcttatgctctctgtgcttggcccagtctaggtatcaatgttacggccctttggtttccaatttgtgctgcagccagagtgggtgatttggtttccagactgtttttggcatgtgctttggcttcatgcttttgtgcatgccatctcctgcggaaaacaccttcacctcatgtgcctcactccccccagttaaaatccttcccactctctgtggtcctgctccaatgcctctccctccttttactcatggggtctgtccttgtgtcccactgggatgggacgttccctctgccgagggaattgtcatgtttctggctcctgtttgcaagtctcctgctcatagcagatttcaggcagctgcaggtctgtgttgtctccactccaggtcactgtccagtgcctgacacatagtaggtgctgtttctgaacccggcagttcaggacttagttacatgtgtctaagatggtgtagaaagggctactggggtctgactgttgggttaaaaggccttgaatgttgtttgccccttagtacacacggtgcttggcacatagtaggtgctcaatcagtattttttggatggaagaatgaatgaaaatatttaccttctcctttaatgtttgtaatttcaaaataaatatggagcaaagaaagcaagaataatagtaaaaattcaaaacccaacttgccctctgcagtgttggtcatctaggagggcagctgcctgttcccttgtccctgttttggagtgacctatgggttcgagtggggaggggctgtgcatttcacttctgaacttgcagtcagaacctgcatcctctctgctcttctggtctattctacgctcccaaccactcatctgttctctatggtgaactggaagtggccttctgaatgtgtctccctgtctggagccttcagtcgctcccattgtccttaggtagagaccctcagtgtaggccacaagtctctgtagagtggtcagacacccccatcctcccctcccctccatctgacacttgcccctcactctgcattccagccacaggcctttgtgcatgctgttcctcttctgggacttgcgctccacgtgtcagacctgccaagacacaggcctgatgccctcggagcagctgcccctttgtctaccctcctgggcatccatctctcaggctgcagttaggtggtgactcgtgtgtacagttggtgaatatcttcctccctggctggactgggagctcctggtgggcaggcaccacccagacctgaggctttatgcacagtaaacatttgatgcttgttttttgaatgaatgaataaatggattaaaaaaaaagatacaaggtaggtgcttagtagatatttattgaatgaataaatggacggcacactatagatgcctagcaaattcttgttggataaaccaaaaaacccaagcaaatcaagaaggctcagcaccttgttggaaaagcctggccaatgactcttccagttaggccttctccagaccagggatactatctgtctgtccatccagccctcctgctcttttcctgttagctcaggaggccatgcatggccatgcctttgaccctcctgcctgctctaccccagcacacgggcaggacctggaggagggtggcaatggggccctagagacctctgctgacacacttgtgctgggggtggccttctggtgagtgatgggatggaggctgccctggcctctggcccctggtatcacgactctctttgcacttctgtaatcttttaaactccagagccgtctggtccagctatgatctggaaacatcttccagaacatctgttttcctcctcaatcaatacactccccaaagagggccaagttgccaaatattatatataacatcaaacatgctatctgaattcaattaagtggtttggttggggaagaggttgtggtaattaagcatactgttttggagcaaattatagcaaactgtttcattcttcattaggaggcacctctcttgactccctacgagctaaaaatgagggagaggaagaaaaagaattaaataaataccccccaactcaccatataaatgaagatagcttgatttattggaaccattatgggctttaatttttagctctgtggtgctctgtggccatggtgcaattaacctctctgagcctcagccttcttatctgtaaaatggggatggtaacacccatctcacatggttgccatgagagttcaatgagataatgaaagaaagagcctgcctgttacagttccatgcacaaagcaggccttcactaaagggtcacgatggcatgggggtgcattgaggctggatgatttatgctccgtcagtcagagccagattagaagtcctttttctaccaaatgcatctcacgagtgtgccagtgtcatttgtgagtttctgggagcagggataaggactctcctatttcattttgtttaacagccatagtccatagctcagagcaggcaggctccataggtgaggagggtcagaatgcagacctcagatggcttcaagtgctagttcagcacctcctttagcagctctgaattccctgggcaagttgcttacgcccctgccacatcaatttcctcctctgtaaaatgggatatcactaattattactgacctcctaggctgctgtgaggattaaatgaatttaacaaatggaaagcacttacagtgcctgacacatagtaaaactcccaatacatgtcaattttgttattcatttatttaaagaatggcccgtttaagctgccagtctttttttccacgggcactccactacttaggctagggatacaccacacaaccagccccagactaatagcagtgcccatttatcaagtgcctaccatgtgacagtggaaggcccagaggaggtgcttaacatccattctccatggctgttgcaacaagcctgctgttactttcatcatccagaggaggaaactgaggctcttaaagtaatctagctgaggccatataggcagccaggacgttacagggctaggatttgtacccaagcctatgggaccccaaaacggctctcttttcactctgccatgctgccactcaggaaaacacacctcccaaccctgaccctaactgggcatctgctctgtgcagactttcatatctgcagtctcagtggattatccagaagtcttggaggattcgtatgttgacccccatggggcattctgacccttaggaattgccttctccaggagtccatgaaaagctcattctgggttgagtgaggtgataggacaggctcatcctccctggaaggggggaaactggttagaaggattttgtcatccaggagggaaaagatagcggcctgaagaaggatgctggtagcagaggtggaaaggagagggtagattgtggagaaaacaggattggtcaccagtggcatgcgcagtaggtgctagagttctttagaggcgggggttttcctcggagggatgttgttctgggaaaccttactagaaggggctggtggggtctaatctgactcctgaaggagggatggagtcatttcacacagtagagacatgaagagttaaaggtctggcggtgggaaggccctgggaccagctttggggagcagacgaggaggatgtgagaaggttcctgcattcaaggagctccccgtgtgtgctgggacaagaggcctgcagccaacagtggctcaagcagagtgacatccaacaccagctattccacagatttgggtgggctgtgaattttagtgaataggaatgggtgtgggagagattggggagccctcactggacccaaaggcttgcgcagacagcatttgtcattcattcattcatttgttcagaccatcgatgtactaatactgtggggcaggagagcaggcggaggcaggaagggagacagacagagggacaaaaagggacaaaagccctccatgggaggcactgaagatttaggaggcatacataccttgtatgccttgtcagaggttttttgagttgcaagagctggaaccctgcctccagctggtctagggaacaaggggaagggctcactgctgctgaaactagggcttcttaaggtgcaacaggcccagccctgccctctgtgtctccagctgttggtcctccttttctctattagcctccctctctgccaaaacccttgcagtatggtacggaaaatggccaccagcccctccaggcccacatcctacccccttagctggcagttccatggtgttccatgacaggagagtcctttaacctccataataccagaaaattcttacaattggctctgattggccaggcctggtcacatgttcatcttttaaccaatcactttatccagaggcatggcatacactcattggccaggccttagtcacatgctcatccctgacccagtctctttatccagagacatggaatacactaattggccaggcctgaatcacatgctcacctatgattcaggagtgccattattctctgatggtggttccccaaaagactcttgggtcattgttcccaaaaggagggagaatggatgctggcgggaataaaaacaaggtccacttccggaggagtataggccggctctcccctccaggaatgagtggaatgagtacttagagctgggtccaccctgtcaagtggaatgtcaggagctggccatcagagagggctgggtccatgggaagggagggtcttctgggccaaggaatggccacacctggtggaggccacatgggcagaggaggccctagcctctcttgacatctcatgcacctaatttccttgcacctgcactggacggctatttgcatcctccctactggggctgggctcttttcaatgccttcccttttccctggtgagtgcatttcagggtgggaatgggagcttttgttaaggccgcttgttgtccgattcctggttggccagcatgaacggcgaccgagatggcagggctgggtctgactgggagacctttttcttttgaacccttctggggtctgtctagcctgattctatctgggcagcgcatagtgttttctggacagaaacccaaagctcacccctgtttccacattgtggagctgtgcgtcagcatcatgggagcatcgcagtggcagctttgtatctcccttttgtcctgagagggagagaggttggcttgggaaatgaaaggatcagctaatgccatcctgggtcacatcaaagccagctaaagctgggtgagctagctcatcacagcttcacaggtggggaggttcagtttgtcagagtccctagtcctagcctcagccctgcttgcaacttgccttgtgatctttggcaagtctctgttcctttctgtgccttgaattccttatttgtccacacaggaacatgaacactttgtgaggggtaaaacttaattcgcgagtgatgtcatcaatttgggcccattcctttctgtcccaatgagagtcccagtgagaggaccccgtcttacccctcttctgtgctattgttgctggcagcttaggaacacatggctctcattttaggacaaatggctctccctactcagagaatcagctgtgagttttctgctcaggctaccctgtctcaaggttgctgctgaccccctccccaaaattccctgacaccctcttcccctccccttctctaacttctggggtgaagctcgaggctgccaccacctccccgcgctgcccgccaagccattagtctcccttctcactggctgcgcatcagcacagtaatcattttcagatttacaagcattaaatattttaatttaatgccttggctctcttgtaattcatgcacttaattatatgataattactcaaatgaaagagatacagctgctgccgtatcaattctgagggaagactggattttttagttggactcattttgggaggtggcctcccccaccacacagctccacatccctccccagaggcctcctgcagcccttcttttctttgggccatggagtctttcatagcccctcctctcccagccagtgctggggctgggctgcaggtggggtgagagtctaggcaggctgcacccatctgctccaggagcagggtgtgagtcctgccccagttgggtgacccagacttttatgggtgctgctctgtaagcagagaaatctaatgaccagtgagccaggttgggaggagccatgggccttctttgagtggtagaagaggaaggaccctctccaggcctctctccccactgggcagcagaggtggctatgagtgctgtttgggggcctctgtagcaggtggagaagccaggaagcctgtctcctccgctggtgatggaagtctgggggtaaggagtcaacttctcctctgaatgtctccactggaagtggggttagaccaggcctcctaccactgaccaccagggggtttgcaaagacaggttaaggatggatggaaggaaggaaggaaggatagattgatggatggatagatggtgctttctgatgggagcacccaccttgttcctatcacccctcccctccctttctctcccctcccttcctctccctttcttaaccctccccctctcctctccattctctccttccatccttatcttttccattttattttcctacttttcttcctttctctctttccctattgacatctaaaattgtgttggatgcctgaagggtactggctgttgtgtaagaactgtaactattaatatttggcaagcatttcaactcctgccctcccctgttcacggagccccgatgggtctgatgttgctgagtagatcgactagagaccctttgagttgatggcaccagcagatttgagaatcaggtggtgttgccttgagccaggtcctcgttggttctgagggtgggcagcacgtgggagggcttccacaaagctgagcctgcttccttaggggagaaaagcccctttctcttactgagaatcaaagggaagtggcagaggagtcctgggcagagccctagtgagaggggccgatggtgctctggcgctcaggcttgagcttttgaagaagccttttggctttccttgggatgagaagttgggtcaggagagtgaaatttccaagccaataatgtattcaggctttttgaaagtttcctggttgttcgggtggggaacctcttggtttaagggaagatcttggccactctgggcccacgtgtttcgtaggtgtgggagagctggacagtgcatttctgccgaagtgtgggtttgcactgaaaagggttacaaatggttcgcccgtatgcagacaattttcagctagcttacagcagctgcggcgccgtgctgatagattaaaagcagcaaccagccccagaatgaagtgtattagaactcctgctgggtcgagctggggagaggcccacacagctgtcatctaggccaagtttccaaccgaaacctcaagaacaggatggaactctgagaaaagttagctttctaaatgaggtggccggctgttaatcaggagagtggggagagggacccgtggaatgccgggaatttagaagatgaggacgaggaggagattggtggaggtgtcctgcccagaccaggaactttgtacagagctgtgatttctggggccagggaacaaacaggctgttgctggcgggggaccaagggctgggcacagcaccccctccttgtgccttgctccaggcatctgtcttgggagttgggtgaataaggacatctgggtgtttccacactacttccaaaggctccaggagctcagtgccaccacaccatgctcaggcccccctggctgaaatggtagggtgattcttggatctggggagctgcacagatctacttttgtcctgggaaatttctctgtagagccacctgctgccagctgtccttcgctttcccctggctacaacatgggggctgttttgatttcatatgtttaagggatgtcttctcttgtgttgagaaaggctcttggcagggattgggtcctggcccctgagtctgactcaaggccacagaaggggttccttcccattgtcacagatgctacttgagagcatatctagcacacccccatccttagccagcatgccaaaagagagatctggaaatattcttttttttttgatatgtacttatttttgcaataagcaaaatacttcctgttttaagggtcaggtgagtctttgctgaaaaaaggaataaatccaacttaactacattgcgattataaatagtacaatatatggccataattcagtggcagtggcgtttgtggtacatctatagcaaatctatccatttaacaatttgctgtgtcctcactcgggcaggccattgggcaggctactgtgcagtccatcagctgcagatgtggctctaagcatcaggtgcagttggtcatcaaggaaacacaaacctaggcaaagagcctgctggtatcacacatcaactgtggcagtcttatgttgggaagaggcctggcttccaaagctgctgtgcatgaccttggcccatcagatggtgggaaataagctctgcccattggtggcatgattggaggctcttgagcagacatggaattctcgtggtttcttgcctgatgagcaatcaggtcacagatgttttcttggattcctgagctggccataccagtgggatgtgtatgtttcagtagcaggccatggggaggggtctcagggggtgagggagaggtgcaggtggatgccattggcctggtccaagggtgtggttgggatggtgccgacaggcctagaggccaaagacgtggctctgggaggcagaccaccttggtttgagtctgggctctgccccttcctggctctatgactttggacaggctgccccactttccttgactataaaatcaagataatgacagcatctctctcagagagttgttgtgaagattaagtgagatatcgtttgtcttagaccttgtgtgttgctgtgaaggaatacccgaggctgggtgatttataaagaggtttatttggctcccagttctacaggctgtagaagaagcatggcaccagcatctggggagggcctcaggctgcttccactcataggataagagggaagagagctagcatgtgcagaggtcatgtgacaagagagggagcaagagggaggggggaggtgccaggctgtttttaacaatcagctctatgggaactaacagaacaagaactcactcacgctccttcccctgtgatccaaacacctcccactggatcccagctcccaacacgaccacactggggattagatttgaacatgagatttagagaggtcaaacatccaaactatagtgacatgtaaaatgcgtacagctggctgtgtgggcgcggtggctcatgcctgtaattccagcactttgggaggccaaggtgggtggatcatgaggtcaggagatcaagaccatcctggccacatggtgaaaccccatctctactaaaaatgcaaaaaaattagctgggcttggtggctcgtttcgtgcctgtagtcccaactactcgggaggctgaggcaggagaatcgcttgaacccaggaggtggaggttgcagtgagccgaggttgtgccactgcactccagcctgacgacagagcaagactccatctcaaaaaaaaaaatgcttacagctatgctgggcatttaagtacccaatgaacgttggctatttggacaaattcttccataatcttgaatagtttgacaagaatcctagaacctcaaatcatctggtctgattctagaatccgttcatgaatctcttccacaaatgcccagctttccttgaatgcctcccatgatggggaactcacccattacaatcaatcatagacaactttttgtggatctagtttccagactgtacttttttgttggttctcacctgatacaaatactttcctggcttcttcagtatagactcccaagaacagttaacagctgccacccatcgggtgtgtatcaggccaggcactgcgccaagcactttacctacatgatctcatccatcctcctgtgtcctaagagacagatgttattttgcctccattttacagatgatgataaagggtcagagagttaatttgtttaagactcacacggatccagttcagctggctgggactgagacctgtctgatgtcctaaccattatcctttccaagcaagctcagaaccagctaattctttggtgtttttctctgcttctcccttctcaactgcagtcagaccactctcccataatggtttcttcctattgatgttttatttgcgtgatttggggagactatatagggatgttaccttttgtgagatattatgtctacagcttctcacagcaccattaaactagtaggataaattctgtctgcaggagacagaagccactcactactgttgtctagtctcttaaattaataaaaataataatctgataaactggttattgtaatttatccccgtaaagcagagcacgtgcctgaattgtcaatcagccctcaaagcagtagaaaatagccagcaattaccaaaggctcagtgagcagggcgaccgcaatcctggcgtcttcaaattaggagaaataaagaatgcatccagaacacatccatttttcagcaagtgctgcatggattataaaatttattatcaataaaattattcatttgtgccctataccgcacttaatgcacctgaagtgagaaattagaagtgtgtttaattctggggctggaagaaaatacaagtgcagcaaatttgcagtaataggagaaagttaatgcctggcaaaaaaaggaatcaatttagtgattgcttttatattttggaagagcagattggtttttcatgcttttttatgataaaagcatacagattcacttagatccatggttttcatattgctttcgaagaataaagagaggttatggattaaggggagtatacaaaggttaaaagtacgtgcatgtcatctgtattctgtgtatctggtgcatatatgtaatatatatgtgtatatatctatatatgcctctatacatctatatacacacatacccccagtaaagtagatgtagttacaatatagttggtaaatatttaataactcactgtccgataaaaaacagaattttgattttgtagcctttgccgatttctgtggtgtaaatactcccactgtgggccaatttcagtctaccaatatcatttcgctgaatctggagttgggaagagaaacgcacagttggctctcaggagtcagtatgaactggctctagcacagccctgttttatatgtgcacatgtacgtgcatatagacagacacatattatctctatggtttaagaaaaaaagaaaggagacataaatgctatccatcagtttgagccctgagtatcatctctgtgttttcccaagtgccagcctcctttagtgaatttgcatgtacattttattcaagtaaagagcagcctcctgccctggaaacacggtgactttattttcattaagttccacgtgctaaaggaaaaaagaaaagaagaaaagaagaggtgaagaaggagggggagaatccaggcttggcttcccttgcattagcaacactggcttgtcttcagcgtactcggccgactcgcctcggtttttatccagccattgttctttttacaccgagtttgcacactgtggcgtgtctggggaatttcagcagttggaatatacatgaaaagagttccgttccactttcataaggtccctggatggcttggacgaggcctcaaggccccatggtagagccggcaccacattcatattccttcccacaccacacacgatagcacgaagcccagaccaatcgaaaacttgacagtaagccttttgattttgcggggaaaccttcatcatgctgcgagagggaagggaatatagcccaaactggacttcatactgtggcaagcttgaaatcccagcccaaccgcagagctggctgattggaattgttggaaactgtgtccaggaattcggctgcaagaacttggctcacagcaacttcggcctttttgaaagaaaaattgtcaactgggagagccacttggggcctgggtttaatctgtccaggcagtaaagattcacggaaatgattggccaagtttccctaaaatgctcagagctcctgcctatttggggactctgggggtgggaaggagcaggctcactggctcctggtgacagctgtcgtcactgccgtgatgatggcagttgtcaccggcttcgatgctattgctattttgttaatcgccaacctgctgcttgtgagatagcagaatcagaggtgcaaacaaagccatacagagcatatgttctactcggtaccctgctctcaggctactgtgacagggtggcaattttctgggcacaccttttgccctggcaaagtcaccatgacatttagacagccaaagaccaaagagagactaacattgaaatcatagatgtgtgctgggtaaatctacaagcagtggtaccgtttgcacctctcttgggaggacatctgtgggctttcttgactgggatcgtgccttcagtttactcatctttgtttgaaaatgttagtgaatatgggaccctgctatgaaatacccatgaaattctagcatctgggtacattggccagcaatgtcctgatgatactgatgtagacagtagaccttggttcaaatgcacaaaagatggagcttggcgaaggtccaaagagccaggaatcaggagcagaccgcccacaggaaaacatgttgtcatcaactcttcttccttgacaaggatattaagtcctggtcttttcagtgggggaagattcatcctcttggggcagagataagtcagtgatgttgagataggtttgggtccaaccactcattctgcagcaggagagagttggaggaatttcatcagggatggatggagactggtgaggatgttccctggggcctcctagaaagattaggggaaatctctcgccatctggccccatgctgatgctccagcccaccatacctcattagcagagaaggctttgcttttctgtttttctttttatttcccgtactgtaccctgttccctgaccccctttggtactgagtaggaaagtacaaagcgggaagtggcaatatcccagggctttgccccttttgtgtggccaagccacagataagtcagtagacctctctgggactcgctttctctgtccatgagatggagagtactccccaccccagacatacaactgcctttcagagtggtgtttaggagtccaggggatggtgagaaggtggaaggggcagctgactcaggccatgcctggggcaagcctgggccagggatgtccaaggttgagggaagcccctgtggcccctaaggagctcaggacttgcccccacctcggacatccctgcctctgagacccccttactgagtggttctgatgtcattgctgggcccctccaggtgggacccccccaaaaccccgctcgcttccaggtacaccttggtgcttcccaatgccaagactattcaggaaagggcagaaacctagtaatttctcagctggagagtgttgtaaaaataaatgtcttctggaggttgaaaggttgtcaaatacacactgagcttaattgggtcctcaaaatgtgcaattcctgctgatttcatggaagatgtggacgtgggatgtgtgtgcatgtacaagtgtgtgcgtgtgtgtgggtgtgtgtggatcccttagcagaattgggctgatgctagcttttgagctgtgtggatttgcatatctgtgcaggtacctgggcctcttgatgggtccattacttagcaaaggacatgatttctcctgcacactggggagggcccctacagccacttctgggcctactcctcttatcctgcatcactttcaagttgggaagtgacccagggctggggccaggatctttgccagggcaactcacctttttcatgccatggaactttctctccttgcccccaacaagtaaacatcttaatactagctaatgctcctggggtgcttgtgtgccaagcagagtttaagtgctgtgcatcctttatttaactcatttaagtcactccttagccctgtgcagagattgtgacaatcaaatgcagtgcacctgtgaaatctgcccaccattgctggggtctggggccccacaagctccatccacaggtccaagttatgaacgcctgccctggagagttaaccaccaggttcagaattgatctcaaaaacagtccttgcctctgtttttctgcaagcaaaactggcttcagaaacctccagcactgcaggatgacactgtgtagctccagtccggctgtctgttggctctctctgtggtgggaccctcgtcttttcccctctgtgggctgtttccctgtttgaggctcagcccctctggagccagccctctctggctttgggggccccaggtgcccaggcccagactccttctctagatctggctgccagaattgaattgatcacttccttgcagggctggaaccaagggggctcaggatggaggctcttcctcctggcctttcctgggcctcctgcgtgctcatcctgtgggtgggaggaggccttctaccatccttgaggccttcatgggagatgagtttctgcatctttgtgaactcagtgctgtgccttcagaaggacagattcccacccaaaccgccccatcacctggcagctcctccagccccagcccagaggctgcttctgctgccatttcattctctcacctgggccaatatcaggggcctgcagccatgccatcgttttccacccaagcacccgtgtccccaccaccaccccctggggtcagagggtcagaacactgccccagggccacctgctcctaggatcccctcatgtaattcccctagccctggtggccccgggagttcctccttctcattccacccaggctgcagccctctccactgtcgctggcttgtttgttcagccaagacagccaacccggggaggaggagcgggcaggggctgcggcgtctgcccccctccctcctcctgccaggcgctcatttgtatgcagaagggattaggcagaatttaccgtggcctcaccctggggagctgctcgcgccctaggaatactctccgatggcggcgtgcagttggtaagattagaacagcccctctgccgccctgcacgccctggtcactctctaggccgccaacatcgaaatcattttcatttataacctttttgatcatccagcctcaaagagggcccgccttgtgtgacagcgggcaccaaaatggcccaattatttggaagaggagggagcagctgaaaacagtcagatatgagagacagggcacttgatctgggctcatagtttttttcctgccttctcccaccaatatttttacagctgttgacatatattgagttacatgtgcctgggctagatccccgtggtactgtttcaaagatctgttcaccgtaaagtgtgctgttctcaagtaaatgactgacttcaagaaagcacagtagtttaaatgttactataaatacaggagctaagacattttaattataatttttgagttatacagtgttctataagtacacgaggcatttacaaaagaatttgtgctgagcttcaagacactgtgctctcttgtggataaagaagtaactgcaggtggctaaattccgcagcccagtggctgaactcttgtttacttgtggccaagaggggtagggggaggctgcagagtctgtggaggtctcagtttgggatgttggaatcaattccacacatatttattgagttcctctctgtgcaaagtactgaactgggggctgtgggggcctccgagttgatagggcagaaatctccgctctcacgtgaatagtcccatgggagaggacagctagcaaatcaatgtgagagacgctgggatagaaaaatctgtatgggagctctgagaaggggcatctgattctgcctagggtgagagggagggctttggagaagagggggcacttctgctctgacttgaagagtgatgagagccacagggaatgtttggaagtgaacaaaaccaaagtcagtcttcagcatgagagcaggtattttgggcaagctgcatggactgcctctttctgtatgtggcttgcctttacctgatgccctttaaattctctactgtccacagttggaaagctccgaaggtcggaagagaccagtgatcttgtgggcttgaaaactcagccctttgatgggttgagtggaaataattcctaggtacaatgggagggaagcaggtctgtggttctcatgttattgtagttttgatgggagcagccttgtggatcatcttcttgtgtgtgctccagtgctgaggcattgggttaaggaaaggaggcagatctggactgacacatgactattatccacctgacatccacccatccatctatccatcctttcaacctcctcatcccatcaatccatccatccacacatccatctctccatctcaccaacctcttcatttcatctgtccatccatccatgcaccatccctccatccatttatttattcacccatacacttatccttccatccgcccactcattcattcttccatctaccatctaccatccacctgtccatggttacattcacctgccagatgtccatctacccatccaccatctatccatctatctgttcataatccatgagacattatagtgtatggatcaaaagcaaggattctgcagtcagatttcttgaattaatgtcctaccttcaacacttactagcattatgtcctaggaaagctacttaacccgtgtgttaaccctttcgtctacaaaatgggaaaaaatagcagaggacaacagaagctcattgtcaaaattaaataagatactacacacaaagtgcttagcacagtgcctggcatggtaagggctcagtaaatgttgcctctgtttattgagtgatgcctgtaggctggatgccaccctgcacagcctgaactgaattactggtgctccaggtatagactggagaggttccttcccagcttcttccttgtggcaagggctaggattttggagtgggagggacctactgacataggcattaaggatcattaaggaatgaccagtgtattttgtttttatttttgttttagggggaaaaatcctagtttttgatgtaggtgtgtttaatatgtgtccatgaggtctcttaatttttttttaacatttaattatgaaatgaacccatgaaatacagaagaaaatgatactccttggtgagttgtctacatcccagtttccatcttgaccaagctcttaattttaaagtgctgttttaaagcactttacatccaaattcactcattctttgattgttcttacagatttcttcaagctacatgtgtcgagcaccagctgtgtaccaggcactgtgccaggtgcttttgtcctgaaggtctcgtgtaagatttatatcttcagagggaaacagaccaaaatcttgacagtgggtttctaacaggggtagaattaagggcgatctttatctgtttttgtattttgcaaatttcctacaataatcatataatgattccatatcagaaaagccaactgaaaataattcagggagatcagagagctcacagtcaagcagaagaaccaccatttataatagccaaagtgataccataggggcctattaatgtaatgagtccctgaaaacaaatggagaacattgagttggcattttcagaacaactggtcctggagacaccctgggtgctcaccacccactgcccagtcgattcttggcatttagagcaccctgttgaaatggtttagactggacaaagtagggagaggatgttcggccagattgtttaggaggtagttgggatttgggggcctgggtcaaggtgtggtcaccaaggtgggctgtgaaggtggtgtgggtcttgcctccgagctatggcaaatgggtagaggtagaatgctcattcttagtgcacttgctccctgggctgctatgcccggcgttactacctgaggatctaggattggggaagggaggaagtccttaggcatgcttcaaactcctggtttgaatgtggagttggagctgtggcctcaggtgtggggtctgtaaagttgggagctggataagcttgactctggggctctccagcatggatgcatcctgttctaagtctgcccagtgccagtgtcaggagagaaaagatatcattgttgtggggggaccatgaagcccagcaaaggaatgggcactggaggggcagttgggagtcccctctgcctccaaggcgggactgtgttgggctggaggcattgctcttcctgttgctaacttggcaaatttgtttggttcagtcatatcacttttggggggcttcagttccccatctaatggagaatctttcacttcatcttctgagcaaccctaatgaaaatgttatgagagaatcttataaacaggggagccctatgccagggaaagacgttatttcataaaaagacttaaaattatcatctaatctactaagagtggttgttattaagaaatacatataaaattgatcatgccactgcactccagcctgggcaacagagtgagaccccatatctaaaaaaaaataaaaataggccaggctcggcgacacatgcctgtaatcccagcacttagagaggctaaggtaagaggattgcttgagcctaggcatttgagaccagcctgggcaacctagcaagacctcacctttacaaaaaagtaaaaaaatagcccgtgggggtggtgcatgcctgtagtcccagttacttgggaggctgaggcaggaagagctcttgaacccaggatttcaaagcttcggtgagctatgattgcattattgcactccagcctatgtggcagagcaagaccaagagcctgtctcaaaaaaataaaatataagaaaagaaatatatatatataaattataatgtttacatttttaatcatgaccataatattgaaactgtcgtaattattagaactcagtattctgccagatactgcacaggtagtacctctaacccttctaacatccctgtgtagggtaagacttattattatcatttttccagtgacttcatgcagatttgagcccagctccttctgccttcagagtctgtgctctgttgaatcttaacaccccagaaagcttgtttgatattttttttaaattaatatttgatctttacagcatcccaggagaaagctggggccatttttctgtacccattttacagcccagaatagccctgctggtgactctgccctgggcctcctgtttgttcttgcttgcaccataaatgctggtttccagggtagagcgggtccaggtggggtcgggtctcttctgcatccccatcccctcctggaggggtgggggcccttggggagcaccgctggttcctctgcttgccttttgggatcatggcccggcctctgagcaagagcctacaagctgccttccatcacccaggcaggaccctgtgtgaggtttttgccttttgcttcttgcccttcctgaatgacacgcttgcacttgtccctttggtttagctggaaaccgaaagtgtgtcatctcaaatgcagactgacgtgcttcttttataaattcttgggcattactattgatttttggctgaggatttagaaatcctatctctaggactcccgagatttccctctgcagtaataatgcattgtcattcttaatatctccaatctctgacacaatattcatatcaagctggagtagtggcgtcagcacatccttggggacagctgcaggggctgcgctggccccttgcccccctccaccctgtcttctcaccaggaaaattgctcctggcccaccccctatttgtaggggcctaaaattgcatcagggaggcatcaagtataagagagttgatttctaccctcctcattgcacagtttttactgaggctcagaaaggggcaggagcttgcccaaggtcacacagtgagtcagtggcagagggagctggtaccctggtctcctagttcaagggtcatcaactctgtgtctatgggggccaagcattaacataagttggtgcaacagctgcacgtgggacagtgagggttatgcagaccctgcagagagcccacaccccttccatggctgcccaggcaattgcatctgggagagtccagatgttctgagttttcaagagaagccaaaagcccatattttaatacaaatttcttgtattttaaatgttggcaactaatgacaaagcgcatgagtgcatgcacacacacccatgtggccctaaaacagaaccacagatttgagttggaagatggtacaggacttgcacagtgtacaagtgggaggccactctcttggtccaggtgtccaaacaccttgacttccatccatgtcagatgccttcctggctgttccacttgtcccagccacagacttgaggggcccgttttcggtgtcccttccagctccttgtcttccagcccccacccactctggctcagctgtgcccccgagggtctcctcacccttcctgggaggaaaggaggccttttctaagcaatcctcctctctggatcccagcttccatgcaccctgcgtgttttgcagcaggtgcaggtctgacccacctcccgcctggtttgtcctttgcccccatgctgccaaggagacagagctactagtttggcctcgggacctcctgggagtgtcactgaataggttctcactgagggattgtttttctagtccttggaattgattctgcttagaccataaaaataaaaagaccgtatcctgggtacttagaatgtgtctcttgaagaagctgatgtgtgtgtattttgggaggggggatggaattgtgttttgagatgctgataggaaccaattccttgcaccttgcaaaaatctccaatggaggcttttgaaactttttggcagaaaagcggagcgttggatgttggaactgaggttgaatctgtgaaaattaaaatagccaagaaatgctgttttcttagttgcaaaaacattttgtcaacacgataggaagtttgagtgggaaggagggtggtgggaacacacatccctcccagtgtcccagcttgagggccttccgtggggggcccacctggaaggggcatagagatagctcttctgtttgggacctgatgataagggagagtggggagagatggtgctgattctgcctgtggccctgtgagaatcacctgtttcctcctctgtctcttcatcggtccagcagcttcctgcaaacccagccacaaaggggccctctaggtacctgcgaagggaggcccaccctgatggaggtcactcccaggcaggcagtgcctcgccttctctgtgtgtgaccacatgggctctgcccagcaggctgggggcagttggcaagcagccctcagagctagacttgttgggccggccacatccccaaaatcattactggcatgagttgagagcccctttggggagacctacattcccttgtctgtcccttgctcccacggctgtcccttatccacaaatgatgtccccacgctatggccaaggacccagttatccccagtgtggttagaaaggggcactgagtaggcccaggaaaggcttagggttggcgttgactgcaggttttgtagaaagagagctggaggcctgggctttggttctggctgggccacagacttgtgtggccttggccaagcagtcttctctttccgagcctcagttttccttctgtaaaatgagggaattgaaataggcagtgttttccacattgcaggctgcaacccattagcaaatcatgaaatcaacttaggcagccacagccaacgaaatgaaagaggaaacagtagggcggagcagaacacagaatggaagagaatggacgaaaagggaaaagggaagggtaatgtcagaatccatcctcctgagtaagctctcacgtggttccatgaaacttgctttggtttccatgtgtattaatgtgcagctaggtcatcatgtatatgcttctttctgtgggttgcagtttaaacaatttgaggctgggctcagtggctcatccctataatcccagcactttggaaggccacggtaggaggattgcttaaggccaggagttcgagaccagcttggacaacatagcaagactctgtccatattgaaaaagattgtctgtgcatggtggcgtgtgcctgtggtcccagctacttgggaggctgaggtgggaggatcgcttgagtctgtgaggtcgaggctgcagcgagcggtgattgcaccactgcactcctgcctgggaagcagaatgagacctgtgtctaaaaaaaaaaagaaggaaaaaacaaaacatatttgaaaagtacagagtagcttatataaacattcttctaagccttacggttcagaaatgtagttagttcactggctgggttgatcttgagcaagttacataatctctctgtgactcagtttccttatctgtaagatgggaataacagtagttcccagcacaaaaggacgttacaaggaccggatgtgtgaatttatgtaaagtattcagcacattagcacacaatccatgctccatgttagctgctgttgctgaagctgtagatgcacccttctacctagggaaggaggtgtggtcccagacctgtcaccttctcggtcagccaacctctggaggagaggagaggaaatgggtctgctgtgcctccgttctttgggcccagggacagtcccagggagctgcagctgatgtggggaggttcacaggggagcccatgcccctaagcagaatcatgcacttgcctggtgagagctcttccctgccatctggctggaggccggatgggacctttgtctgctctggggggtgcaggcagggtggggcatggcctgagttgcagcccagacccccagcctgcagctcctgcctgttcccaccctcagtctttggtggccccgagaccatctctcctgccccccattcaccaggcaaagccaagagccccacggccccaggaatccaaagcccagtggaagtcctcacatgcagatctgtgatctgccaccatctgagcatttccatttcattcaatagttcgagtctttgaaccctgtagctccattttgaaccatctgaagtgggcacacatctgacaataactactttttttcaccactcatcccacttaagaaaaaaaatgcaagataggcctgtgttaaaatgaaaaggagaaagaaagaaatgaagttgtagaggaagctgcctggtcagaccagtgttgcagtaactaggaactggaaggttcaagatgagtctctagagaggcagggaaaggagggatgacactggggccacctttctggccaggggcaggagtgtgggtccgggtgtggatgccagaggagtggagaatggacccagcgctcttgggaaacttttcctggttcaggcacggcttgcctggcagcgaggagcaaggtcattggttcgatgtcaggggaaggctttgtgcttccccgaaggcggctgtctccttctctcccttctctctgctccgccttccccgtctctctccccttctctttctcccgaggtgcagatggccacatttgcaggttaactggaacagctggagatgcattattagtttcctgctgctccttcatatttgcttggatttttttttttaacggcaacataatttacaactagtacactggtgtcagagctggcatgttctaaatccgcatcagatttatgtaatgccgttgcttatcagtgaatgaagtcataattattgctttgtaccattaaatagcataaatatataaactgttatacaaattgcagcaaacgtttcctctggggagctctagaccaaattttaatgtcgtgcatttgtctgggatggcagtttctatggtatataataatgttgataaattttactgtagcaagtgacattttaaagcattaattttggtgctaaaaaaaattctgaagaatgctcagaccaaactgggaggtgcttggaggacccactgggtgaggtcgggtgaggtggaggtttttccttaagaggacagtgggtgatgtgtggcactcccagcactcctccacatgagatcacccctcctctctcaactccccagggaaagtggcagatacattttccatggcaatgatgataattaatttcaaaaaattcaaatcgattcatttctgccttaaatttgaggtgtgcaagggaaagtggaaggaggccgtggaaaacgcacaattggtggggatggtcctcgttgtaacctccttcccaattatgtaaattctgtgtggggtgaaaaaaatccccatcctaattagagatgcaacacctggcctcagatgatgtttcagatgccaggcgtgtggttgcatagcctcctaaagccattatcgtcaagagcgacttttgcgagaagccccaggacaacgcccagcatttacctgctgtgctctttggagagctgggtggctgtggtggagtgctggaaggagcgtgccaccctccgccttcagaagagggcgtgggggttggaggttccccgccagggcccactcaccactgtggagctgacccagggagttggagagcatgctgccagctgctcacccccaccattcctgggccttgatgaatgcaaacatcctctgagaacctttgttaccatcctgagttttcaggtttcatcttttttcttatgtccctgactcctcccttgagattcttagagtgctctgctgagccttatggctcttcttgttaacgtggtatccttagtgtcgtcttttggtatgtgggaggatcacgcatcgtggcccctttgtgttgggtgaagccttgtggctaattctggccagagagccgtgagtggagcctttaaccaacagagtgggacctttcagcattctctctttccctggggcactctcagcatctgagtgtttttcacaagcagaaacccctgcaatggatgtgaagggcaaatgagaaataaaccattgcaccccttgagattttgggagttgttactacaacatagctttccctatcttaatacacaggtctttgttgatttctctaaagtttacaactttctgcagggtattggaagtgtgggaaagctggctgattgtttttttttttttttctggaaagagtatcaagtagataaaacttttgtccattctggacagtgagaaaactgaggctcagaggagttaggtgactatcctaagatcacacagcttccaggcaccaggcattgacgtcccccagttaacaaatgttatgctctttcttctctcttgctttgcctttgaagaatgaattctctttcacaggggtcacaaactcaatgacctttgaggtcaagcagatcagggtggggctgaggagcacaggacaatagggactgataagaagtgcagggaatattcgaaaagcattaaggttcagccttggcgtttaattctgtgccccctgatgacatctcgagcttccacggatagcttcagctgctgtgcgcgctcactatgagtgcctccttctgatgtcttgccctcgagtttaaatcttgaactttgtaatggaagtctcacatgctcatccctttatagccgccaactatctgataaagtcctctacagttaggatggggactggccattaacatcctagtactctatccccgagtgaccttgtgagttatcaaatcctacctcctcctttcacaaatgaggtctctgagctcagaaaaggcaccaacttacccaaggacaccccaccgagtagtttcttaatgaaagcgtttgtactgtttggaagtgaagaaagtcacagtttaagtggatggaggggtgttgaaatggaattgagaacagccagtagggaaggaaaatgtgttctccttaaaaaatgttaacttttgtttgtttgtgtagtcagaagacatttattgtgcaagatgctgggcaatgtgcttgatcattaaaaaaaaccttagtgaaaagatgtcttgcatttgtgggtataaaaatctgaaacttcttgcagacagaggtcagttctcattctgcttatgttcccaacacctggctctatgctttgcacataacagaaattaagtgttgaatttaattgcctctatccttatgctaccaatggcgattatgaataatggtaaggaagttagcacagccctggggttaagagcacagctctgtggttgaaaggcctgggcgctgtcacttactgtaaagtgaggacaagatcatgacctcctcgtagagattttatgagcccatcccagatgtaaagtgtttagctgaatgcctggcaggtagttagcacttgaatgcctccaagatagtccaggagagctaatctttattaactcagcgagcccagtcttggctagtgtctgttcagctttgcttgggagacagaactgtggctcagcacaggcaaatacattctgcccactccccatgtgacgtggacaataattttgtaccccaaactgcaaaatctccatttaaagcagcttgggagaattgtttcagcatgagctaccactgcagtctggggttgcttttctgtcggaggctcggtgctgaacagttagagtggggggtcaccctggctggcagggctgggcatgacacctgtgtagctcacaggctctgagcagggttgatggggtggcatggtcatgtggcagccaaggcccagtcttgcacatgttgagatgtgatggggctgcccttgtcaagcctgcccggcgcctcctcttcatgacagtccccattatcctgtccaacagcaatgggcaggggaaggagcactggacaaggagtcagggccctgagattcacttcctctgtcacttactatcttttcaacttgatacttagaagcttagtgttccaacttgcagaatgggacgaaaaatgccacctccatccagcttactcacatggctgagaaacagacctggggataaagtgttccgtagaggccaaggggaagggccattgttggcagaggttaagagttgcatttcggtcctggatcagccacgtgggacaatcactttacctcacccagtgtcactttctccatgtgtggagtgggaataataacggcaccggccccatagtgccactgtgatgagcaagtgactgtgtaaagctggcttcgcttcagctctgatcctctggtcacactgtgaggtcagaggtcctgttgtcctgttctgctgcacatcaccagcacccaatgctgcaccctgcgcttgggcgctcagtttctgcagaatagaagaaggatgcgatcccctggagttacgtcttgatgtctgatgcctgtagactgtgagcccagcaagggcaaaagccctggctcccaggtcactgctgcatgccagcacctggctcagtgaggaaaaccctcccaagccttcagcccctgcaagcaccctcccctggaacgccctctctgcctccacatctcagcctgttcatccaaggccacctcattcaggaagttattcattcactcatccattcagtaggtacctatgcaccagacatgtgctaaggtgatcctcacctgtcacggaggaagtttcttcccccttggtgttacctcgacccccatcccaaatattttattcacccttcttaaggagctgaccccttcctgcctggtgtaatgcttatgtgcatacccagctgatctccctccctaattagacgtgagggttttttaaaactttgttgaagtatagcgtacgttcagagagatgcacacctcttaagtgcacagcttgatgagtttgcagaaatagaacacatccagatcgagaagtcgaacccagtggcctctggtagctccctgcactccttcctgctattgcctccctcaaaggcaagcactggcctcacctctggaccatactgtcgttttgttgctagaggtgatttaaaggcaggtgtgtctaattcattctctcttctccagactgcttagcacaatacctggcatttgttgaataaacagataggtggatggatggatgggtagatggacaggtggatgtgtgcatggatggacccagtaccacagggattagactaatgacggtgttaatttaacagctgacagttgttgcattctatcagcccactctactcagtgctttataggcacctctgctggtcctcacagagccctgtagggtagatctccctctgtttttacagatcagcagactgagattcagagaggtcagcgacttgcccaaggtcagccagcccgtgagtggcggtcgctgtgaccggggtcatatgactccggcttgcgtctggagctggcgctctgtgcctgagttcccactggtttacagccctgggcagtccttcctcagttgggccagctggacataggctcagcgggcgacagggctgagctgtccttggcggggaagctgatgggttccacgctgcccccgcccacccgccaggcgccccattcctcccgggctgcactgagccttctgtgtgcctctccaaaggacagggcatatttcttcccaaccctcttaagacccagcccgcactggagggcttcatcattatgcaaattagctggattggatccgctcccgcagaggactccgggggcagcagaaggacggagctgcctctggagcgctgaattgagcctcagattaggccagtcgatgggtgggggctgtggtggggagtgggcacggagatggggctggcaccgatgatttgccacccctggggaggctgtggggattggggggctgaggactggtgctggagaaggcccgctgcttgggcttacccaggccaggctcccagcattgttgccgaacatgggatgaagaaagacattctttttggattttctttgtgtgttgagcccttttatgattcatcagtaagtaaatatcagctgagggggtgatttgtttctaacaagcttataaaatactggcgtcatttgtgggcttattggagtgctgattataaacactccccatgcccactcctctatgtcaaattagcattcaaaatacaaatattggatctttggatcactttctgctgtctctttggaagctggtaggctgggaaggggtaacagaccccagcctcagatgaagaacatttccactccactaggggacttgaggggttgcagacagaacctctcgctgcacccttggaagggtgggggccacggggtgctctgagctcagctgctcctcttgcctttctcgttgccaagtttccgctgacctggctcctccccacccccagagcctgtcatcttcaatctcatggaggacgcagatctgggcaggcggcatctggccgggtgagcctgtggagctgcctcctccccagggtgggctggggcccagcctgcacccagccagacaaagtggttgttgagagtgtctgaactggctatgggagccatcacgtggcagcctcctcatggggggtcccaggcctccctggcatctgtccctgactcgcctcccagctcctcacacctcctggcctctggccttctggccatgtgtcacagcaggcacattccagctcacatgggacagaacactgtgtgaggtacgagagtggatgatgactcacatcttttcagggccatccatagggaccagcccagcaggtgcattcactccaagctctacaaatgcataggatcactcaatcctatgcatcaagcacaattatatccccattttactgatgaggccaccgggacactcagtggcagagcccgggcttgaaaattggcctgtccattccacttgacaggtgatggaatagagtcaaggccagagggagcaatttgcccccatgaaggcagagacccagcagggaccagaaagcagatctgctgaggcctcagcccagcaagagctgttgagtgaagagtcactgccactgggaatctctggtctgaagatctgcaaggcaggggctgagaggggctgtggagctctctggtccaaccatttccagttatagatagagagacctaggcctagtcattaccaacattgtctccatcactagtcagtggattaaaatttttaaaaagcttttattgtagtgtattacttcgctctcatgctgctgtagagaactgcctgacactggatactttataaggaaagaggtttaattgacttgcagttccgcagggctggggaggcctcaggaaacttacagtcatgatagaaggggaagcaaacatgtccttcttcacatggcagcaggaaagagaagaatgagagccaagcatagggggaagccccttataaaaccatcagatctcgtgagaaatcactgtcatgagaacagcatggggggaactgcccccatgattcaattatctccacctggtcccgcccttgacaggtgggtgttattaaaattcaaggtgagatttaggtggggacacagagccaaaccatataaattacaaaggctatacatgttcattgcaggaaaaccagaaaatccagccaagcaaaaataagaaaaacatatcctgccttccagagatgaccctctaacaccttaatgtgtgtccttccagcaagtttctcagcgcacacaagcacacacaaatatagtcattcccttctttccctcacttttctttcttaaccaaaatagcattgtgtttactacctggttttgtgtatttccacttaattgtgggtgaagtgggagattgttagtctgagtgattgttagtctgcctttttagagaagacgtttgtctctggtccacagggctgtggacagagactaaatgttgtttgtctctagaaagccccctgccattgagcaatcattggctgagtgccactgtgtgccaggttgttaggtgctgggaaatgcctaagcagtgtgagagagatggtggtccatccttcctccctacctgttctaggggagggaagcataggttctgggtgcagagagcgggagtccctgatggggcagacatgaggggcaggtgagcagggagtgtgcctgtggagctgagttcttcagccgggttctgaggacatcctgctcttggcaggaggggctcagccatgggaagttggggaggtgttttctgttgtcaactagacagagggccactgggacccccattttcatgctggagcttgtttccaccagcacatgcacagccctctccatggtgtcttggattcctacttttctcagctctggatgaggagaagggagccatccacatggaggccaggatagggctgggtgcaggtccccacctgagggtgtggaggcatggattggagacacagtctgttttggaagtgggattcaacaggcttcactaaaccctggcttttggaattctaaattgtcactaaggtcctgcccttgtgcattcagggtgtgattaaagcatgaggtgaaagcagagtaatcggctttggatttgctttttcccccaaaatctgagtttaacattgtgggccaggcgcattggctcatgcctggaatccaagcacatggggaggccgaggtgaaaggattgcttgaggccagaagtttgaggccagcctgggtaacatagtgaggccccatctctaccaaaaaaagaaaaaaaaaaatgagtggggcatggtggcctgtgcctgtggtcccagctgctcagggctctgaggtgtgaggatcgcctgagcctgagagatggagactgcagtgatctgtgattgctccactgcactctagcctgtcttaaaaacagaacgaaacaaaacaaaacaaaacaaaaacattgtggatgggattcagggccacagtctttgctgtgactggaggtacttactggaaattccttagtatgcaggaccttgaaatgggttctggagcagtgaactatgagctagattccccagctgaggccagcattctagaggctgtgcatgtgtgtgtctgcctcttggtcatgtccagtaggaagggaggtatcacccctctagaccaagcccttcagtggcaccagaacattggcccctctcactggtcctctctgcccttctgcctgccctcttagagcggctcctgcatcctgggccctgggtcactgaggctgttctgtggcatgacagaggcaggacagacagctctggcacaggcggggctgagctgctgggcctccaactcctgccagcccagacgtccatggcatttcccctggagctctgcttccccactctggggtcccaaaggacttggttttgttttttttttaggatttctgggcgactgtgttttcacacaaagtatgtcccttggccaggcctcccagactcctcctaagcaagctgggtgtgacagtgtctcactggtctctgttacactcacaccccccacacccaccaccttgcacagtgcctgcctcagggtcaataataaccatgacagtgatattaataactcaagctattaagcctgttcatctcccaacagttatgatgtaggcactacaatcattctcattttacatggtggggaacattggcccggggaggtggggttccaggatcccactgctagtggatggtggtgggagatttgaacctgtgcaatctgactccgaggctgcacttctgttcatgtgctgtgccaccagaaagctatagctgaatgcagccgatgagcaaatgagggggtatgtccagccctgagaatggcatggtggctgaggtggtatggggttcccgggaagatgcagccccaccgcgtcacccccacagagcaagccttgctcccggacatgaagagtggcatctgtggacccagagccacatgtctgggttcctgcatttgggatggtgttgagacctggacctgaatgctccagggctggtgtccagagccgtggggggtgtagttgaggcaggactctatccatcaggggacagtgtgagggacctgtgcctgctgccactgaagggcatggtctatagggatgacacctctcttcccacgggacatgatcaagagatggacacacatgtgcacagcaaactattagcatttattgagcacctcgtgtttgtctggctctgtaagaaataccagaaaagtgaaagaattgctttttcatcctcagataatgtattagccaggattgttttggttggaagttgacagaaaatcaagttagcttaagcaaagagaaggaatgttttgaaagctacctttttatttcacatagctatgaataacttgggtgcaacgaaaactcctttttggaaaattgtggcctggaggacagaggcaaggcatcgagagctacttgaataagggtacagaatccgtaacctaaccctagccctaaccctcaggaatgagtgaggccctgtgagtgcagcccttgggccaggaggaagctgggtgcggccaaaagtaggggtgttaggtaggcagggccagggccacctggcagaagagtgcagctttgcactgggaaaaagggagccactgcaggttcttgagcaggagagggaaatgatggctgtggagcctggggaggattatccaggcagtgtgtctgaatgtggcagggggtgaggctggagcagtcatgatgaggtggggccaggagcggagagcaaagggtgaattgccaggtgtctgtcgcatgtgctttttgatgaaggtgtctatgaagatgtcttttccaagtaggaaaaaggcaagatgccagccagagctgtacggtggggcgttttcctgctatggtgtgtgggcctggcactgctcacatctcatcacagctaatggcagctgttctgctcgctgcacctcgctggagagttggaggctgtgtggaggtggcctccacccccactcccctgctgctcagcaatgagcccattctttacctgcccagtccccctctgcctgtccctgcctctcctggtgggggctgtcaggagctgtcagtaagctctgcctctgtgggtcaggagtggctgctggatgggatcagcccagaccttaggctgcaggcacctgcttggcaggtgggaggcacagccaagggcagacaggagggctggctgggctctgggagctggcaatggggtctaagccgcccagaggtggcagaccccccatctggtccctgtgtgctgggcccacaccatctgagaaaatggtatgggagggctcagctctgggagctgaacacatcaacaagctaatgtgagcttggggcatcccatcggcctcatttgatctcagtcctgggtctgttgaagagagaaaggccgagcactgggcttggcctcaagaaggtggtattttgttaggggagcgagtgaaggaaggggagaggtgagtagacttgagaggaagacgtgacctcagaaaagaccttttgagggccctgtgcactgtgaccataagcctcgctatcttgggtgacttttcagccgaactgaagaaagacccgcttccccagagtagacccaatactggtattagcgtcgcaatcatgtgactacttggaaggagtatcattgatttgaatgtattcatttattccatgttgcgtttgaatttccaatttagcttcaattttcattttacttgggtcacagcaaaaacccggctctctgagacatagcctgcagaagcagagctgagaaatcacacagaccacttagctcagcatcagaaatccaagcatttatttcctcgatgagccacagggctcagccggcttaaaaggcaactcagtagtgctgtggccggtgggcttcttgactggttaggagcccaggtgctattgatccaccatatgacttgttggttcaaagttatggtatttgggttacatccttcagagaaacttcatggctctgcagtgttcctgtgttcgtcatattcttacccactttgggcaaagtgcccacataattatcagggtgtaggtttatgttgaacgttggagaagttcacatctaagtggtttctcaggcagggcaattgcaattgcaagcaagtgctaacagcaaaagggctgaggtgttcttcataatatttgacactcacattccacagttcaataaatatttgttaatcacttgttatgtgcccaacgctgttgtaggttctgggattacagtgttgaataagacagggagagcccctgccctcaccttgcctgtattctaacacaatgctttccaaatgaagtttctaaaatgatggaaatattctgtactacccagagtggtagtcactggccacattagctattgcaactgaggaactgaatgtttaaatatattcaactttaatttaaatttaaatagccacaggctgggcacagtggctcatacctgtaatcccagcactttgggatttgaggccaggagtgtgagaccagcctgggaaagatagcaagatcccatctctactaaaaatctagccaggtctggtggtgcactctggcagtcccagctgctcaggagtctgaggcagcaagatctcttgagcccagaagtttgaagctgcactaagctgtgatcatactatggcactccaggctgggcaaacagtgagaccctgtcccagaaaaaaaaccaaaaaaaaaaaaaaaaaccacccagaaactaaagagccacaggtggccagtaactactagattgacagtgtggatctactttttaaagcttttcaatagaagtcagtcattattttctagtctcattgtttatttttttcagctggagggtggtgtccagtgacccaggtcaaggtggactttgagaaagtggtgaattccagtttccaagctgaactctgggggttttttgctttgagtactagtaactgcaggaaaagttctgtctgtatttacctggatggggaacttttgaaaaatgttgctttcttgcattctgcaggtgtgtgttgtgtttgtgtgtgcccgttggtaactgtcaggctttttgacacattgctgttgctcattttaaaaaatgatcttggtggggacaaaaaatgatgtcggcagtagagaaaacccttgtagtagaagcaggggtaattcatgtgtccctggcagggtcggtgacaataagggttttgcaacctgcctgtcatgttaattgtgtattattagaggccattaatctgaggattattaacatgatggatgtttaggcaatcgtcttgttgaaaactttaatctgaagatcagtgatatacatcagtaggtgtttgatgagttaagaaagaataagctacttgcttttacctagtggatccccaggatgtagtggaatcttcattttctgaggtgatcagccttcagttctttacaggtaaaaggggatgtgtgtgaggagggctgtggaatgccttctgaaaatgtgcaggcagagaagttctgagttgtatagaactccaagagttctctttcctcggttctcagtgaagtcccgcttgttctcttgtgtgtggtttatttcatcactcagacatccattctctttctattaagaagctgagatagttacctcctgtctcttggtgttatgtccgggacctgatctttgtcttttcttttgccaaagaccacccgtcatgattgctgatcgctcaaagagccgggatttggatgtgtctgctaatgatgtgtctctgagcaattgctgatcactcagagaggcgggaggtggatgtgtccgccagcgtcataggaagttagcaagcaggaccctctgtgatggtgatgttctccttaaccacccagggctgcttgcacctcagtgctagctccctggcagtgtggaatcagctctcagagctggaaggagcctccactggtaatcccatccaggctgggccccgatctctgcggtttttgggctctgaggcctttcaggttagggagatttctgcatgggcccagctatggggaagggctggccaagggccaaggggttggggggtgcatgcagctgatcacgcccctgactcagtcaggccctgctctgaccttcatgaaaatctcagggaatttcaagagagagaagcaagaagaaccataaagaaatgggaaacttgggtccaagagcatcagaggggaggcaaagtcaactcatatggcccgaagtaggaagctgcagcgagccacaagggaacaaaagggcttaaaatctggacacgagtttcgccatcgcaaatatgggagtggtgtggaggtagaggaggagggagatgaagaaagctgacacagaagcattttgaaggtggaagtagcataggacgtgccatgagagaacacacaatgtcccaggtgctaagggtctttaaacatttactggggtaggggcatggacatggctggccatatgccctgaaagaggagcagggttctattgccttgatggcccccacagcgggtttgtatgtgccatgtcaccaggcctgagcatggagtttcaggtagagtcatgtcagaagtgacaatggcaggctgggcgtggtagctcactcctgtaatcccagcactttgggaggccaaggcaggcagatcacctgaggtcaggagttcgagaccagcctgaccaacatggtgaaaccccatctctactaaaaatacaaaattagctgtgtgtggtggtgtgcgcctgtagtcccacctacttgggcggctaaggcaggggaatcgcttgagcccaggagatggaggttgcagtgagctgagaacgtgccatggcactccagctgggcaacaagagtgaaactcggtctcaaaagcaaacaaaaaaaaaaaaacaaaaaaaaagaaggagaagtaacaatagcagtaatagttgtggtggtagcattatgatcagtattctttaatttttttttaattttaaaaattttttgtgctcttgttaagagacagagtctccctccatcacccaggctggctggggtgcaatggttcatagctcaatgtaacctcaaagtcctgggctgaagacatcttcctgcctcagtgtaccacccaccaccatgcctggctaattttttccttttttgtagagatggggtctcactgtgttgtccaggctggtctcaagctcctggggtcaagcaatcttcctgcttcggcctcccaaagtcctggaattacaggtgtaagccactgtgccgggggtcatgcttcatattctttacttggctctcatttactctcataacagccctgtgaggtggacaaccttctccccatttcacagtcagagactgagacacagagggaagcgcttggcccagtgtcaccctgggcatctgcagcagagccaggattctcctccgcgcagcctggttcttggccatgtttttccccactccctgaaggatctagtcttgatgaaacaagggctagtcgggggccgtccgctgagctgtcctgtttgctgtgatgggaaatctcacagggagtttaccagaaatcattctcaagcttaactgacccctagctaagatccatctgacatggctcttgggagcagttggtcagtggaaccatctggagtcttctgatttgagtttcagagaaggagagagcgagcaaagtacttataacttaggagagctgtgtcctggagacaggctttggccagatggccgatcttgccatggaaaccctggggtgaatgctggggtggttgaggcagccagcccttcctcgggtgtgggaccaggaaggaaggcctctgtcctcctcctttcttagccttcgttccccgaatcccattgcgacccccaggtgtagaaagtgatgaacttccacctggcctctctgtccagcctctggcagaggggagacttgtcagatgctggaatcaaggaagacaacctagtgatcaagccaggctgaaaccacatgcctgcatagcaagcgagagggcagatcgcagaggccgtcccttggtgggcctggaccagatgctggaaggcaggagagtccagtcttgctgtggtcagtagcgatgaagggcgaggctgcagggtggggggtgacccttcccacccacacccacgtgcccatgcgtggaattggcattctacccagatggggcattcggtctccccctttctcctgccatggggtagcgttcgtttgcacatgcgatgtcggtttattgcggtgtcgacagcattgtggaagggggacgttggtgggtacctgggtaaataagtataaatagttttctttctgatatgtgaccggattattttccagttgatttcaagccctggccccaagtggcccacagatcaaaaaaagataagggtcagttacaaggttgagctcattctccgttgccatggcaactgacctcaggcaaccctcggaggactacacccagctccccaggtgatgtttttactgtccacaccatcaatcccaagcctttcaaaactcagactgcctaattgtcagggctctgttttgaagaggctctgggtcccccgtggggcccggttcaggctgccagagctcatttagaagcctttgtgaaacacaggggaccatacgatgggtcccttctgggcagaatggcctgggagggtgcccccagggggaggaggaagggcacagcccatcctccagcattaattaggaaaatgtgagcccaaaatgggagcagcgtggtgggctgtgccttcaagccatggctgagcggtcttgagtgaggaggacaccgaagggtggagagcccctggcactgggggtcggggacagccgtgatgcggggatggtttgggggagtgttagccacccaccgtcagagtctccagcagcctcttcaaagatatactcgcatcatttccatcccaggagtaaccacaggaaatatttttcattgctgacgatttttcagtcttttgcaaaatgtggacaaaaagtgactagaaaacttcctgccttttaagagatccttccacatagaatattggtcaaagcagtgggacagctcccaaacccagcttcgggacagcaggattccaacaatatcagcgtccctaagccccttgtatcgcgctcagtggttctcaagcgttaatggacgccccaaacacgggggcacctttaaaatgctgcagctctggggcaggcctgagactctgcatttctctcaagctcccaggtgctgcccgggctgcttggcagggaagtgggttcccgtgggctgccagagctgggggtgttggggctcccatggtcatcctccatcaccactcacctgctcccagctcttgcccagcctttgacaagggacactcctcagaccctgagttctcctatgaccctggttgactcccagcctaaatgtcactctctccttcccttcagcctggactggttaatttcttcatggcatttaatgacagatcaatagataaacggcccaatctggctgcccagatattatcacctgccctcctctttctgcctgggggtctttgtttcttacaggaaacaaaggacagagtctcccacagctcaggttcctagctcctgttctgcgctatttgtggttatctatggggatggtgtcggaggggtcctctcctggggtcaccctcacctcaccctcttgcctcctggcaagatttgcctggatgagtgctggggcctttgctcccatgcttcctctctccaaggaccatttaccgcgcccatttacagtgtgtgtgtctgagccccaggacctcaggacttgacctgatactagatgcgcaggccgcaggctgtccctggtgctgtggaatgtcagtctggggcatttatttctggggctggtagtggaggggccgcagcttggccaagcagcctgtgtattccctgccttgcttccacctgcagacacactcttggagagaggaggtgcagcctggactgtcccacgctgtcacatgcagggctacctcctccccttcctcagggaaagccccagccctgctgccaaccggcgcttgtgctggcgaggggaccccccaggctcaaacatggagatgcggagggcggctctgtcttccttctgaccaggatttttttgggtgatcagggagcaggggtggcttgctgggtcccaggttttaggtcttgtggctgtttcttgaattttctaaagccagagagggctgctgggggtgaacagcagggctgctgctgccccgctctgccctgctctgccctgccacatccctgttaggggccctgcctctctaagcgtcccttcctcttctgtcagctgagggagcctctccacgccctcagtcttggagcaggctgttgttccgtggggttccagaaagcgttactggagttgaggtttttacaagccgagtcctgtgagattaggggtgaccatgggtgcatagtgatggcatttaccagcactcccaccctaccgcaaactctgtgctaagtgctttacataaatcattcatttcctgctcgtcaagcgtctcctggtgccagatcctgttctaggcactggtgacatagcagtgggcaaagcagccctcatggagtttatgttactctgtctgtgtgccggagggagggagggacggagggaatgagaatgaattaaacaatgaaccctgtaatataccaggtggtagtaagcgctatccaggaattaaaggtgggccaggtgctggaaaggacgggggtgtgtgctgtgttagatgggggtctcgagtaaggcctccctgaggaggtgtcctttaggcagacccctgagtgtagtgagggaaggagtgtgggatggtctgggggtctcagcaagggcagatgtcctgtggccaaataagactgcttggctgccatacaaaagccccgtaatgactctgcctattttctagtggcagaagcagaagctcagagaggcaaagtaacttactccagtccacacagcgagtgagtggtggaactagggctcaaacccaagtgttcccggctctagcttttgtgtccttcattgccacatcctggatgtaggtggctagtcatgcccctagtcaacaccaggcggaagtcattggtcttctcctagacaggtgtgtgcattaatgatgccactctggggtcagctttcccgaggggggttcctgctaagagagggggtaggcagggactatccgttgtggctggagcaggtcacgctcagtgcaccagagcccgagaacaatgccccgtccacaccccgctgcagcccgccgctcctccctcccaggcagcaaattatggcctccgaatgtgtgcccaggcctgcctttgacatcagtggggcccacctgagcttcaccttcaggattctgataatcagctctctctcctcctggcttcccccaagacccgtatggaaataagtatgtgtctgccagggatcaaatgcttttggagacaaaagtcggtaccagggacattacagggagctatcatctcggcacgatgctcttccacaaagccctctgctcctcttttgggctgacacagtttcagcctgaaaggttccagcaggctgacttggttttaagcaaaagcacatcctattatttttttgagaaatgaagtgtaaaattaacacttattcctgagcagaggagggagaaaggagagacagggactttgggattttcctgcttggcgggttgtttgtttggcagtttgagtttttatttatttttattttttttaatcataataaatcaatagatttccttgtgccagcctcgacttatggggaacaggaggcaagatctgaatttcagcaggtgaaatctgcatttcactttacaaatgagcggggctgcataattcacttgagttgtgtgggtctgtcttatggatgcctgtcatgtgctattaaaaaaaaaaaaggcacagaaaaggaagggaagcaattgtgcgtcttaactcacaaaatcctccagtccccacgctggggtggaggggcctgcaggctcccagacagctttgtcattctgctccaaggtgtcggccgagcactgtgcgatcttatataattcaggaaagtgattctcggagggtgccactatcggcggaccctgcatcttggggtggaacgagaggttgtcagcgcctgcggggtgagagtgatggtgctagcaaattctatcaatatccatgggctggctcacattgggtcaccagcacgcaaaggagtgtttgtcacactaactagggcagcccctccccgccctctccacctccccggccctccccctgttttcctggatggtttcataggcagagatacacgtaatggacacccaagggagtacctctaacccctccagtggggagaaggcctcgtcttcagaaagatttgcaaatcaaaaggtcttgccttgagtgggagcgagtcccagctctgcgggaacccttcaggctttattccatcccctcccttcactttcactttttgcttgttttatttctcctcccctctttccccaggtttgactctcttaaaacacttgggggagagagaggaaagggtcccgagacacacagtggtctgttgggctcttgatctaattagcctggaaccttactttgacactggtttggggctgtgatctgcttaaatggtagccgtttgggccccggacggcttgcagctccagggctgcctgactgtgcacatatttatgaacatgggcgctgggtgtagctgcggctatgaatcaggggggaccagctgatgaattgctcggcactcggagaacggaaagtgactgtcagacatgatttctctgatttataagttgcaggaggcttctttgtcctctcggtgtttgtgtatcagatgggcccgtcgccattcacagccaagtggttaaaggcccccgctcggcagagagcggtaaatcctgtttgccgtctcagcccccagagcccctagctgggcagggagagagggcccagcctggggacgtctctcctctgtgagtatttccaagcccctcctgcaggcaagcccagaaaatctcacatggttacatgaatcaagggtcattgtgcctagtgagggagtagtcgtgtgtgtgtgtgtgcatgcacacgtgtgtgtgctcatgaactggaatagtcagggcaggctgcctggaggtcatgtacaatgaggggtacaagtcagggcaggctgcctggcggtggtgtacgatggcgggggtacatgcatataggaaaggttttgtatcctcttctgcaccgcccccatctggctgtgttacttgagtaaatggtctaattctccgaacccatttcttcttcccagaaatgcagttttccaagtaagctgggttatttctgagattgaaatatgttataaactattcttacagaaaactctgcacagttgtcaacctcacataccccctccctccttaatgtccacggggtgtcctcattctaataaggtcacatgtaagggtggagtctctttctttccttgatcctacaccctgtgccaggcactgggcaatgttgtttgtgcagggggcaggggatgcattggggggtcttttgaggcagccccccacactggaggccatctctaattatgatgaacgtctccccaagggaggtggaggacgtgcgtggggcctgcagggcgagcgtgctgagcctgccctgtgtcccaaaacttgtcaatgaattccttttctgctagtataaatggaagatctgtttgagtctctgtcgggtgtatgtggcctagttgccagggctccaggggcatgacaaacacccggtagattccagccagtgggctatgtggggcagacccacctgtgtgtgcacgtgtgtgtgtgcgcctctgcggtggggtgcccgggggtgcgggggatggctgggccagggggaatgcctgctgtctctgccagcccctgccagggcctagggacccagggactcgccaggagcctcagcccatctgtgttcatgtcttgccaccagcagaacccctctgctacctaattcttgcctttaagggcaaatcagagcacctggcgccttcagtgaggctggttccctgggggagcccaaaggggaacccgtgtccttggctgtcccagataatactctcaccaacactgacatgcctggcagtaaacacttattgagcacttgctgtgtgccagggtctgttccagacccctgtgcatgtattagctcatttaattctcatagcaactataacagaaaagctgttatggagtgtttcagacagaggaaactgaggtacagagaggttgtgtgacttgcctaagatcacccagtaaggggagggacggattccaaccccaggtgatgtgaagctcaaaccaggggattccccatccccaccactgacccctgggcccctctgtcctcctgcagcccgggaagcagggaggacaggtggtccccatcttactgcacatgagcttgtgcccacagcatgctgtgtggggctgaggagccagaatttgaacctgctgctgcttgattgtgagtgagggcaccagagctctgagcctcctcgacattggcaaggctggtgctcaggcactctgtgtcccccggcgcctttgggtgaaggtttggggtctcagcggctcccaggtggggagatggaggagctgtgttctggtctgaagcaggatggcgagtttgcctgttgtccatcatccactgcatagaccatttgtttaaaagaaaagcaaataaaaagagcgtttggtgcagtatcttccatgctgcccgtcagtctcgaagtaaaattccaaagtcctccaggggctgacagggcttttcttgtgcatccctgtggcctctctgacctcactcttggccctctgagctcaggcactgtgttcccatgctgggcttcaagcctgtccagcatggcatggacccacctcagggccctgcccccacccctctcctagagtgctctcgccatgtattcacatcacctcctgacactgcattatgtgctgatgattttgtttatcatctgtctaccccaccaccagagtgggggcagagacattatttgtttagttgcctaaataatccttagagcaaagtacctggcacatagtacatgctcaataaatatttgattggattttttaaaatcctggttggaccaccttctccatcctgtacctcatcctgggtgcctctgcacagtgacccagtcttgggactcaagctgttgaccatggcctgcacacctggctgcttgatcagcaggagaaatcacagcaaatggcacctccaagggccacatatttggagccggtcctctggggtctgtaagcctctaggggtgaggccatgtggagccaggatgagtcttggtgtctgcagtcccttcaccagccccggtgctggggattggaggggggttagtgctggggtctatgggaggccttgtgagcacctgtctgggggacatggcatgctggtcactgactggtcacgggttttccttgcagaggaaggcatcaaccacgagtgtaagctgtgcaaccagatgttcgactccccggccaagctcctctgtcacctcattgagcacagcttcgagggcatgggcggcaccttcaaatgccccgtgtgtttcacaggtaaggtacccagcttgtgcccctcaggggagagagatgaacacaggagccctgccctgttattgcgggatcccagtgtgtgctcttcctctttccttggcaggcctgttatagaccaggactccgttggggataccctgagggattaacaggccctttgccccacgtccctcagttcagagctgacacgcgccctccttcagtgctctctggcctctcctcatcagcaggctggttggcaccctctcctcgccctctgcacacaggagctagaagccctttgtccaacccagcctcaaccctctgcggcagttttcccctcccgggccctgtgtttgtctccccgagccttgagctctattcagcacttctggggctcccagcttcacatactcctggttcccccttccctggcctacctagctcccatccatgctccaggatgcaggggtcaagggcagctctgccggccaagttcccagcccccagactggctgccggcccaggcgaatggctgtcccagcccgaggcaagtctcaggggctctgccggccccctcctgctgcccagatggcagccggtgtgcgtgggagagcctggccttccctgcctcccccgacatctgctgtctgccacggcaggaagcccaccctggggaggacgcctggcaggagggtatctctgaagtgctcacctcccagacacacagctgctctgggccacctcctgggtgcgctcagggctggggccacctcagaactcctgccactgggaagccagggctagaccttctccatgccaggcccaggggtgtccactctggggcaaatcccccaaacacacacccctggggctccccagagcccctgagcaccctgatgccatcttccccctcatcgcaggagcccccacccatctgtcactgccacactctgaggctggcactgaagggccccagctgcccgtctgccaacccaggacatgggggcctctgtgtgggggcccgaggatgctgacaacaataaaaataggaatttgtgttggttgagcaacttcttgtacaagaccctgtgctgagcttatttaattcaagtctaggctctgccacttgctagcagtgggaccttggacaagccatttaacattcctggcacctcagttttctcttgtataaaatggggataatagcacctgtcctacaggcctgggaggggttcaagaagctcacccctgtaggtgtctggctgttgatgatggggacgaggaagacagcattcatttgtctgtggcaggccatcttttaagcactttatcaatatcccatttgatcctcccagccacccagctagggacatattataatcttcattttttgagtgaggaaatggagcccagagaggttaagtgacttacccagggttgcacagccactaagtaccggagctcagcttatctaacttgagcctcctctagtatgtgctaagaacactcccagtagcccactgtttggctgactgtacctatgccacagtgatccctgcctgcgagtgttgtgggggcagctgccacaggaggctgggctggtgtcctgagcttggccctgacagccgtgtctgtgtctagtcttcgtccaggccaacaagttgcagcagcacatctttgccgtgcacgggcaggaggacaagatctacgactgctcacagtgccctcagaagttcttcttccagaccgagctgcaggtgggtgcccacatccgctgcaccacgccgcctgatggtcctcggttcccccgtcagcaccgacggtctcagggttaaggcaagctggtggagtcttatgctggcaggtctgcaatcaggggctgacctcctggctagcaggcatggagtttcagccccctggcctctgccagcccagcgttctcaaaagaaccaactgccactggctgagcccagagcaggagtcagaagcttacatttgaggtgtttcgtggcaagtcctgtctgctcttggggattccaatttccctacctctattgtaaaatgatatttcactgagctttggttctgtggctagaagcccatgatgtctttgtggctgggtcctggggctgtgtgggaacaggagttaggtctggggccttggagcctccagttttgtccataaaagccagaaaagaagagtagtggtgcccgattgccccagcttagaggcagtcaccagaggtcctgagactgatgtggccctcaggtaagggacaggggcctcagccaacttccttgcatcctcatccccagcctgtggtaactgagaggaccttgggaaaggaagctggtgtgacggtcttcccaggcattcacagccacctgccttggaatcccatggggccccatttcacctgttactggtttttccaaggaacaagatctgtgcccaagtgaaactgctttctctcccactggtttttgcaaaaaattcttgcaacactggagagatcacatgcccaccagaaatacaacacacgtacacagaaaaatctcacattcactgtacctggaccatagcatcacacacacaaagggaaggtgcacgcacacagttcctatcacagtgtatatgcccagagatgtcacaaagagtaacactgcatccaccctgaggaataccgcacacatgcagcacaacactgcacccccaaaagaaggaccacactcatgtccacagatatatcacacatacacatagacggacatgccgaaatgtcacataccaagaatgagcctgtcgggaaggatatgggtaggttaggctgcaataacaaacctcctctcggtctctgtgtcctcaacaaaaggtttatttgttgcccatgtgacatatccaagcaggtgatggggaagagactctgttcataatattcacttagtgacccaggcccacggagggtccatgcccatccacgtttccgtagtcactgaggcagggagaagagggaggtggtgacttctctaccagcacttcaagcttcccctcggaaatgatgcacgccaccttctctcacattgtgttgactagagtaagtcccgcgggcatgcccaacctcaaagcgggtgaggcagggaattccaccctctgcctggaaggagaagggagccctaaggactcacacacaccagtttggccctccaggggggaccctacacacccagcagcaccctccctcatccccatgccactgctgcacctgcatgcagcaatctcccacatacccaggttacaaggctggggccacttacaccatgcagagtcacttgaatggccacagtggtgcctccccctctggggttagaggggcacagctgtggcctgttgtagggggcccccttcttactgtgctgtggcccacccacactgccaggcctgggcccgcctgtctgcacagctggtggtggctgttgcctggaggatatgcaaacaggcccttggagggtgtggggaccggggggattcaccattagatggtcaagtcctgtttccataggctggccccatgccagggctaggtaggctgagctcagggctggccccgaggagcacccagctggtgtggtggaaagcctgtttcttttcatccttacggtgctcataaatttgtgtattgtacatgaggcctttatcccattgtcacaacgtgggacagagttatgaaaccaatcatacagacctggcccagagagggggttccacttccaaaaggccaccactgagctagtgacccttaccatgccactgctgtctccccattgatccacaaactgagctgatgtctctgtgcttaggatgtgtggggcgacagctaggcgttgatgccatccaagaagcctccctgctcgtgtgctggatgcgcaccctctcccaagtgcagtccatgcagccgccttatcctacctgccttacctgagtggcccagctaccaaaataggcctgggtatcctgacagaggaggctttctatagcccaacaggtcaggcctcttttaaacccgtgagtgcatataaactacgatttatttacactttgaacttgctcagctcctgcctggctcgcctgcattgtcccaaatgccaagaggtctcttctctgatggcctcaagattattcccagagaaggtttcccatcctgacgtttttgagcttcattggtgtcactgggctgggggcctagctcataagtgcagaggtggagggaggctgctgctttcaatctggatcttgcttcgatcccacctatctcgagctgtgggccacacttgacctgagagcggttcatgtgagctggtggtttcctgggtcatcccgttaagctttaagtcagatcctcaaatactgagaaaccgctaaattacagccttaacgagtcactattttctgcaattaatgattttaattatagaccgtttaaatacggaagtgttgttgcaatgccaaatctatgcaaataatggctctcgttaagtaacttgaatagcaattttctcgtttttgagaggagggtttttcaggcattggagtgttcattgtccctacacagaagctggggctggaaggccctggttgggtggaacaggcaagtgtgctgttgtttcttggaatgagctgggggtttgggtggggcagtgggaggcaaggccagctggagttctatccttgctggtttcttgtggccttgtgtagtttgaggttatgcacggaaattccaggcacctggtatttgcaggcacaagggactatgggctgagaggtcttgagaagattctaggcttaggattgagctcactgcaggaccaggaagtgctgctgcaggaatagaagtttaggaggtagaactgaaccatgacaggcttggtctctgtcaacattgacatgtctccctccaaacgtaatgttttcttaggttgcgttaacaggagcacagttgccagtataagggaggtgtgagtcctctttgattccaagttcggagggctctgcccaaaagactgagattaattcaaaggagtttagacaaactgttgcaaattcacaaccgaataattaggaacatgagagggaactagctttcctattcatttgtttgaagcaagtatgtggagggcccatgatgtgccaggccctgtttctagcacctgagaagacagtggtgaaaagatgaagaaatacccacggggtctgcattctaggggattgatgggcactttccaataagagccaatgacatgaaaaaaataaaaccaaataatgggctagagcatgctgggaggttgaagtcagacactccttggtaagtgtggtcagggagggcctccccgaggaggtggcatgcaagctgaggcccgatggcatgaaggcagtattgtgtggaagagagccgtgagtgcaaaggccctgtggccactgggtgccagggctaggatgacagaaggcagagtgcagctgaagcacagtgaattggggcagaggcagtggagcccagatcatggcaaggttttcaggacagtgaaggactttggattttatctccatcatgatgggaaaccaagcaggggacagatattatctgatttacaccctgaatcaaaatgtaagaagtttgcttttgaaagacatggttaagagaatgaaaagtcactgattgggagaaaatatttgcaaatcacatatcgaataaagcacttgtatccagactatatgaagaactctcaaaactccataatgagacgggacacagaacaactaaaaaatgagcaaaaatcttttggcagatgtctcaccaaagaaaatgaacatcattagtcattagggaagggcaagtgaaaaccatagcctgatgccacccacataaatgaaaaactcacaatgctgagagttggtgagggcgggataggaactttcacacattgctggtggcagtgcaagatggtatggccatgtgacaaaatatttgtcagtttcttataaagttaaacgttcatttaccgttagacccagtaatcccactcttagtgtttacccaagaaaaaaaggaaaatttacactcacaccaatacctctacatgaatgatgataacagctttgtcatggccccaaaccggaggcctgctcgttgtcccttatttggaggatgggtaacagatggggtcatgtgttacattggtacaggtcatgtgtacattctcagcagtaaaaggcaactgcagatacatgttacaatgtgaatgaatcttgttttgttttttaagtgacagggtctggctctgtcacccaggctggagtgcaggagtgtgatcatggcttactgcagcctcaacctccggggctcatgtcatcctttcacctcagcttcctgagtggctgggactataggtgcacaccaccacacccagctaattttttaattttaacttttaattttataggtggggtctcatgatactgcccaggctggtctcaaactcctgggctcaagcaatcctcccgccttggcttcccagagtgttgggattacaggcgtgagccactgtccctggtgccatggataaatctcaaatgtcacatgacaaaagccatactcaaaaggttccatgctgtatggttttattgacatgacattctggaaaaaggtaaaaatatatcgccatagaaaacagaccagtagttgtcagtggctgaaggtcggagttgcagggaagaaataggggagacttttttttttttttgcaatggaacatctgagttttgtgtaactgatgtgaaagctgctgatttagaatactgcagcaataagactagatattgctttaaaggagaatgcagagatagggacagacagtgcgcacagttatttggaaaattttctaagtctgctagtgttctgtgtacagaaaaagtgaattttctaaatgacaaatttggaaactgtggttcccgttgtcatttttatgatattctttgtggaaagattgtcactggacacattcagaaacagtatcaatgacagactttgatatacaatatacttaccttgggggtcatgtatgtttgtctgcacatgcaagaaatggttcaaaataatgggggacctatgcagaagctacaagtgcatgtggtcaacacaggttatgtagattccaaggatgcaaatatcttagtgacataaatataacaagatataacataaattgcagagagaatagggcttgcaatgaacttttccattgtcagtgtgatcctggttatgctcctccagattgtgagccgccaatatcatcaccaggaggaagtgttaatgatggattttagcttacggtagaaaaaagtgtaccttgtttccaaaacgacgtgctgctcctaaaaacaatggtcttttgatcagtttctacatttcttttttacctttgctcattttaattgctattgttagtcttaaatggaataaaatgaagagattttggagcaaagcgggaacagtaagcagcatatctatctcagaagacagcagcaggaacaacaacgagtcacagagttaaagtagcccaagtgataacttcgaagccatagggtggagaaaggatattaccaagaaactcaccattaactggcctgatctaacaatgaaaaaaaaaaagttttctctcattttgttatggcttaaagctttcaatttcacaaaacaaaataaatcctatgacttgaaagcaagagaaaaagaaataggggagactaagctttgtccatatacctgtaccctcacccacatatacacctgcccacgctcaccccacaccttgaaaacccaggcagtaggggatccagtctgacctcgaggtgcttccaggagtctgtcctaagtctgtttaaccaggagaagacttggatggattgcagaagaaatgcagggacagttgtcttcgagcattttaagaactctgggtcctggaggggttcttattgcttcaggtggctccaagacttttggcagtgggcgccaactcagaacaggggttttggtcctggatagtcatggctcaggcatcactctctgcagttggcgcaagctagaagggaaattaagctgtagggacatgagtggattttggatgctaagagcaggaagcaatgttgggtttttggcagccctattcccggagccaagtgtcacttaaataaggcagctacactctgtcttctctaagactgcctggtccctgccttctgcctctttctggcttttattgtcctctctctctacagcctgactttctgggctcctctgtacaaggaggaaggtggtcaaggttccacagctcctgtcaattctgctaagacagacaccctaggtagctcaacagagaggatttagtgtgaggattggtgacacaggtagccagaaggaacacccaggaaaccccagagatagtgacagcggtggcagccagccctcaggcaacaggtgctagatccctggagggggaatctggtaggtgagcctgggtcagctgtccaccctgctccagtgagctgtggctgggggtaggatcatatgatacaaaccagcaagttcagggtgcttttcagggaaggggtgcatgacctggatggacactgagcatttgcagtatgcgggaaaactgtccagaaatggaaagtgctgaggtccctgtcggtagaagtgtgcaaacaatgcacgtgtctgaaatgctgccaagagtgaagcagggagcggcccagtctttgtgagggcagctccgtatttaaaaccttgctctgtcatgcaccagccgtaagcctcagtttccttacctgtaaggcaggggtgtgagtagttcctacttaagagttcagttgcaaaaggcccttggcacagtggctggcacacagagcatgtagcagacgctgcctgtgattattattgacattgacttctgggcagtttgaggatcagatggctttggggattccctctccttggagtttgctttgctttcatggtttccagcctgagtttgaacaaagtgagactccaagtccttccttgtgtggcatcccaccaagcctcagggctgtgggcacaggagaccccacattggggcattgggaggagccaggtgcccagggcagtgagacggggcataaagggcatggaatggaggccagagggccggggcttcgggtcccccttcccctacttctctgagcgcctttgacctgggctcttttcttaggaccctctatttctgagccacgtccgggcgccgtggagggtggtatgtagatttgactgggggtgcaagacagcccgcaaatgtcagagctgttggccttgcattcccagcctcaggcctcagcagatgaaggcctggggccctatcggccccatgccagcggttagccaccctgaggggaggggtcgcctctgcccaccagcccagctgtctctgcatccccatgggcacctctgtgcccacagacactgggcacggatggtgcctccatctccccatcctaagagccttgctgcttcctgttcttcatcctcactgtggggatgcgtgcatgagggtcatatgcggcttaccagccatacagggctggagttagacagtggacaagctcccctgaaattgtaccagagacaattctcatggccttcacccctgggccctaggtctgtgctgcgggccaggctctgttctgagcactttgcatggattgtgtacagccctatgaacaaggtactctcatccccatttacagatacagaaactgaggctctgagaagttaagcggtttgccgagggtcatttgcaaatggcagagccacacataaagctggattgtctttgccaccaaggcaaacagaaaccctccaaagtttaaataaattgccatttatatgagctaatagatttaaatgaggcctgcagtgctgaactataaaaagctttcgttgtcaggggacccagaaactattttagtagttgggccaagcaggtagcacaagtagcagtaacaggggatgcaagaaaaattgctcctgggtgagcccaggtgggaacgccatggggcctgtgcgcgcggggccagggctgtgcatggccacgtttgccaggctgcagctcgaggccaggaccctgcaaaccctgttgcttgcaaatgagcatcaggatgggtttggcttaggctgggcttggggagaggaaggattcattctcgtcacggagatagggacttcctaagacctcaggttcatggtgctgccacctttctcccctttatgacttgcttggtcctgtcatgggggaatagaacttgaactagagagatgtctttttagacatagaacttctgggatcttggagctgtggggcactgcctgccagggcatgtcagagttcacagcgcgtgtatgtgtgcacgcacacatgcacatgtccttgatgaagatggttttggggtgttggaccagcgccacgccctggaatcttgactccctcattgacaaagccaggggctgcaggaagtgattccgtgagccgggcccgcggtggcaaagcggccagcccagcgttgagcgggcgcatttaaaggattagctcatgctgtttgcttgtgtgtgcctaatcatgctgcttccagctaaatgattacaattgattaaaagcagagctaggtattctaacaagcaacccggagccctttcgatagggtgagccgggctctgccaggcagggtcctggtacccggccagagggagagctctctgagacaggggcgggatctcagctcccttgggacccttccttcctagcccttgagaacatttgattcagcccttgccctgattccatttactgagtacctactcccggcaccacctcaggagcctgagacagaactgggaacaaggagacagggtttctattctcatggagctgacatgctttgggagacactgatgataagtcagtaaatacatgaactaggggatttcagaatgtgaaaacgctgtactgtgatggagagtggtgtgtgtatgtgcatgtgtgtgtgtgtgtgcgtgtgcgtgtgtgtgtacgcatgtgcgtgtgcatgtgtgtgtgtgtgtgtgtgtgtgtgttgggtggtcaggaaaggctggcatttcagctcaatcctggaggttgcagagccagtgtggggaagagctgggggatcctccaggagagggaagagccagtaccaagtatctgaggcccaagcagatttggggtgttctcagaacagaataaaaaggcagagggactagaggggcaagcaggacagacggccactgccttcctgcattattctcctgggctggcctcgcatcgcctacccagtgagatcaagatggggcttcctagatgcacgtacacctgcctatctgcctgcaggaagtaccctttctttctcttaatgcatcagcccagctccagtgcctcctcccctgagaagcctctcggattctccttcctttggtttctccagcccttggtttaacccccctgattccgttggccatatggattgtaagtcactacgtctacaccaaactctccactctgacgtgagtttttggagagtgaagacaccctttgccatccgtccgtccatccatccatccatccatccatccatccatccatccatccccatatgtgttaacatattttttgagctcctggaaagtcggaaagagaacacaagcaggaaaggaggaaaaggaagaaggggaaacccacagattccgggagcccatttttaaaatccctggtccttataagatgggtaaccaaagagccagtttccttgtctctttgtactgctgctgttggatccagccagataattataactaataataattaaaaatcaaaagtgctctaggcacatacttagcatttgactctggctgcgctttctgtgagtagcggcatcttcctccttcctgctttagagatggccccatccttgtcaacctgacttctgctgggagaccagggcccagatgggtgtggcctgaagttgctggctgacacccagtggtggttccagggagtgagaacctgttgctcacgctggagtcagccacttgtgaggccaggagcctggggagggctgagagttgggctggctgctgaccccccgaagtctcccaatccccattattttcttttttatttttttgagacagagtctcactcggtcacccagtctggagtgtgcagtaacacgatctcggctcactgcaatctccgcctcccgggttcaagtgattctcctgcttcagcctcccgagtagctgggattacaggtgcccaccaccatgcctggctaattttgtatttttaggagagacaggggtttcaccatgttggcgaggctggtctcaaacttctgacctcaagtgacccacttgcctcggcctctcaaagtgctgggattacatgtatgggccaccgtgcccagccgcccattatttcctactgcagatgttgtatttctctgggctcagtttccacatctgttaaatggggtaagacctgctgcctcgggttgttgtgaagatggagttcgcatgtgtaaagcactttatagcacttaggatagaaggattgctgagggtcattgtggcccttttccaataggatcactttatgcttcctgccttccccactagggtaggaaaccagagcccagcacagcctgaattctactgaatgtgaccacatgttgtggcgatgccatgcccatgctgtggagctcacagtctggcctcagatgccagccctgccaccaagcagctccatgaccataagcaagtcaccggcattctcttgctttcaagagaccagggttattgaagagcccttctttgtttggtactggggtagctgaaggcagtgatgcctgaaaagctcccagcattgggtctgggtcagagtcaaaggttggtgagccctagtcattgccctgcctgtggtctggaggtggtgggctttctgttaatgcgttcattgactcattcaatcaatcatgtgtggacgtgctcaatctagcctgcaagtgtttactaagcacctgatctgtgccagctgtgcataggtgctggggacaaacagaggcatagactaagcccctcacatgttgcagggaggggaaagtaagctaataaggacaaacagaatttttgttatgtgtttgtggaatataatataatgtgatgtaatatggtatagtatatagtatagtatagtatagtgctgcatcataccatatcactcatactacatactaaatacaacataagtgctacacaaaacagagccccacagttgggcccccatgtgacattaaggggcactgtggagcctgagctttgcccttgctccctgtaagttactgtgttacgagcacagttggtctgtgtctctaagccttggtttatttactgtcaagtggggcaagggtgttcccaacctaataaggtgtggcatcatcatcatcatcatcactgttgtcattgacatgattattattgctgccactactggaggcagctgtgtctcctgaggggccatgtgtggcagtttgtggtctgccttgggagaagtctggggtggacactgacaacactccttgtccttagaaggcccaaggcacaggcctgagcccctcaccccaaagtagtacaaatgagacagcatttcctgagtgcttactgggaacctgactgtaagcccttcatgtgggtagcctcttaggacctcacgcatgaggtccatgtcatagatgggtaaactgaggctccccatgtggacatagctgccagcgtggagaaatgtgaggccaggcagtctgacatgagtgcctgtgttcgcagcctgcgggctgaggcagtggggttggagatgactctcaaagcccttagaagccaagggtaggtctctgggtgcagggtctcgaagtgggcctcacctcccagcgaggcaggcgttctagagggtgacatggaggctgcatgcagctcccggggcatgatactgtcgctggtctggacagccctgggtgagcaatggcttctccctggtcaccacagaggcgcagtgaggagcgggcaccggaggggtagtgttgaaacagaagtctgtgtccagctgtgctcagataccctcgtgagccttgagggtcagctcgcctgagcaatgaagtgtgtggaggcccaggtggggactggggggcctcccctcaaggcccagctccaggcagagatggcacttggaatcagcctccggctgcccgtctgcccattggagcctgtcattcatgccctagggcagggggccaaccaactttagagggcaccatgccatctcgacagatgggcacgggggagctgccaggagcctcaggccggtggccattgtgtgtgtggcgagccgaacccctccccggcgctgcctcagccgggaccacatgccttcagtttcttagtaacagtgacaacactgcgagtggcggcgcctcaccggctccacatccacagaggtttgcaccctgtaagccctgccccgcattgactcagacaaagagggagcctctcacacgggaagacatggggccttggggcctgaggggaagaccccagacatagacacagacacagacactcctgtcagaccacctgggctcatagctctgctttcctggcagctctgcccacatggggagtctcagtttacccatttacaacaaggagacacactcatgtgaggtcgtaagaagctactcacgggaagggcttgctgtgaggtccctagcagcactcaggaagcactgcctcatttttactgctttgcggcgaagggttcaggcctgtgtcctgggccttctagggacaaggagcacagtcaacgtccaccccccagaaatgaggtttgggggcctcagagttgctttgtcaatgtgaccttgggcatgtgacctccctcacggtgactcattgtcgtcacctggacagtgggctgccagtgcccctcttggagggttactgtggggatgcagcatcatgcttgtagatcatcgagcatggtgcctggtcccctaggaaggccacatggaggaggcaacatctgaggtggaattggcagagttgatgtggatatcactgtccctctttcacagatgggagaagcaggctcaacagcgagtttaagccactcgcttgatgtcgtgtcccacggctggtaagtggcagagctgaacctgcaaccctggtggtaagaggcaaggtgaaggacgatggtagcaccaccaccaaccaggcactaagggaatccttttgccttgatttttttcccattctgagggcaaacctatgaagccagtgctgctgttatccccgtttcacaggtggggagactgaggcatagttgggcagagatgagatttgaacccaggcagcctgaacatacaaccattgtcctaacaccaagggcaggatgttttgtgttactgaactccatttgtgtcagaactttcttgatacagcagcctgtgatcctgacttattgggagcggggatggctgcctgcatcaggaggctggggtctggcatggctggggatgtcttagcccccatcaacgagagaccagggtgctctgggtggaagcctggattgtactctttggtcaagcaggaacaattactaatgacatttacaaagaaattaatgatgagaaatgcaagttggcatttcaggagcacccgtcagcagccgtgcgccaatactcataggagaggcgaggtgctgggggccgggcatggggaagaggagatggcagaaaattaattttgctgtgtcaataatgtggctccactcattctgcttctgaagtttagacagaatcaatcatggacggactggggcttgtccggggctgcattgagattcactgtgtggctgcaatatgagcaagggaaagtgacagtttcagtttggtgtctcctttaggcgtcccaggggacagcagggatgggagtggcaggggacagtgagagggaaggaggtagtcatcctaggacagggccatttgggctaaaatctatgtaccacctcttaccagctagacgacttagcgagccactttgcttttctgagcctcaatttcttcatcggtcaaacgggaacaactgggagaagtaaagataatatataaagagcagagagtccagtttctgacacatggtaggagctcagtatacgggagctgttgccttatttcacggttgtattttaagatacacagctttcctccttagagcctctcttacattaagttgcaatacctcatttgtgtgctgtagtttaattggtcatattttttgtttgttgtgatacataaaatactggagcatcttatgctctttggggttctagggtaaataaaatacagcgttggtgggaagcgtggtggaaggtgaggagcaagatgctaaaattgtctagggcagggaggggatttccagtaggataaggaaccatgcctgcccctgccctccctgacttcaggagcatccagaacaatctaacccggtctctcctcacataggggagaagggacgcacaaggagaagtcactgtttttataacattgaacacttttatagagcagagggtgaaaactcacagtccatggcctggggattgtggaacttttagagggttctctatattctattttcacttttttttttttttttttttttttaagaaagagaatcttgctcaggctgcagtgcaatggtgtgatcatagctctctgcagccttgaactcctgggttcaagcagtactcccacctcagcctcctgagtagctgggactacaggtgcacaccactatacccagctaacgtttttattttttgtaaagatagggttcactatgctgcctaggctggtctagaactcctggcctcaagcaattttactgccttggccttccaaagtgctgggattacaggcatgagccatgcgcctagctggttgtctgtgttttaaaacagagaatttccatcatcataaagagtcatttagctagtgctttttgagtgcccggcattgttcttagcactggtaggcataaaaacatttgatcctcacaatgcctctaatatgaagacaagcaaaatgaggcacagagaggtcaactaaccccccaaggcctcagagctggttaatgctggacccaggccaccagccccggcttctgtcctcttcaccaccacactaaatggctggatttattgatttttctataaatcaggcctggcagcccctggccgacatttctgtgtgacccctttggatactgggatgtgcttcctggttcaacacagcccacaactggccttccttacctggcttattaccaacttgcactgtgagtttgtaaccccgttgaaacacttcacagtttgcaattattatctcattggtgcctctgcaaccattgctgcctctgcaacattctaggggccactagaaatgctcttgactctcaccattttgtagacttgaatacaggcttgggacctgggcattaaagtaggatactggcagagagaagtggggcttgtggtgggagttgtggaatgtgttctactcatttgggtttgagtgtttgagcggaggaggcaagtgaggctctctgcttcctgcacagtgaccagtttcccagctgaggccacacctggaggtatagtctagacagctgcagccctgacctgtggcgccatctttgtttcctcatctttgcctcagaagctgccacatcaaaaatgtggtattggccaggcgtggtggctcacacctgtaatcccagtgctttgggaggctgaggcaggagaatggcttgaggtcaagagtttgagaccaggctggacaacataatgagaccccgtatctaccaaaaaaaaaatgtgggatcatccatgttttttagttgacagagatgacaaagccctgtggttagtattagttatgaccctattaagtgtccatacagcattttacatgttataaaaccttttacatatgttatctaacttgaagcttctaacaaggcaatgaggtagatattattagtcttacttttcaggtgagtgaaggagtgcttagagaagcgagtgacttggctagggtcagaaagacagtaattagccaaggcaagatttgatctccaaagcccattgtcttctcatcaactcatcaacgtttaccgtcctacccagttatttattcatgcactcctcttcctcccaccattcatccattcatctacacatttatccatccacccaccaatccatctactcatccatccactcaccaatccatctactcatccatccactcaccaatccatccacccatccatccatccatgcatccatcctctcatccatcctccagccacccatccactcatccatcaatccatctgtctatcaatctatcacctacccattcgtccacctacccatctctccacctatccatccactcaccaatctgtccactgatccttccatctatctatccacccacctttccatccatccatacatctgtccatcacctacacaccatttcatctatccatccatccatctattcattcatctacccatcaatctgtcatccacccactcctccacctacccacctatctatccacccacctttccatccatccatacatctgtccatcacctacacaccatttcatctatccatccatccatctattcattcatctacccatcaatctgtcatccacccactcctccacctacccacctatctatccacccatccacccactcaccaattcatccactatccatcttccacctacctattcctccatctacccatccatccatctgtccatcatccgtctaccatccattcccccatacccatctacccacctatccatcatttatccatccatccatcatctaccatccatctccctatccatccagctacacgttctttcaccatcatcaccctccagtattgagtgtgaggtacgtgtcaagaaccacacagcttttcggatgccttcttcgtgtgctcttaatttcacacttcactcttacctatccctctccttactttaaaactgtgcatatacctacacacacatacacacacacacgaaagcacacacccctctggtgagatgagtgggatgggacagactggcgatatagataattcttggtttgcattatgaaaaccagtgacttctgcctggtgatagaagtggggggcacagggcagacccacttgatcattgtggggcaggtatctgggcagtgacaatgtgcccactgtttggttggaggctgggtatgtatgagagggcagacgaggcatttgaggccaggccacagcattcttcagcctcatcagtgggaccagcttccaaagagtgggcagcccatggagccctgcctttctgggtgacgggatcaccctttgctgggtgccaggttggaccccctctctggactggcaaggatgtacacctacgtgtttcccaagaaccgtcacaatcataaagtgtaatcggtctcagctgcagttttgatcactggtgcgtgcacacaatttatcacagcaaattaggtccatccttacaagcttctgccctgcagcctgggggtctgtcagcaagggggctgggccatgaggggctgggggccattcttgggggttgatgggccatgttttctgaggaggccccctcagaatatccgccagaacagttcttagtctgtaggacttaattttctagaaattttgaggatgcaggaaagttttccttttaaccaaaatttggaagaaagtaaaaatggacacgatcaaagtttccttatatcatttgcaaatcctaaaagcactgggttagtttggggacctgaacatatgtgttctgtataattagtgaccgtgtgacctagattttccagtacagtcctgatttcaagtactccatcccagctcttggctgtttgtcctgatttttggtttgtggaatatggtgactctatgtggatcttggttttctcatcatattttgatgaataaatatttaaagtggtaaaggcttgcagagtcagaaaaaattttctcccacttatttttttccaacctggcaaaacatgtcatgtgtaggtgtgccctgtgctcaccttcctgcctcccacctgccctgccagagcaaacacagacacttccttcctgcagcatttgtaagccatcagggccccctttgctggactggcctatgactgcaggtgaggcctttccataggggaaagagctcccagttccacaagtctcttgaggtcttctgttcttccactagctggcactgggagccacactgtagacaacagtggatggctcagccccagcagcacagagaaagcccctctgcttgcactcagctggtggcatgttgtcctgggatgctgtggctccctcccacccagctgaggatgtctcgggctgctatgatctgtgcaccttccagccaggaatgtcgctgagtgtcttagctattggtgcagcaaccctttctcttaccttctaagatcctgcccacttttttgttgttggtggtggtgacagagtctcattttgtcacccaggctggagtgcagtggcacaatctcagctcattgcaacctccgcttcctgggttcaagtgattctcctgcctcagcctcccgagtagctgggattacagacacacgctgccatgcccagctaatttttgcatttttggtagagatggggtttcgccatgttggctaggctggtatcgaactcgtggcctcaagtgttctgcccaccttggcctcccaaagtgctggcctcccaaggtgctgggattacaggtgtgagccactgtgcctggcctgtttttcattgtaaaaattcacgtagcataaaatttaccatcttaaccacttttaagtgctggttcagtggcattcagcacattgacactgttgtgcaatcatcaccaccatctacctccagaactttttcatctttcccatctgaaactctgttcctgttaaacattaactccccatttccccttttcccagcccccagcagccactgttccactttccatctctatgatttggctgttttaggcacctcgtacaagagaaatcatataataattcattccacctggcctagtgtcctcaaaggatccatcccagctttaagaaaaaggtataacctgctctgggcatggccggggcaagggttatggggaagacagtggagcggggcaactgtattttttcttcttctcccttgaccctatcagtggaggcctggctttgctacagtagcttgcaggctgtcatttcagaaatactcgttgagtttttaccaagcacaggctctgagctaatggggtacagtggagagctgagacaaggtccctgtcttgttgcgctgatggtgtcatgaggggcagttggccatggtgcgtcaacaaccaggtcactgcaagttgcaggacatgcagagttgaagcctctgcaaggtgcagagcgatgttgtgatgggagtctgtggtcagcggacaggaagcctgctccaggaggatggctccgatgtggagaagccccaggaaaactggggtgtgggggacactctggatagcgggagtgctgctgggagggggaggggcttccgggctgcggtgtttgggggcctggcagaaggtggtggctgaggctgtgggccagcaagaaccagaccatggagggccatctgggctgtggtcagagtccggatgtgttccgggtgtgggtgggacccgccagggagtttaaaaagcagaaacccttctacagctctgcctcctcgaggagacaacccggactgtgcttcacgttgttttctcagctttcctttgccaggaagggggccttcaaggggcccttgcgtcctgggcaggtggggctgctggagggactcagcagtggggtgaacgtggggcagattagccgcacagggtagacagaaggccaaagtaaaagtaactggcctctgaccgcttagcactacatggttagtgtcaggactggggtgtgtgtgtgtgtttctggggggggattcgagggtatccatgagtgtgtacctgcatggggttgtggggtgtccatgagtgtgcatgggattgtggggtatccgtgtgtgtgtgagtgtgcatgggattgtggggcatccatgtgtgtgtgtgtgtgtgtgtgtgtgtgtgtatgcgtgcacatgggattgtggggacctatgtgtgtgggcacatgggattggggggtatccgtgtgtggggagggtgggcacatgacgggggcaggtgtgtgtgtgtgtgtgtgtgtgtgtgtctagagtatttgtgtgtgtgcatgcatatagagtggtgtgtgcacagtaataggaacgctgccttgggaggctgctttcgtaagcaccccaaggggctgcccctctaccatgcctggcctctcctattccccatgggacactgtggagggtagaagggagggatctcaggtcctttgaagcaaggaaggtgtgggggttacttatggtccagatttttgaatgcggtcatgtggcaaactctggcgcttgtctctccagatagcccacggacaacccccgagacagccgtgttgagcctcctgggtggctctaggaaagtgggagtttctggtctccttacatgctccttggtctcccaggtttgccagcacctggcgcacccagaaacacttgggctggctgggtgggaatgcccatgaggcagcagaacccaggacatatggatggttctgtcttaacagaacttcatcttctacccttaccctctttgtcagaacttaaccacaccgagtcccacatcccagccccttggctgaggattcaactaatgttgggccatctgctgcctaatgacaccactccccacctcacttcagggtgtctggggcttctcgaggccctcaccaaccccagaggtctcaagctggtggcccgagggccagattcaacctgcagatatgttttcgtgggcttgcatagtactttaaacatcaagaaagtttatggatttattttacttccgttttcccccaacttttattttagattccaggaatacatgtgcaggttaattacatgggtatattgcatgctgctgaggtttggggtatgactgaatgcatcacccaggtcatgaacatagtacctcataggttgtttttcaacccttgtcccctccctccctcccagctcttttattccccagtttctattgctcccaactttatgtctgtgcgcaccacagtgtttaactcccacttatgagtgagaacatgtggtatttggttttctgtgtctgcattagttcacttaggataatggctgctagctgcatccatgttgctgcaaaggacatgattttattcttttttatggatgcataatattccatgatatatatatgtaccacattttcattatccaacccactcttggtgggcgcctgggttggtttcatgtcttcgctactgtcaatagtgctgcagtggacatatgagttcatgtttctttttggtggaatgcttattttcctttggatgcatctgcagtaatgggattgctgggttgaatggtagttcaattcttagttctttgaaaaatctccaaactgctttccacagtgtctgaactaatctgcattcccaccaacagtgtataagcattcctctaagaaagctgatattttaaacaaatctaaatttccagttttcttgcaaaaccggaagcaacactgggcctatattcgcatgtggcagtcattgcctagagctgacaagtgctgcctcttcttgacaaagtttgagttcttggggctgacacagaccccactgggtcttactgctttgcacctggcctgtgctgcacttgtccatggtgtgaacctgacagcacccacactctaatcttgaggcctccatccagacatgcagttccatgtggtcagaggaatcctccccactgcagacagatctcctggaattcacccgctctttttcatgacataaacattttctgagcattggtacccctgctgacaggtgcttccgtcttcccaaactgcttcacgtgcatgatcttctttgacccacactaagagcaacagatatactttgaagtgaacccttttttggttttgagaacccgtccacccaatagccttttttttttttaaatgaggtctcaccctgtggctggagtgcactggcatgatcctagttcactgcagcctcaaatttctgggctcaagtgatcctcccgcctcagccatccgagtagctgggactacaggcacacgccaccacacccacctaattttttttttttttcgtagagatggggtttcacccaggctgatctcaaactcctggcttcaagtgatcctcccacttcagcctccaaagtgctgggattccgggcatgagccactcacccagctccagtgccattttttatggagtttcgtcacttccaccccaggctcttctcaaggctttgcaagaggtgcacttgactggattcctggcccagcagcatcagattggggccccatcttttaggggtctgattcaggctcttttagggcaggggactgtgcactaattcatatttgagatgagctgtcccacgggggcctggtttcaagcaggctgctgtggttagaatggagtttgcagtggccacaggttgacaagatcagtgcagcatttctacccaggagggggccaaaggccacagaagtgaacttgtggtcacctggcacactgttgctaggacccccgattttcagtcctgaatctgctgctaggtaccctgtccccaaggggcttagccacagggtacccccaccttctttggagaaacagcagcagtaggtgggggtcacattaactcaggcctcagagtcaggcatagactctgttgctgaggaggagcaagtctataagcagccctggaagcattccatcttcctttgcttgtgacaacagccataaaactctcattttcccttgcacggctgctatctaaagtctcaccgctcacccaattctctgctcacaaacagactgacggggcccatttgcattctgaagtgcagctcccctgagtcccctgtccctccaggcaggtattattagtccccttgttttgttgggtgactctgaatgggagcctgtttacgggctgggttcctaatagaaggcttcggttccctcctaataatctatcccctggtgggttttatttccaaagtacagcagtacagaacctgccctcttgggagtttattgggcttttttcttccccacaatattttctcccacgttttcatgcgagggaagagtttcctgctcatggaactgattgttgaccaagccacctgcgttggtcttttgtgtcctggcaagagggggttcacggaaagtggggggcaccctcctccccgcctcggctccatagagcatctcaagaacacggaaaacctggatccggttggcatcaataaaaggagtctgggtcagaggctgtgtggatgtggctctttctcaaatgttaccccaggtgactcaggtcgctgcatctgcttctgctactggttcggcaaggaagctgcagaacccccaccccaaagccaatccccttgctccctggaagttggaatctccctctaggccgggagttccggatgaattgaggctctcacatgagagacagcttccctggctgagcgttgcaacactcatctcctgctgctccggggtggcagacgacaggctgcctcactgtctggcaggcagggacgggaaaacctcacgcacatcccgtgcatggaagagctgctgctccctctgccataggacatctcagggctttgtccaaggccagtgggccaccagcttcactctgaggccagggttgggtgtcacacccactcgggcaaaccttgccctgccatctgcgtaaatgaggcaaacctcggcttgctgggtgggggtcatgggagaagtgaggtgtgtccacgtcatagcctgggccccgggggattgactgcatcacagggcaggcatttagagggaaccttggccatcactcactcctaattttaatgacatgcattagctaaattgtgttctgagtattcattcggcgctgtttatggtgtgctctcgagtatgcttaccgtttgtcagaagtgcaaactagcgaacatatgagcctttaagacaggccatctgttcgtcttagacccttggacgattgtcaaattcttctaaaaataagtgctcacaagcagagaggggctgcccaggtgatacacagcagataggggaggcagggctgcctgtatctatacccttcccaaagggaaagaagtaaagtgtgggaggaaaggggaaggttttccagggaacaggggatgggagcagagggaaatgatgggcgagaaggccctgctgacacacctttttggctggaggcatgagcttctccctgtgtcttgcctctcctgtaactccacagctcaaataccttccatggctccccatggcccagatttaagggcaagctgcctcgtctggcatcaaggagcctcatcaataaggcccccgccttcctctccaggctggtctccatggcacataccctgtgcttctgccaagctgaattattcattgttcccccaacatatgctgcacttttcacatctcacaggcagaacagtgtggtggtgaagagtgggctctgcagacagactgcatgggtgcagacccagcactgccatcaccagtggcaggacctgggcctctctgcgcctcagttttctcatctgtaaaatagggaggatgagagtatttaatgcgcagggcagtcgtgaggcttaaatgagctaatatgggtggaggttaagaatggtgtctggcacacagtgagcctaccatcagtgttagcagcgatcatgatcggtgccattcccaccttcgtgctgttgtccaggggttcactctgcctggaaaaccatctctcaagctctcacacacacacccagtgcaaatcctcacctgggctgtccttaaagggcagctaaaaggccagcttcttccttaagcatctcctattggaagtcctctctctatagtccttaaaaggccaggattgtgcctcacttgctctcttccgtctactgcacagggccaggtgccttgtttgctaagtgaacaaataacgggacccaacttcacccctgctgagcacgaacatggctgccacttcagcctcaagggctacttcttcccctggaaagggaatctctcagtggttaaggtgcattctcgggcttggccctagctcctggagaaagtgagttgtaaagccagccttgtgagagccactgtggctggaacctgccagggagtggccagtggtgggcagtggggagaagggggattggccacaacctctttcccaaccggaaatcacagtgaggtgatgtgcaggccgggtggctctgcaggtggggccgggagagcagggtgggatgctctgggtgtgggggctgagtgttcttgtgccttcatatgctatagggactcaaagactcaagggccagaaccacggcctagtctccagagaagagccaagccttcttttttgcctcttaatggtcttcagggtctatgagtttggccatcggcaccctcaccatgaaattgtgagctcctcacgggagggcgctggagcttctcaacctgtctgtgcccagtgcccagcccagggcctgacagacaggaactcagtgaacatctgtggaagaaatgtatgcatggatggatggatggatagatgaatagatgggcggatggatggatgggtgagtggatgggtggatgagtgcacacctattccatcccctgtggagtctccctgaggctgtcctcccctgcagacatggcattctgttcctgagggtggggaggagaaagcagtgatttgtgggtacaggggttctagccaggggggattatggggaggggataatgacacctgttgttccaagggcaggaccatccaaagttcagccatctcgggattgttcttaagaccttgccagccctttggacacccagaggggaagggggaggggtacagctggtcagtccattaaacctctatgaggccctcactgtaagccccaatcgtgcctggtcccacagaagtggcagggagcaaacagtccctctgccgtggagcaccctgccaggtcaggaagaccagaagacagtcctcatgccacagagcaccctgctgggtcaggaagaccagcacagacaccactatggagatctgtggagcatttgccgtagccagactgggacgtatgcaggcattatctcctgagtcctcagggcatctgtattagtctgttttgtgttgctataaagaaatacttgaggctgggtaatttatgaagaaaacagttttatttggttcacagttctataggctgtacaggaagcaaggcgccaccatctgtttctggtgaggcctcaggaagcttccaatgatgatggaaggcaaggggagctagtccgtcacatggggagagagagagattgcaaggaggcaccagacattttttaacaagcagatctaatggtaagtcattactgcccagaggacaccaagctgtccgtgagggatcctctcccatgacctaaacacctcccactaggccccacctccaacactggggatcccatttcaacatgagatttggaggggacaaacatccaaaccctatcagcatcttaggaagagggctgtgttattaaccacccccaaaacccggaggtcacagaacttgcccaaggccacatggccagtaagtggcagagccaagattcaaacccaaggcgtagcccatctcggcccacgaaagcttcctgcccaccttgaggtcaccagggcagtggctagcaccaatggagcacttgccaaggacaaggcaaggtgctaggactttacagacactgtcctcagagtagctgagagccaggagaggcagctagcagggtgtgtggagaagctcttttgctttatgctgctggcatgcttaagcccctcacgtctctcccacttgacatggtgatggataggtatcaaagggagaccaggcagggtcccacgcctaagcaacagagaatggagccaagatcttgagaagcaatcctgggcttcacactagggagaggcacacagtgttcctgtttgtgactgtgttgggcatggaggtgggctgagccagggccccctcctggggcgcgcaaaaccagcatcagaccccagctgaacctccaaggagcccattccctctagtgtgtggcggtgctttgggaaggacagtgtagccaccaggctctgtactctggcccgctccttccatgcacaaaacattaccctggattgggttcaggatcaggatcattttgctgctgaattcccagcaacaagcatagtggctcattggctcaaagacgaatgaatgaatgagcaaccatgaaatgaatgctgggcttctttccttccagaggctgagggtgtgtcagggaaccagttcctgagtgctctgctgacgatttgcacagagagggctctttttgtgggtctcaccaggacccagggtaggcctgcccccagcataggcagcacacaggtttctgtgcccgggcccatgccatccccttggctatcactgtcttgtgtccctggccccgtgtgccaggcagaggcccccaaaacaggctgtaccagaaacctccatccaggagagcacacgagctctgctgagtggatggattgaggctgcaaaccattgctgcccaccccctcctgctctcccgttttattttcctcacctgcttctctggcccacacctgtgtctccctggcaggcagcgaggccgagtggatgccaggcctccctctaggcattttccagtccttccctgggcccctgtctccacccccagcctttatggtggtgggaagtgttcatctgtggggtgggtagcatctttaaaaaacgattttcttccttctctaaaggggctaaatatagcacaggcataaacagagaaagagacattaaggctgaatgcccttgtgagaactatgctggatggaaagaactctttaagaaggtttgctgaacctccccacgttcctcaaaccacagcttctagctgtgggggacggaccacgggttctttcacggttattgaactgtgctgattgcagtagctgtccagagctgctctgtgtcctggtgttgggcgactggtaagtcttggggacaggggtcccaccacctcctctgcctgttgagatactgcccttggcctatggaggagccaatgccctccttggctgagcacctgggcacctctgggctccccaccaccatcacacaaactgatcgggtgaccttgaccagtttccctagctgagctgccagctgcaccattaatcccacaaatgtttgggtgtctgtgtctagcccctctaaatcaggcccctcgaggggtaggcccagctggtgtcttcccctccccctcactgtgccagtgcagagcagagcatccagcaggtgcttaataatgtagtgctgagtgaattctggtgcctggtccccttggggcatcaagttttgacatttccatctgctgtgacatcctgggcttttgttcctgtcacaaaacttcagggaaggaagttttatccttctgtctcagaaccctctaggaggaagttctttcttgagtgtaacctcagagccccctgctactgctatttaagtgggcaggcacactgtggcttttcctggggaatggcataggcattctggagttttcctcaccagtggtcccaggtgtgggttccagccttcatcatgtctgcaccagcagtgccctggtgagccagtgtgggccatgtgtgtcacactgagcctgttcttggcatcctggcaacaggctgcttcattctccagagatcccagacaccccctgtgcccatgttggtagtgggtggtccttggggattttgtggagatcgaatatcatgtctggttttctgtggcctgtggaacaaagtccatgtttgttggtactcaaggcctccactgtccgtaggccatgtgcccaccagccttcctgtgacttctgtgctgggacctgtgcctgcatcgccacttggattctaggctccacacctccgtctctgctattctttcctcttggaatgccctctcccctttccacatatccacatcctatccatacattcattcgttttctttccattgactcattcacaaatactgcctgagtgtctactttgtgccaggccctaggaaccataatttgaggacaagaaagagctgtccatgtctcccttcctcatgtcccctctcttcctcctccctgtcctccccctaataaagaatgacccacccacaccaagatagcaggggtttttgactggcggttggcagggtgtgaaagtgcagacctccaagttgctcctgggcagctgtgcctgctggggattggaggcccaggcgtatggtcaggacagtgcatgcccagccctgggtcctgagaaaggaggtgccgccaccctgtgtgcagctcagcaaaggaggtcagtctagctcatgagaggtgcgtggctgtgtgggaggtgggctgcaggtgcctggagaggtctgcagggatgggaagtgatccatgtgcctagaggactcaaagagcagcttggttgggagggaggagaagggaggcgggaactgagtcagcagaggcttgaaggtagcaggaggatggctgtgtagagtgtggattcggctccccacaggactagctggctgtccctgcacaagtacagggagaggtgccacggctggagggtgcgggttcccatggaaaccgcctgcatcccatctgtggcctcagacaacctgcctggtgcctctgggtccctgacgcccccgaccgaggtgtcaggcccggccggcagaggtggcactgtgtctggtgcagaatgcgggtgatttgcagactgcggtgcccatggggtgcaggccctgggaagcctggctcccctgaaaatccccttgctctagtggattccagccatctggttcagtgcccggtgcttccaacctgggtgaccttgggcctgtaatttttgccttcctaggcctcggtgtcttcatcttaagaagtcccacctcgcaaggctgttgtgaggattgaaagagcggtgcctgccacggcacagagcacgcatgcccaccaagccccggccgtgcgcctgctccgcccgcatgagcacgaggctgtcgcttggcgctgtgggcatctgctgggaggcaggcgcgggctgcctcttcccggccgggagctcgcaggaagggtcggtgacattaccacgggggccgcagccttcgcagtgcccgtcacgggaagggactgcgcggggccctgctccagggagcaggagtggcccgtctcggccccggccccggccccggccccggcctcggcctccgggcgaggctactggcatcacctggtcgccctcgccgcggacccgagcccaggagagacgcggtgcctctgctgacccctggcggtcagcggcacagctgcaggagtcgccgggccctggggggcgcccagaaggagcctctcccggggatctagggtcctgtgcggccccaaacagggccaccctacacctggtggatgttgcctcctttctccaggtgtcatgaggtggagcaccacctgaggctttgatgaaatgggtctgaatttggaacacgaaccactgaaaagaaacaaaaagacggctttcagatgccaaatcccacccccagtcccaggccgctggctcctgtgaaacagatcaaccctgctggccccctctggctggcagggggaggaaatgccattgactgtaatgagagggaaacatttggccacagggtcccacctgggccctggattcctaggtgcattcggccaaactgcactgagtccctgtctctggttgggccattgccatgtgaccaagcaggcaggctcccggagcccagcagcagaggctcctcccgcgtcttcctgccgggtgacctgtcccctgcctgggccgcaggcaccacggccgcccactgcctcagcacgcctgtgcccgctcgggtgtttcttggccggagagctgcacagcacatctgctgtctccctctgctaggctcggagcagccacggggaagactgagagggggatgcgagggcagcctgcaggcgatcagagtttcctcctcttcattagaggaaaagggagatggagaggtgaacagggatgtttttaattcctgcctcctccccggcatttcccctttccctccacctagccagtccccccggtaagacctgaatggtctttaaaaaaaaaaaaaaaaaaaaagccaaaaaacaacatatagggagtccaagttggcagtaacaggaacctatccccaagccccaaatcaacgtggcgtcttggcagctgcgtccctggagcactttttccttgttgcattttgttttgttataatcgagacgcttttctgcggctcccggcgtaaatgcactgagtgggagggacgagcatgctctccattcttctccttcatgtgtgtctcctttcttcgcctttgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcg

SEQ ID NO: 38041 - DNA, 26090 bp, Homo sapiens
cagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcgggtgagctggggccctggacggggtctgcggggacaccggccctgcgggtcggagtcaaacgcgcgctgctcagagtgctttaaacggggacgctttactccccgccacccttggagaactggttttggctgccgccctgagcagcgtccgggttggggagaatccagcgcggcaggttcggctttcaagttcggtgtcacccgtggcacgccagtccttgagccattccgggtcagcgtggcgcgcgagttgtcgcccgggctgcatagctaccaaggaggggcaacccgcgccttccttgcgggcctcgcgggccttccaagcttgcccctttgggaccagcctcactcgccctccccattcggagttttcttacccgccgccttccccccgcccccttccccccactcccgggaggctgcagattgagtgacgccgcgcctgggcggtccactgactggggagcagtggccctgagacctcacgccctaaggatgtagccccgctcgcagtgcacacgcagtcgcacgccgccgacctctgagcgggtcagacgcccttgtgctttttgtttctagggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgtgagtgccccaagcccgcgcggagtaacgcggggcttgcgggggcccccgacacagactagcgggaggagacatattttccgtgtgataaaaacagggcggtgcctgcttgcctagaaacctccagcgcttcctctttgcctctctgggtaaatctgagctgcacatcgtaggcttcgagagggaaagcagattctccgattcaacactaaactttccctctacgtgtagccccgggttttctcttccccaatccaggtagcgtacttttaaaattctgctcaaaggccgggcgcgttggctcacacctgtaatcccagcactttgggaggccaaggtgggcagatcacgaggttaggagttcgagatcagcctggccaacatagtgaaaccccgtctctacgaaaaacacaaaaaattagccaggcgtggtggtgggcgcctgtaatcccagctacttaggaggttgaggcaggagaatcacttgaacccgggaggcggaggttgcagcgagccgcgatcgcgccactgcacaccagccctggcgacagtgcgagactctgtctcaaaaaaaaaaaaaaaaaaattctgctcaaaacgtacttttccaggaagtttttgaaactaagcctcctctcatctggaccctttagttaactcagtggccttccagctctatactggcagtggctcatctctgcccttatttgtcgccctgcatttatcctttcatgtgtgtcgtggctgaagtgtctgtgtccaccagggctggggcgacagggaacactgctctaatagggccagccagtgtttggaccgggaagtgggcatgataaaatgtgcatccaggctgggcgcggtggctcacgcctgtaatcccagcactttgggaggccgaggcgggtgaatcacctgaggtcaggagttcaagaccagcctggccaacatggtgaaaccccgtctctactaataatacaaaaaaattaccagggcctggtggcgggcacctgtgaatcccagctacttgggaggccgaggcaggagaatcacttgaacccaggaggcagaggttgcagtgagccaagatggcaccattgcactctgcagcctgggcgacaaagcgagattccatatcaaagaaaaaaagtgcacccagaagtgaaagcaacatggagtgtgtggttgatcccaggcaaagtgcaggggaccactaaaggtttatgggctcagtaataggccctggaataaagagaggttttgacttggtttcttccttcaatacttattgttttgccagcagactagcttcatctcgtaacctcttgtacatacttagagcttcttgctgcctaaagatgatgggggtagaaaagatcttggaataatgaaactttactggcccaggcattttcccagaacacctaggcagagtaagctaaaaagcactgggactgccttcctcttcaggaaatgctttcaggcacagaaaagacacaggcctgctaaataacatgcttttcagttgaactaagttattataattttaccacctccctctcctacctccaactttttcctatttttaacttacagctttctcaatgaaaaatcacgaatcatttttaccctcatctgttggagtcaccatattcaaacacattaaagcaaaagttctagtaaaaacattctaacttttggatttgatactaaggtatttattgaattgcctaatagcaccattcaattcactagcattaacaaaggaaatgctttcttctcatgttggaagtaagccttcttgaattagaataatactagctaccctttattgagcctactgggtgccaggcacttcatgaacacagtcccgtggggaagatggtatcatctgttttgtgatgtggaaaccaagcctcagtggggccaccttgctggaagtcaggtggctggtgagtgctaaaagcatgggaatctccagttcgctgcagtgcctttcaaagcagagcctgtttcctcatttgtctcccatgcttgtgcactgctgcatcacactacaacatttgggcctgagatggaagtattgttatcttgccaattttgaaaaatcgcctctgagagagatcccacaaactttgctttagtacttcccatgtcttaccagtcccctccctgacctgaactctttgaagttaagctcagaaaccttggagggtggccggccacagtggctcacgcctgcattgccagcattttgggaggctgaggtggatggatctcttgagcccaggagttcgagaccagcctgggcaacatggtaaaaccttgtctctacaaaaaataccacaaaattagccggatgtggaggcttgcgcctgtggtcccagatactcaggaggctgaagtgggaggatcgcttcagcccgggaagtcacggctgcagtgagccgacattgcaccactgcactccagcctgggtgacagagactcaaaataaataaataaataaataaataacagaaaccttggagggaattaaaactgaccaagtttccgtctttattttattttatttatttatgtttgagacggagtctcactctgttactcaggctggagtgtagtggcacgatcttggctcatcgcaacctccgcctccctggttcaagcgattttcctgcctcagccccccagatagctgggacaacaggtgtgcgccaccatgcccggctaatttttgtatttttagtagagatgaggtttcactatgttggccaggctggtctcaaactcctgacctcatgattcacccaccttggcctcccaaagtgctgggattacaggcatgagccactgtgcccttgcccagcccaagtttccatcttaaaacaaacaaacaaaaagtaacacttttttccccaattataaaagtaacatgtaatcgttgtagaaaatcagtaaatgtagaaaagtaaaaaaacaaagctaaccaccatcctgttattaaaaaatgaccagaaaaacccttcaggatattttctctcagttttgttcatgtggatatacatatttttccctctggtattggacatactgtatataaatattttttcatgtacagttaaatattctcagagaatatggatagatacttaacaagcctcctcctctttttctcacaatacttctgttcatagagattcccccttttttaaaattatgatctctgtgcaaggagctggagagagaaaggaaaagtgccaagtcccttaagagccagccattttcccaaggggacaaaatgaaacatttgtgaaacaatggtttagtgttactttatttgctctgaggaattcatatatggagaggtgagcttgagctggctttgaatcatgtgttaaatagaatacatgctgccatgcagaggaaaaagcagagttcagaggtgtcctgagcccaggatgggttagtttcacttcagatttagactgaggatgaaattctcacttactatgcttatgatgccctccatgtgtgctaagggtaaagatcctagaaacactgaatgaacacagatgagttgtatccagttgtgtttttcatcttgaattgttaatctatattcttatacaagcattatagcacatatatcagttataaggaagaaaaacttttactttgaggatttgttttacaaatgaaaaactccttttccttttttttcttatttgtcttattcattcatgttggacttttcccttttctcaggttctgcaccagtattgtggctcaagactccagaggccacatttaccatggtcggaatttggattatccttttgggaatgtcttacgcaagctgacagtggatgtgcaattcttaaagaatgggcaggtataatccgtaccatataagataaaaaatcagaaagatttgcaaactcaagttagcagtcatttggatggcctgctaacttaagtgtgttatcagtgtaagacacaaaaaaatcacacccctggaaaaacaaagccagaagagaggtttgcatcaattatgcttataggaaggacggtcatttattatttattattcagtgtctacttaaagaggtcacccagttttccatagggaaatctcttttagagagtgatcaatcatccacttatgcagagtcagctctttcctctgctttcccatgcccaggctgcttctggaatatggaggggctgggtagtgcaataactagaaacacccaactttgggatctgacagtcccaggtttaaatcttgattctatcaattactgtacttcctttgtgaacctgagaaattactcattccctaattttgcagactacagctcatggaggctcataactactttactgcgatagttataaatgttaaatgaagtagtctatgtaaagttgtagccaaataataaatggtccttcattctgcaagtgtgattgacccacaccactttcttgtgtatgatctttaaaaaattatacttagatcttttgtttatagcatggtccctttaaaactataatctagtgtgtgctgttgtcaactgtgtaaacttttagagagacagaattaatcaatgttcattgagtacgcaaagcatgttttgctgtaaaacagaatacagagtgcaaaagccagattttggctgtaaggacaaggactatattccctttgttctttgcatttaggggttgattcacaaatactaaaaactcatttactaactactcagtcatctgcttttacaaacactttttttcataaaaaattcaaacagtacagaaatatttaaagtaaaagtttctcctttccagtcccatttctttactttgccactattaacaatttgatttctagctgaattactttaaaaatgattttaagtggtaacgataatataaatgcataataaattctcaaaggaaatctgctaaatattaagttattactgaatgaaggataatattatttattatttattcatgttttttctccattgttctataatgagctaatactcttaataaagagacaaaggaataaatgcaatgaaaataaattatttcagctgctctgaaactcactctaatagttgttgcttcatttgtttttgtttttcctggagttcccatgaaataatctatagagaaatagtctgtagaggtagttttactctcagtactcaggtgactgttactgaatatagacagtttacacttgggtattgcttttctatggaggactcatggccaagaaattgttttatgaaattaagaacaggttatccacaaaataattcatctctcattcttgtctagtgtttgtaatcttaaaagtatttttggctgggcgcggtggctcacgcctgtaatcccaacactttgggaggccgaggcaggcgaatcacgaggtcaggagttcaagaccagcctggccaatgtggtgaaaccccgtctctactaaaactacaaaaaaaaaaaaaaaaaattagctgggcgtgtgggtgggtgtctgtaatcccagctacttgggaggctgaggcaggggaatcgcttgaacctgggaggcggaggttgcagtgagctgagatcgcaccactgcactctagcccagtgacagagtgagactccatctcaacaacaacaacaaaagtattatcatacacaggacctcattcgatccccccagcagccctgtgaagcaggcataagtcaacattttaatctttactttctagatgagggggcccagcttcacagagactgacttgccccgaatcacaaggcctctagagacatggcagaggtagggccagaacccaggcgttaggcctactgatagtttttgtttacagccttaattaggctgtaaattattattattattattattattattattattattattattattactactactattgtttttatttttgagacagagtctcgctctatcacccaggctggagtgcagtggcgcgatctcggctcactgcaacctctgcctcccatgttcaagcaattctcctgcctcagcctcccaagtagctgggactataggagggtgccaccacacccggctaatttttgtatttttagcagagatggggtttcactatgttggctggtcttgaactcctgagctcagataatccacccgcctcggcctcccaaagtgctgggattacaggtttgagccaccgcaccaggcaccaggctgtaacttaaaattccctgctaagggtttgtttatgttaactgactaggcagaaacaactgggaagtacaaacagaagtaaagacagattttcagagctgcaagataaaatatcttacaaattatatctcaaaattatttataattatgtatcgtaattgaaaactacgatgtgacttttgatctcataacttcaattttctcagccctccaagagtgaccctgacgatcacggtgtcacgcaaatgaggtggccatataattactttttattttccatataattacatttgagtagtaaggaagacttatttctgctttaccaccatgcgtggagatgagacattcatggaggtcctcagtaagtctgagggctgaggtcatttataaagctaaggacactgcattctcccttgtaattcagccaccttaaattatttttacaagcagataaggtaaaaataaataattaaatgaaaaacattactgacctaatttttctaaggaaaatatcaatctaggactatctatttcttaaaacataatggtattagttaacttttattgaacagtatgagtcagatactgttttaagtactttttttttttttttttgagacagagtcttgttctgtcacaggctggagtgcaatggtgcaatcttggctcacggcaacctctacctcctgggttcaagcgattctcctgccttagcctcccgagtagctgggaccacaggtgcgtgccaccacacccagctaatttttgtatttttggtagagttggagtttcaccgtgttggccaggctggtcttaaattcctggcctcaagtgatccgcctaccttggcctcccaaagtgctgggattacaggtgtgagccaccatgccttgccaaagtacttctttgaaaaataaaatttggtatcagaaataactgataaaggctagctgtggtggctcacacctgtaatcccagcactttgagaagccaagacagaaggattgcttgagcccaggagtttgagacgagcctgggccacatagggagaccctgtctttaggaaaagcaaaaaaaaattttgtatatatttatatatcagtcaggtttggtggcatgcacctgtggtcccagctacttggaaaactgaggtgggaggattgcttgagcccaggaggtcgaggctgcagtgagtcgtgattgcaccattgcactccagcctcggtgacatacagagtttgatttttctcctgcaggttacatagtggtatcttgcaatcactggagcttgtgaccttaatttaaagtaggagtgatgcctataattcatgggatagttgtgaggattaaatgaaagagctttgttaaaggatttttaaatatttaaaatttaaatgtgattattattggtgaacagtcccactttgatattctaacttcacagagcttataaaatatgtgatattcatctcttataatcaaatcaaaacaagttttattttattttattttatttttgagacagagtttcactcttgttgcccaggctggagtgtgatggcgctatctcggttcaccgcaacctccgcctcccgggttcaagtgattctcctgcctcagcctccctagtagctgggattacaggcatgtgccaccacgcccggctaattttgtatttttagtagaatccaggtttctccacgttggtcaggctggtcttgaactcccgacctcaggtgttctgcccaccttggcctcccaaagtgctaggattacaggcgtgagccactgctcctggcttcaaaacaagttttaaagtaagactccacttgctacttctaggatggggcttcttaacctgctttgtgcacccctttggtgaatactgttttataaatacataaaataaaatacgtaggattacaaaaaaaatcagttgtgttgaaaacagccatttcaatgttatactttttcttaacacattaaatagtaaggtttagcagggggtctaataactaccatgatttcaaagtagtaaattatggatagtgtttcaaaataactgcagccaacattgtgtatgtgaaaatatctgtgatttctactagtggcaaaattataggcaccactatgattgtgtgatttgttgcatgcattcattatagaaggagttaaatttcagttagaggttagtgaaaataaagatgcatctttttttttcccatccaaggtcacaaatctactaaaatctatctatggaccacacccccacccaccccagcttaaggttaagaacctctgtcttagaagactatttcagagttttattctattgtgttggaatttataagaaaaaaaatccagaaaattgtggggcagaacaggtgatttcagtgtatttgattggaatggtgaaatgatccatgttatctcttgatttcagattgcattcacaggaactacttttattggctatgtaggattatggactggccagagcccacacaagtttacagtttctggtgatgaacgaggtaatcaaaacaaacccctgtgtaattttagctacattattgttcagttctatccaagcacttccttcactcacccaacagaatatacagaacacccactatgtggcagggacttccatcctagggggagaaagtggacagtatgcatggaagcaatgaagatttcaggtagcaataagtgctgcaaagaaagcaaaataggaagctgtgatagagagtgaaggaggaggtggggtggttagtacaggtcagagggtcagagaaggcctgacccatgtgatccgggagctagttctgcagaagccaggggaagaccatttctggtggtcttaccgcaaggatgaaggccgtaggtagtaataataagcttggtggatttcagaagccaaagaaagtcagtgtggttatggcatgggagtaagtgggtagtgacattagaagtgaagaagaggctgaggccatggtgcagggccacaatgaagagtttggtttttaagcataatggaagctgtagggggattgtaggccagggagtgaacagatgtgatttatatttttaactattacttttgctgctctgtagagattgggttgttttaggttaagatggaagcagaagaccatttggaaactactgtgataatctaggggatatatgatgctgttatacaagccacatttgtaaagcactttctggtttaccatgtacatcctcacatgtcttcttcttagaccctcacaacagtcctgttaggcagggctgttatttttaactccattcgttaggcagagaaagaaataggctgtgagatgaaatgacagctagtagtgggagaggaagttctcagattgctctcctgggtcctgacccaattgctctgttcattgacatccccactgccattccccagatctcaggggaacaccatttagttccacagtatgtgggaaatctagaaataagtgagctctgtgtctgtcctcagcgtgcagctgaatcaaggagaaggatatatacaaggagtatcttgaagtttagtgttgctcgtctgatgaaccctgattgacttcatggtgttgtttttttggggtttttgttttgttttgtttgtttgtttttgtttttttgagacagtctcgccctgttgcccaggctagagtgcagtgggcgatctcagcttactgcaacctctgcctcccgggctcagccgattctcatgcctcagcttcctgagtagctgggattacaggaggtgccaccacacccggctaatttttgtatttttggtagagatgggttttcaccatgttggccaggctggtctcgaactccgaacctcaggtgatccacccacctcggcctcccaaagtgctgggattacaggcgtgaaccaccatgcccggccagtgttattgtttattcttatctttttacataaggctttaccaggaagatggtgattgagtatatatcagtgtccacagtaagcagttctttatcctaatgtatttcttccacattttctcatatgtcagctatgtatagtactggttctcaacctgtggtacccaaaccacagcatgacaattactaaggtttttaatagaatgcctataattacatgtatatttattaaaaatgactggctttcattttgcaactcaagttgtttaccaaacttgattagtagaatctaaggtatgagcagttaaaaataaccaagttagtctacaacatatgcatttaatgaaatactgtcaaactgcttttagccaggcatggtggcacctgcctgtagtcccagctacgtgggaggctgaaatgggaggatggcttgggcccaggagttacaggctgcaatgagctgtgatattaagtctctggacattatggggggtgccagcaatgcctcaaagccaccctaggaaaggataaagatatgaggaggactaatgaatgccacagggcatggggaggcttaacaaaacacctggtgggtaacacctgaagactccagggccagtctgcctgggtttaaatcttattgctgtagctgggtgaccacgatcaaggagtttaacctgtcggtgcttcagtttcctcatctcgaaagcagggatgggccgggcgcggtggatcatgcctgtaatcccagcactttgggaggccgaggcgggtggatcacgaggtcaggagattgagaccatcctggctaacacagtgaaaccccgtctctactaaaaaaaaaaaacacaaatttagccgggcgtggtggcgggtgcctgtagtcccagctaggcgtgaggctgaggcaggagaatggtgtgaacccgggaggtggagcttgcagtgagccgagatcgcgccactgcactccagcatgggcgacagagcgagactccatctcaaaaaaaaagaaaaaaaaaaagcagggatgataatagctgctatgaggatgaaatgaattaacgaatatgaaatacagcagtccctggcacagagcaagggccacagaagtgtttttgttgttgttgcatctccaggcctggcctcctctgagtcctagactggagcatccagccatcttctcagcatctccactctgacgtctactaggcatcttacacttgcctaagcagatctcttgcttttttcttttccctattttctacccaactctgcctctactcaaatctgtccctctcctcgtttcccatgtctcagaaaatggcacctctacccaaccaattgctaccagaaatcatcactgacccctcactccctaagtcttatcagctctgacagcagaactagactgtacctgtccattctacctccactgctgagctagcccccatcacacctgtactgcctgattagtccacctgatctccttgctactatttttactttcttataattccttccctacccagcaactagaatggtcaggttgttcccctgcttaaaacctactgtgacagatattgcatgatttcacttatatgtggaatctccaagtttgaactcatagaagcagagagtagaatggtggttgctatgcactgaggaaaaagggaaatggtcaaagggtacaaagtttcaattagacaggaggaataaggtctggtgatccacacagcaaggtgagtacagttaacaatcatgtattatgtatttcaaaattgctagagtgggtttttaaaaattaattttgttattgatacacattacatgtgcatattttgggagcacatgtgatgtgttacattcatataatcacatcagagaaatgcaaatcacatttttatttctcttaatgattaatgatatggagtatcttttcatgtgcttactgcccatttgtatatcttctttggagaaatatctattcaagtcctttgcccatttttttttgtttgttttgagacagagtctttctgtctcaaatcacacattcataaatgcacgatcatgtgtgcacaatctaattgtgatatgttaccttaaatatttgtcttttctttacactagaaacattcaaattctagctattttttttggcggggggggggggggcattaaaaatttttttttaatttttttttttagtagaaacaaggtctcactatattacccaggctggtctcaaactcctgagctcacgcagtcctcctgcctcggcttcttcccaaagtgctgggattacaggagtgagccactgcacaaggcctgttttttttctttttctcttctttctgttttcttaagacagagtcttactctattgcccaggctggagtacagtggcgggatcttggctcactgcagcctcaatctcctaggctcaagttatcctcctacctcagccttctgagtagctgggactacaggcatgtgccatcatgcctggctaacttttgtagaggtagggttttgccatgttgcccaggctggtctaaaactcctgggcacaagtgatccacccactttggtctcccaaagtgctgggattacaggcatgagccactatacctggccaatagtagccatcttaatgggtgtgaggtggcatctcattgtagttttgatttgcatttctctaatgattaatgatatggaatatcttttcatgtgcttactggccatttgtatatcttctttggagaaatgtctattcaggtcctttgcccattttttttttgttttgagacagagtctcactctgtcactcaggctggagtgcagtgactcaatcacagctcactgcagccttgaccaacagcgctcaagcaatcctcttgcctcagcctccccagaagctgggactacaggcatgtgccactatgcctggtagtttttaaattttttgtagagatggggtttcactattttccccaggctgatctaaaactcctgggctcaagcactcctcccacctgggcctcccaaagtgttgggattacaggcttgagccagcacatctggccctttgcccatttttaaattggaatgtttgttttgttgttgttgagttttaggagttctctgaatactctggatattaatctcttattaatgcaaatattttctctcaatctgtgaattgccttttactctgttgataccgtcttttttttttttttttttttgagacagagtctctctctgtcacccaggttggagtgcagtggcctgatcttggctcactgcaacctccgcctcccaggttcaagcaattctcctccctcagcctcccaagtagctgggattacaggtgcccgccaccatgctcagctaatttttatatttttaatagagacagggtttcaccatgttggcgaggctagtgtcgaactcctgacctcaggggatccgcccacctcggcctcccaaagtgctgggattacaggcatgagtcaccacacctggctaatactgtcttttaatgcgcagaattttaaaaatttttgtgaaattcaatttgtccatttttttcttatattgccattacttagccttgaatgaaaacttttgtttggcaatgaatcccctaacagacttttaaaagttgtccaaaagtaattttgggaaatgattgcaaatttgtatttttttaaaatgtgagcacaaatcacaggtgtggaagactcaagttctctatgttcttcctaatatttattaagacacttcccttgatggctacataattttattttgcctggcataattaatagaattatttcctttgacataactatcattgtatcctggtacaaaagattctgctttcaaaacttgagtgaatatctctctatatttccttgctaaaataacatatctgtttcatgtgtgtacatatatacacacacatatataacatatatactcaacttggcagataaaggctggtggtgggagaatgctatcgctgccctgtttcggagacacattcccgtcagctggctgatccgcgctgtgagtatatttaatgtggagccctccttaactccacctccaccttctaaactgttctgtgtcatttaacaatgttgcttttaatgtaaggagctccttaaaagaataagcatctaaatgtctgcaaagtgcatataaatctttttgataaatgtcaaagataaagccagacactagttaaagtggtaaggacagattgtaatcagtatatgctattggagtaaggaagagtccagtgtgaactgagctcaacttcggtttgtgcagaggtgatgggtattttaaaaggtgagggaacaaggagcttaggatagtcagagaagtgaaaagtggaaaggcgggatcggttcatgtgaaaccaatttgagtttgcgaactggaacttagaagttatgctccaggcagggcgcagtggctcacgcctgtaatcccagcactttgggaggccaaggagggtggatctcgaggtcaggagattgagaccatcctggctaacacagtgaaaccctgtctctacttaaaatacaaaaaattagctgggtgtggtggcatgtgcctgtaatcccagctactcgcgaggctaaggcaggagaatggcgtgaacccgggaggcggagccggaggctgaggtaggagaatggtgtgaacctgggaggcggagcttgcattgagccgagatggtgccactgaactccagcctggtcaataagagcaaaactccgtctcaaaaaaaaaaaatgaagttatgctcctaccctcctacagagacagggagacaggggccctaccttcaggtattggctggaacaaatggcaaattcttttgacagcctggagttttctcagacaggcactttaagggggactagtcatctgagagacgtggccttgagctgttagaaactattagtatttgttcgagtctttataagccagggtcaaggtctaatagagaagaggtctcagaggagcctggctagagtttggttaaggagagaatctttgtcataggctagagttttccacaatagctgattgagataggagataatattatgctcttctacagagacagatgtactccccttttaaaatctccatttgcaaatatccaaactagcaaagcaaacacattagaagccagctgtgcacacaacaaaaggaacatctgctctacaagaacctattaaaatgtgctgggttccaggccacatctacagtagtctccccttattcttggtttctgttacccacagtcaactgtggtccagaaatatgaaatggaaaattccagaaataattcatcggttttaaattgcacaatattctgaatagtgggatgaaatcagtcacctagtaactgtctcaattatcagactgttacgcatctcagtgcttgtgttcaaggaacgcttatcgtacttaataatttgccacaaagtgcaagaatagagatgccagcaacttgggtatgacaaaaagaagctgtaaggtgtttcctttaagtgaaaatgaaacggcctcatttgtctggggtgataccttagatttgttgtctcagggccacagaaaactagaatgcggacacaccagtgtgaggttaagagtggaagtttaacaggcgaaagaaagagaagagcaaagaggagtcccaaaaaaatgagttgctgcttctgtggtgaaatgaaggaggttttatggatgagcttgaggaggtggtaactgatttacatagggcagcaaagattggttggaccaggtgtaccatttgcatagggcatgaaaagctgtctgcccccaccctaatcttttattatgctgatggattctctacctggctggtgccatgttgcctgcttctttactgtacacatggtgacaaagaaaagggaagatgggccgggcgcggtggctcacacctgtaatcccagcactttgggaggccgaggcagagaagtgaggaggtcaggagttcgagactagcctggccaacatggtgaaaccccatctctactaaaaatacaaaaattagtcaggtgtagtggcgggtgtctgtaatcccagccccttgggtggctgaggcaggagaatcacttgaattcagaaggcagaggttgcagtgagccgagatcacaccactgcactccagcctgggagacacagcaagactctgtctcaaaaaaaaaaaaagaaaaaagaagggaagatggagcctccgttttgaacatacctggctcccaggtagcccttttctgttggcacagctgctggcattcacccgtgcaagcttccagcttgcttgtctatgtttgcagctcgatttttcaggctgctctttgttagaaaagaataacttcttgggctactttttgttagaaaggaagccttgccaaggactcttctaccctcactatctgcctaatttctttctatctcctgtatcaaaaaggtgaaagttcttgatttgataaggaaagaaaaaaaatccatatgctgaggttgctatgttctctggtaaggacgaatctgctgggtgtgatggtgctcgcctgcagtcccagacactcaggaggctgaggcgggaggatcccttctgcccaggagttcaggtccaacagacaacattgagaccccatgtctggaaagaagtaaataaatgaaataacaaaagaaactctgggacctagactaaaaaaaaaaaaggaagaagaaagaaactccatgtctattagcagtcactgcccatttcctccatttcctgagatagatgcatttgcactccctgactttgtcgcctgggtaaaataagtcaccagtgccttcagtattttttatggatgttcttttgctttgctgtcacaggttagagaaaatgaatttgatagtagttgggggatggtataggcaacataagcaaacaaatatttcatcactcctattacctctgcaaaggccaagggaaaatttcttctttgccctctgatggttcactgaaaagtcaactcacaaaaggcagattaattggagaaaaggcatacaaatttatttaacatgtacatgacataggagtcttcagaatgaagacccaaagatacaggggacattgtccatttttatgcttaggtttaacaaagtatggaatgccatgtagaaatatgattgaacaaaaaggtagatccagtgctaatagatggagtggggaaacccagctaggcctgtgtgtctagattcttcttggcctctctgaccatacattcccttcttccaggtacagggcaggatcctctctggaaaggggatcatatgacctacagtcaaacaagttaggacagatcatttctttttttttttttttttgagacagggtctcactctgtcacccaggctggagtgcagtggcatgatctcggctcactgcaaccttcatctcctgggttcaagcaattctcccacctcagcctccctgcatagctaagtataaggcaggaaaactctacaaagccctgccatgggttttgtagagttttcttgccttatggttattgctgttaaggtttatggtgctgaatgacggagcctttgcagacaccaataccttgaattgttcttttgtttgaccctatcaccacctccacccttgacaatgtgccctggcaatatccaggatgggtgagcatacagtgtacttcctttaaaacatggcagcagagtggttgtgaaggtggagacaggaagagcaggccctccaccgaaggatattcttgagcagatcagctctaggaaggagcccatatggaatctgaagatttggggagtgatccccttaagtatccttgccacaggcctttggaagtcatcatgcgccctcggggtgtctgaacaccagttaagctcagggcgctaatgtagcgcatgctctttcatccccaagcctttgccagtctagtccatcgaactagaaccctcctccccactgccactcctcaccctgcaaccaccactttcaccactcacttgtgtttgtctctttagcttcaattcatgcgatgcttcccagcagtacctcctccactgcccttggtgaggatgggacccctactgtgacgtccatagcatcttattctcctatgtgaactctcattacactgtgtcaccattggttgttgacttttctgtcttcctcagaggcttggggagaataggaccaggcgactcattcactgctctatcccccaccagcacagtgcctggcacagtgtagatattcaagaaaaccctgtttaaataataaatgaatgaagaagcacaaaaagtcctttgtgagggcgatctgcctggagagcacacagccggtgtttgctgagccaggcctagggcttgtcaacagttctctcctcctgtcagaatttcctgctgctcctggctccgctttgaagctgaaatttcttccatcttaggagccctgataacaagaggataaggtcagagcagatcaaggtgatagtcatgacataacatatcaggagaatgtgctttggatcatttttgcatcatctggtgtggacccaactgcaggtggggttgctcacgcaagttcatcctttcgttcagaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtaagtagaattgaaagctctggtcattttgtatcagataatcattttttttaatcggtgaaatgaggggtattttaaatttgttcatatgtctcctctgctatgtcgtaaattgccttggataagacaagatgatgtgctctgttgtaggtggttccgagttgagacaaattacgaccactggaagccagcacccaaggaagatgaccggaggtaggctgctacgtgctttctggtttgcagtgttttcttatggtcaggagaatatgcccattctgtcacaggaactggcaagacctatgggtgctatcctctcccagaaaatgtacctgagccccttcgccagtgccttggctgggaagggagtgttgtgtggaggagagcagtgggcagagcctctcagcagctgggcgggtgttgggaggctgtcagggtcaggagccctagagcccaccaccagctctgctagtgactcactgggtggctctcgggcctctgtttaccagtctgtaaaatgaaagcaaagggccaggttcatggtcttctaggcaagatatttttagaaggaaattatttcccttatttaaacaataaataaaccagtcaagggtttttattgtcccttcaagttgtaaacattctataattataagtcagcacagttccaaagtgcaggtagctatatacgttgccttggctttactaccccacaagtttggccactgttcagttctgcagccacacattttcatcatcccagctttctggagcagatggtgccaaccgtcccagctgctggatgaattccactgtggtgggctgggcctcagcaggaaacaggcttggggccagaatctgttttggagaaagggagataatgagactggagcttgcattctgcctcccaaaaatgacagctgatgggcttcagtgcttgttgaaatgccaagtgaccttcgacctttgtccttacagaacatctgccatcaaggcccttaatgctacaggacaagcaaacctcagcctggaggcacttttccaggtaacttgtgtcacagtgtcctgcatacctaggatgtttggtgttttgttaatagtgaatatgaaaaactccgtgaaatcttctggtagatgaaaacgttagggtaaaagttttatttggttgaaatcatgtattaaaagtggtggctcacacctgtaatcccagcactttgggaggcctaggcaggcagatcacgaggtcaggagattgagacaatcctggctaacacagtgaaaccctgtctctactaaaaatacaaaaaattagccaggtgtagtggcgggtgcctgtagtccaagctactccagaggctgaggcaggagaatggcgtgtacccggaaggcggagcttgcagtgagccgagattgcgccactgcactccagcctgacagagcgagactccgtctcaaaaaaaaaaaaaattatatgacattttctcaacttgcttttatataagttaaaatgtccatcttcaccaaagtttttctttatattaaaaagaaaaagtcatagttgtaatatatgttcattgtttaaaagaaaaaaagagaaagaattaaaaagtcaggccggatgtggtggctcacacctataatcccagcactttgggaggtcaaggcaggaggatcacttgaggtcaggacttcgagaccagcctggccaacatggtgaaaccccgtctctactaaaaatatataaattagccaggcttggtggtgtgtgcctataatcccaactacttgggatgccgaggcaggagaatcggttgaccctgggaggcggaggttgcaatgaaccaagatcatgccactgcattctagcccaggtgacacagcaagactgtctcaaaaaaaaagtctatatcacctcaaggtacactaaagagtggttatgttctttctacagacattctttttttttcttttttagtaaagacagggtctctctatgttgcccaggctggtcttgaactcctgggcttgagtaatcctcccacgtcggcttcccaaagtgctgggattacaggcctgagccactgcacccggccctccatagatattctatgtgtatttcttctaccatgtaatcttctctataaaatgactttttcctatgcagattttgtcggtggttccagtttataacaagtaagtggcttgttaaacatgtctgttcacacatcactccagaacagtgaactcactcacgtactgtttggctcagcaaggatctgagggctcctgtaaccaggctgtgggggcactcctgtgggggcactcctgtgggtacagctgcgagcaaaacaaagtctctgctctcatgggactaatatgggtggggtgggggtggtggtgataaacaaatataaatcaggtgagaagtccatgaagaaatccaaaggtaaaaagaatagagtgaccctgaaggaggctctgggaatttttttttttcttgagccagagtctcgctctgtcacccaggctggagtgcagtggcgcaatctcggctcactgcaagctctgcctcccaggttcacaccattctcctgcctcagcctcccaagtggctgggactacaggctcgtgccaccacgcccagctaattttttgtattttttaagtagggacagggtttcaccgttttagccaggatggccttgatctcctgacctcatgatctgcccacctcggcctcccaaattgctgggattacaggagtgagccactgcgcccggccagctctgggaatcttaaattcaaacttggccttccatagtgttgtcaaactagaaggaaaaacactttgactggctgacctcttgattcctacatttgaaatattctggcagtgaggtgttcatcctaactcagtcaggtagctgtggacagccttcacctgttaggagctccttagaaataaattctgaatacctttggttttcttttatcctccggaggaatttccactatctccgaagctgttccttgttccactgacaattcgcttagttaatgttcttttttagcctgtacccttgatagcagcattctgtgagcaatggtttctctagtgtatagcctaggattttactcacattctttttaatttctttttcttttttttttttttttaagtgaaagcaggccaggtgcggtggctcacgcctgtaatcccagccctttgggaggccaaggcgggtggatcacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaagaaaactaattagtcagtattctgctactcaaacaaatgagctatttggataacaaagcatacccagtggtctgctagtaaaccagctctttgtgtgggaagggacaaatgaaaaaattcccaaatttgtagcatttgttgacttccatggtgtgaatactcccacatggctgatttcaggcttatagttggctcatacacttcctgcatatttaataattggccctcaccagactgtaggagctagctccaatgcactattgactgtacccttcatagcggggcacaatgttgcccttttaatagtcattttttaaatgggggttaataaactacttttgtgttcttatagtttttttaggtaattatagaagtgatgaatatatctggctgggcgcagtggctcacatctgtaatcctagtactttggaagccgaggcgggtggatcacttgaggtcaggagttcgagaccagcctggccaacatggtgaaacctcatctctactaaaaatacaaaaattagccaggcgtcatggtgcgtgcctgtaatcccagctacttgggaggtggaggcaggaaaatcactcgaatccgggagacagaggttgcagtgagctgagattgcactccagcctgggcgacagagggagactccgtcttaaaaaaaaaaaaaaaaaaaaaaaaaaagaagtgatgaatatatcttttaaaaattagtattataataaaatagttacatttattttaataaaacaaagcattttctctgctttgaacagccctcataattttacatggtggcagtggccagttggctgtattataattgagttaagcattctccagttgttagattttcctctattaaaactctgaaataaacatattcgtttgcctctcccctgcttactttcagattatttcccttggctgaattcccagaagtaggattactgagttaacagttatgaatgtttaaatggtttctgaaatggtttggtcaaaataaaattgttagaaattataaacagtttaccaagtagtgtttttctctgttgtatacttgaaaattcaagagaaactgcttttaagtgacaatcaccatggagccagaattaacacagacttctgactctcaggccctttacatgtaatgattaacctcaactgaggctgttcagttgtattaggttaatagaaataagtgtagctgtatctgaaaaaaagaaaaagaaacaacaaaaaagtagtctgaacaaaggcagttagctctatgctgcccctttgtgccatgctgcaaaattacacccacctgcaatacatctccatcctctgctgtggctcatcagtagagaaaatactaaaacagtaatggagagcagaactatgactaaagtaaacgagcaattaaggtcctgttcagggaacctccattacccttggacgagctctgcacttgcttacagtgctgtctttaactgggtgtatgatttagctgtggacccagtgctactaattctgcctgtttctgaacaacccagctccgatattttgcacatgcacctcaactggattccaagacaaatgtgtgtacatgtgggcacatgtgctcaagttgtttaggtctcttgttatacggaatgtgtaatcaatgacactatacttttcatccttagatctgggcaaggtggaggggcggggcaggtgccttgatcctggagctttagaggccctcctctggaattcctctagttgtgataccacccccccaaagcatggtgtaaggaatctgctggaccaagggcatttgcccacctggagtctgcccaagtacccaggaccctgtaattctcagcctgaacagccccacctccacttccagggtttgtgttttcctcttccctgggtgatattctcctgatggtggtgcatggccactgagagagagcacaggggcaggtgcttgctggggaatgtgaaggcggtgatgtcacatgtgtgcaagtaaggcccttgtgggtaggacagagccagggtgagggccaaggcttggtctcccccactgccttggggtagagctctgaggagtcttgagattttatttatttattttttatgagacagagtctcactctgttgcccaggctggagtgcagtggcgcaatctcagctcagtgcaacctctgcctcccaagtttaagcaattctcctgcctcagcctccctagtagctgggatttcaggcaccaccacacccagctaattaagtctgagaattttaagttccaacttggccttccacagtgttgtcaaaataggaggaaagtgcactttgacctcttgattcatagatttaaaatattctggcataaagggccttgtcccagatctcaagtgttagggaagcacttggtcattttcttccctttctggcatattagagaaaatgatgtgtacataaaatttcctcataattttcagcttcacaatttatactacggtaatgagcgccggtagcccagacaagtacatgactaggatcagaaacccgagtagaaagtaa

SEQ ID NO: 38042 - DNA, 142781 bp, Homo sapiens; identical to SEQ ID NO: 37647

SEQ ID NO: 38043 - DNA, 30557 bp, Homo sapiens
ataataataactatatgaatatggctgaggcgaacaatgcgttcttcgctgccagtgaggtaggtgactgtcttaatgtgtttgttcctgttttttgtgttattgagataatttaataggcttgaagggaaaaacaaagtatcaaatttatctctctcttatgtggcacaaggtaactactttggaggagaaaagagaaaagcttattggaaaagaaaacctgataagtcttttatcacttgtctgtagactgttactaatgttagtaacttcatacgaatcttttgattaaaaaataatgcaaacaaaaagtaaatatataagaatgtatgttaaaacacacacacacacatatacagtgttggtatctaagcagataagtggttatttttttagataccaggctagaagtgacttttaatggaaaatagtttaacttcacatatatctagggataattaagtgtcattaagttgtcatggtttgggaaactatgtgacagaagagtattatagtttcctggggcttggggtgatgtgaaatgagtgttgtaatttgttgctagatccccacagcccagtacagtgcctggcagtagtaggtgctcaataaatatttatagaatgaatgaatgagtggctggcatgctccaagacttggtcacagctggggaaactgggtgatggaatcaaaatgcagcacctcattgtctctgggtctgtcttcagtttacgggtgcagatgaaacaagcatcatcttcttgctgctctttttactgcatttcctattattgattttgggctgctgtttggtctcattggcctgccctccagaaaaacctcaatcttgattagataaaacatggtttcctaaaaatggtagactgtgtgagatttaagattttagaacaagaacaaacagaagtgaaattggcccaaatggaacatttcctcttgtggttcatgtaatataaagtcctcattttccagatacattcaaatacaggaaactgaactagcttgaccccagagaatgaaaataataatggcttcataaatgatcttggtaaagggaggcaagtgttatgaaagaaattaactttgagaaattattagaataaacgggggatcaagaattaaagctattcctagattaatcatttttatagtgaccatcatctctctaaccaagaagacagtttagataagggaatattgtttggcactggctgctgtgttgtttgtggtaatgaacacaaaccccatctgtaaggacgacatgatgtttcattctgtaggatttttttttccctacatttgaatcaaacattgatgaaagctctactgccagcagctgttcagagacaatttaattccagctgtgataattcaccgtgtcagacattggctgttatatgttgatacaacagttctccagatttgcatttttatcaaaaggaacaaatgttttgaacatttcagtacagatggtatttaaccatgtacatactactttaacatgttcaaggtaaacattgaaaagtcaatatctgtaaaaaaataatcacgtaaactctaaatgattaatctgatattggtcagatggcacagttaccaaagtcagtgtgtctttttgttgtttttgttgttgttgatgccatatgtggttatttttttataatctcagatatccagcattttggattcctttttttctctaaggaaagcttaattttaatatattacctgcctttaaaggtagtttaacattttaacattttcttggttatttcagtggattattatattaggttaggatattgtaatatgcttaattgaaattaatttgtcgttaaaaaaattataccatagggacatattgcatatgacatctctctctgttcctgaacaaaaataaaaaccttcctaattatgactgcttagcatagacatgttttatgttagttttggaagtaatcttatgtaatgatttctctgtacatcttttcttgaacaaaaaataaagcccaagtaaatgttaatgctacattatagcacgtgcctaatttcccagtcactgcattaaaagtaaatttacttggttttttaacattttaatgagtgtaaactaattcaggaagtctttaggtttgcatgctgtaaagtctaaattgtgcctgaaaccaattcccttcacatggatattgtcctgtagataacactacaggaactaggatactctgagtttgaaattcacacatttgctttatgttttctatctgtgtcatgattaccctgaccatttttaaagtactttaaatatttattgaaataatatttcaagtgttaattacagtggtaatgaaaacagccaaatgccacatatcaagaatgagtgtttatccgtattgttaatgtgatatgttagatttcattaagcagtaatggggtagcaaatgagtcacaaattacagttgcatctgttactagaccatattagtgccaaaataacggcaaatgcaaccatagggttatgctcattagccaaccacgtttgtggccaattcatccctttgtgtttgggaactaggggttccacagttagaaactgacagcttttggggtcattattagaatgcatgtgtcagaaaatccaatattttagtctagcattcaaatgtattattctgctacgatgttttgaatatattgagcctgctaagaacctcaagatgttcagttgtcccaccatagactgccatagctcgtgacctctttttttctggtgagatacaaataacatttgacaggttctatatgtaagaaatgttttttgttgcttttttttcttgagtttttcttttccctcaagtggtcattacattatatcatgattgatagcttgaagaatgatgattttcagcacttaattagtcctcttaactgataatagcagactcaaattatcttgcaccagttcattctttcaaatactattaatagtaaatgaactataagtttgactctctgagctaggaataaaaaatatgagtagccccccaaaccctccacctgaccaaaaaaaaaaaaaaaaaaaccaaaaagaaacaaaaaaaaacctagaccttgccactcccccagaacctctcgccaaaaaaatccccccaaaaatggttagtgtggttgggtggagcaacactgatttatatcacgaggccctattttaaaacactgcctttaagaatctcagtattggctgggcacggtggctcactcctgtaatcccagcactttgggaggccgaggtgggtggatcacaaggtcaggagatcgagaccatcctgcctaacacggtgaaaccccgtctctactaaaaaattcaagaattagccgtgtatggtggcgggcgcctgtagtcccagctactcgagaggctgaggcaggagaatggcgtgaatccgggaggcggagcttgcagtgagccgagatggcaccactgccctccagcctgggagacagagcgagactctgtctcaaaaaaaaaaaaaaaaaaaaaaaaaaagaatgcattaagacttacttaggtcttgagatataatacttctctaagtaagcgaacagcatcaaatctagttagtatttctatatcaatatagctctatgctctctagatcatctttaaaaagtcgaagactggtagaaaatgttcagataaatacatattaaaatgttcatgtaaaagaaaataaccctctttgtagtttaaataaaagcgctggcatcttttaatatgaactatgataatccttatataaaacattgtattacacacagtaacaatttccatagaagtagtcattgcacttgggaatataccaatgaggaaattaaaaaagcaaaccacaaatttaatattacttgttttatatgttgtggcagaaagtaaatatatgtaatgttcacttctggattaatatgtgtgtgtgtgtgtgcatgccacaaaatcatcagcattttataaagcatgtggatagtgtcagcggtttgagctgtttcactaacatatcaataaagtagcaatttgttatatgctccaactaacaacaaagacagatgttgctaattaagtaggcattaaaaaactgttaatactgatactccattaaaaccatatgataatgagacttaaatctttaatcagaatgatcagcaaaactttatatatggaaatctgtgtttaagatattttcatttgagaaataaatatttggcctagatatgtatgtagtgttttcatgcaatgtctttctctttccctccccggaggaataagatataggaacagaatatgaagatacctgtattttgtttccttttagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggtaggcaccacatttattacttaaattattttttatcatttgcacaaatcatagtaaagatctgagagtccatgttctgaaacgtgctcttgcctgttcctagtggattgattctagtgctatttacatgcaggtactggatcgctgcctggtattgaacaaaggggtattgggttggttgacagtaaccaaaaagaggatgatccaaaaagagtctgctgatttaaaatgatttttttttaaagtctaattcattaatttggaagtagccaatcttcccttgctgttggcttaacacaaaggtgtgcttgagttgaaagtttgcccaggcaagattttagaaatggaagtccttatcaggtgcctaagtcttttgagtttttagtattataatgcttacgatacacgatttattcttattgcaaatgaaataccaaactgagataccaaaaaagggaaaaagtataattgcttataaccagcagagaaaaatatagaacaagtgattatgtgaaatacacctaattgcgttatttattgtcataaacatcgattaaggcactccagagagccaagataactaatgcaataattttggttctatttttcttagtgtgcaattatagtcagcaatcactagagtaaatctgcttaagtattttaaactcttctgctgggatttttcttttttttccatcatagcatataatgcatttgtgtctagctaggtgaggtactaagtagacatttttaaaacaagattaatagtttatagagcttttttttaaaaaaccctgataaaatgaaacagatgtgttggtataacaaaaaacaaatcctcttgcttgtttacatatttctctgcacattaggaccatgccagtgatgtttattggcttcattgttaattccccagataacaacatatgattgcaaaatatgtagtggattagtggtgcaaagattcaaagtgctctctgaaatataagattgctttcccaaataggattgcagcaacataattttctttgcttgtgatcttttgtgtttgagctgaacatcagggtttttattttttacttttttttttttggtcagaaaagaattcagtgaacagtcgggaaatagtcattaagtattcataaacgttactagacatcacaaataattgtttcctggggactttcttatatttttgtacctttgacactggaatggagggttctattctctgtttctctacagccaggcttgcaatgttttgcttagaaaagaataaaaataaaatgggtgtgtttagtcaccaagggagtttgccagggttcaccatcattcatagatgctcagagaggctcatttaagttgcagaaatagttaaatgtgtgttaaaatgtgtactttcttaaattggtaaatatttattaataatataagaatctgcctttaaattaaacatctgatgaattaccttgccttaaagctataaaactgttattgctgccataaaaaagtgtaaaggaggcattttgactatgaaatttcatttcatggtcaattgaatttactatattggaaagaactaaagatggaatcataaaataattatgatattcacatacacttaaagaacaatgctttcacggactggcgttgggaaagaggactcaatttttaatgcttcttttgtaatgtatggctaatcactaaagcagttgaattatttcattgatttttaaaagtataggtactttagctaagtgcaggctgttgtcatggtatttacatggacctcatcacatttattggtgcctttttgaagttttgctgaacctgagtgatatttattttggcttgaaacaaactaatcttgttgaaaattctagtagaatttcaccttgaagaaatgtcatgggattttaaatcacaaatgttggaaaaaaataaaatgtactaggacagaattatgatgaatacaatgtgttgttggctttgttctatgtactacctgacatgttcacctataaacttgaattcagaatcgccagaggcatggttaaaaattggttatgtcagggttcttctatatctctctgcgggtactgagttggctggctacatcataacactccacagaagcctcctcagagatttcccttaggaaagtcaccagaaaaataataaataatactttatacgtcatgcattcagcttcccagtgtgtgttggatatttcataccttatgcaagtaagaagttttattatccaaatgaatatggctgtctgttaaggattgctatggtgaattaagactatcatataagaagaaaagccagcttgttgatgttgtattgaaccagcttttcttcagagcttcatcggttttcctttagaaagagtgacagtttgtcacattactgattagctgcattattgttggcaacaagcacaacatgtttatcttcgttaaatttatgccattatatttaaaaacagaaggcaggaacaaaaaagggggattaaaaagagtccagtgattagcattcacatttcaaaatatgcaaataatgccccagtattcaaaagcgaattgctgaaaaattgaatgtcgatgcatttgtgacttcaaagaacaaccttgatttgcttgtcgtgaatacgtgtattttaaaacaggatgtggttggcaagtcaaaatcaacagtatattttggttaaaaatttgttacctctaagtgttattgtcagttcagatgatcagaggaaattgttttaatccacaaaagattgcaattctaaaaatctacaatgtgagttccaaagggttgtgtgtgtttttttttaacacctctctataatctgcccagcctgctgagtagcactgacatcagtagtacatcaatttcagaaagtggattatttttactagacagctattgtgacatattgggtcagtcataaatgaaagatattcatgcaagcatgcaatacttgtaatgaagtctcactctgaccttctgtatgattgattctgtaatttagttttctcaggcagtgcctgaaatgaaatgaaatcatgttgaacaagttttgaatacccacagtgcaccaggagaagaaaaatctgcagccctagaggcttgagagagagcagatgaacgatttatctctatgctattatagcctttgccagcattcaacatttcttttttttttcttatttggcttaagtacttaattctgcaggtagctgtaaatgggaaaataaaatgctgttcagatttaaaatgacaggacaggagtatgtgcaggggactgataaaatatcttgaatagaactgacctttcatgtagctgaaagttactgggggattcatcctcataattaccatatagattatttttatttctttcctgcaatgaaacatttcagagagcagtagtgctgattgaatgaaaattgaacttgttaacattcttttcagcttagcctgttgtacataacagaaggttagctttgatgaatttcaaaattctctttgatatctaagaaacagacagtaaaataattgtctctggtctgatattttgtatgccccccaaaagagaatttataaaacacactgataattcacatacttttcttcatatattatatttccatgtttagaggactgacattttctgtttgatattaccttggatttaattgtgatcacacatatttatagaaaatgctatagtggtgctctagcaatatcaaacggagtattagaaaattgaaaaagatggaagtaaggaaagtatttgagtatggtagtattcgtacctgttaaagggaagagaaaaagagaagaaaaggtcctataggagacatttatgcagagaagaaaattatgagcttttaaaatattcataagactcttaagtcataatccagacagatatcatttttgatagaaaaatggcaatttatcaaaatattacatctaaaattaccaggcttattttagaagttttttttattattatacttggcatggctctaattttgaagttgaattattatatttatttttaagaaaatgactttcatgccatttttatacttaaaaaaatcttacgttaagagaaatagcagactttcaattaatatgttgtttttagcaacgttgcttaatgtgttacagataaagccgttatttcatgggtcattaatgtgtttaatgcatggaacattctattaaaacaagcctttattattgttatgaacgcattcattgccattgtcaatagaggctggggagctaaagttcacaggatgatgactatttagccatggggggacaagcaatttctcatacaaattgaatgcttacaaatttatcatacatattgaataattttggtcaagttacggtcaaaaactattttattataaattaacaatgtaaaggtcacaacttacctaggcaaaaatacacattgaatggaataagacctatctgcatgaactctaaattataaaactgaagccatatattaaccttcaatgaatatttactgagcacctactaagtgctgtatattgtttgttgttattttttttaattttacatattttttagagagaggatcttactctgtcactcaggctgaggtacagtggtatgatcatagctcattgcagtctcgaactcccgtgttcaagcgatcctcagcttctcgagtatcttggactacaggtgtgtgccaccatgtccagctagtttttaaaattattatagagacagggccttgctctcagttgcccaggctggtcttgaattcctggcttccagctgttctcctgtcttggcctcccaaagtgctgtgattagaggcatgagccactgcacctggcctgtttttaatcattagagattgattatactgtttgtgaaattgttttgtgtttctttctttttttttgactaccagtgtcccctcaatgaattacagagattcaatctgactgctgcctgaaagaagcttattgtcaaaaaccaactttaatttagctgttactataccttgataattgtctgccaaaaatacccaggccacagacacttttacaagctgccttctttgtagagccttgtaccacactgagcttaaaataaatattctttattcttggcctgtgcatactactgactctgaacagataggaattgtctttagggctgagttaacctgagggtcatctgtcaaagtaggactgtgttccaaacttctactaaacctaattagaccttgtgcagtgtgatacatgattattgtttagtttataacatttaaaggaaaatgttatgagaaggctggctgtggtttatttccctgtatcttctttttaacatagatcatctacagttaagtattgtagtacttagtgatggttcagagacagcaaagacacccttttacagcacttagattcccacataagactgacatgatggctcaaatattttttggagaggtgagagttactctgtatgccattacccctgttccttttattcacagcccttgtcgtcctttgcaatggtttcctttgcttgcttcccatctgtctcctccctaccagaatagaagctccaggaaggcaagtgctccttgggtctgtttggtgtcgtccctgggcctggaatatacttggctttcaataaatatttcatttgttcaatatataaattaataaaaggacaatgaaagaacatttacttgttattaagagcatacttagactgctaagttaaaatggaggggagggggcttgaagtatcaacagctataaaaagtggaattgctctttaaaattttaatttaggactgaataaaataagtgtggagttgtccctttggtaaaacaaaggcagttgcagggtacatgagtaaactaccattaagtgttcataataaactcttgaaaattttattttgccaagaaactattaattaactttagggaacactgttttttacaaaactttcatgggtaggtatgtctgattacaaccctgagagtagttattaagtaaaaatgatctatttcagtgcagatattttgatgagtataaaggtggtggtatgcaggtctgtaattatcattggtatgcatttggcattactgtgtcagggtccattggagttacaaaagtagtagctatgcataactatttgatcgttgttaatttggaaataaaattttaacattgctataagacataactaaataattgaagataaaattactggcctgcatttcctatttgcagttaactctgatatttatgaatacaaagtaatttttattgctgataattgtttaattacttcatttctcaagaaatattgattaaaaactggcacagtgaaaatatatttagtcacactctaatatatttgggttagttgcttcttaattggatgttatgctctattttgaaaacctaatattggatcgttatggagaatatttctgtgtaagtatagatagaagatgcattaaacacatttgcatattagaatttaaaaaaattttaatgatgaaatcaacccaagtgtaagtgccattgtaataagtataaacacataatatagaataataatgtgtaatatttacaataaaatgtcagggtgaaagcttatatcttagatttgcaaaaagaaacaaaacaaagcaagaccgtagtatgtatagctatggactactaattgtgcagcacaaagataaatgtagcactgctccaggtttgaaaaaatgagtgaaaaggatttaaatatgtagagttttctcatttaaggaaattagagcaagttttatccattctcttctcatatcctgctaccctaagacatatcttcatatgaagtacaaacatgatattataacatagtgacttacacagtaaggaagtttttcacctttcaattctcttttaatcttgattaagtccaggagaaagactcagtttggggctaattaagtctttcacacctttcttttgccttcttaagttaaagaaagcagaactcaggcccagagccttaggcaggccccagtatccacactgactataacagtattgttttcttttcctggtgtttatttggcattctattggccatgagtgattttaatttttcatttatgttagtgatctaaagtttccttattaatataacattattcagattttaaccgttcactcaaatgattaatgttcaataatagactgggtttcaggcaatttaagaaaatgagggattgctacccaaaatatccattcattggatttttcctgtttaaaaaagacaaagaggctctttcatcaggtggagagagaggcgagcctccgccaggcactcccctacccccaccaaggcatacagaaaccagaaggctttgttgaacaccacaggcatgaatcatataggccaatagatagaaggcaatgcccctcctattagtgagagcattttatgagatccatggcccacccactctgagtgaccttctgtgactgcaaatgttaatctttgggtattcttcgaaacacagattgaggtggcaggctatacatttatatttaaactaaatagaaatgtccgcaattgatttagatgggttggttgtccatgaggtatggtcagttaatatttattgcaatgaatagtcccaccagatatataccatgctttaaactttcaatggcagccttctacactgtgaatataatccagacttcctaacccagacaataaaccttgtcactttatggccatgacttgccgttccagcctcatagccagctatgctcttcctggcccagtcacactggactgtcatttccttatcggcagtatgtttgcccatgccccaggtttgggtacatgttcatctctgtctgggatgccctggcttggttagcttctacttccctttatacctcagcatagtaggtcacctcttcggggaagcatcccatgatttccccaccttacacaatgaggccagtctctccaagcctattgcatttcaccctttaccttgcctaccctgcacccagctttcctgtccaccttttcatttctcaagcatgtcaagatctctcccacttcagaccttgcacatgctgttccctctgcatgagacatgcttttcccttcacttcacagttggcttctccccatccttcagcatcagctcaaatactatcttttttgagaggcctttcctattgacccaatcaaatgtagccatccttccccaataactctcttttgtataacctatttattttcttcccaatatttatcacagttggaatcttgtttatgtggatgctttctatttttaggaaaagaatataagctttgaacattcactacctgcctcccccaaggagatgatttttatgatatttgtctaatacagtaatttgcaaatgaaggggattttgacatttgctaatgtctgtatacattttggttgtcacagcccggtagggaaagggcggctactggtatctagtgggtagaggccagagatgctgctaaatattctataatgtacagaatgcccctcccccaacaaaggatcatccagacccaaatgtcagtaccactcaggctgagaaactcttatctaatatcgccaattagaagacaaaacgagacaaggcagagagaatgagtttttcccaaatactgaaaaatttaggaaactatataaaggaacattacatataaaatgtaattgtgaaaggagttgaaaaagctaccagcattcagctcttattgttggttatgatagtgggcaatctcttagaacccaatagctgctttgcctttaaatgatcactggtaaatctttcaggacttaatttttgtaagtaagaagtaatattaacaaaatcacattaaatttctctgggctatattcatagttatacatttccttattgtgtcattactactgggaaaaattgtgagcaattttggtgggagtatataaaaattattctggcctacattatgttgtagtaaatttgttcatccattcaggattttgtttaatgtgtaaaataatcgcatggtaatttcctggttctcaaagatataaggtttgatatattgccttctctggcctgatacatagtaggggctcagtaaatacttttatactgagctgacatcttcctctttttatgtggtagtcctaagatcaagggtaacatcttttaaaggttacttttatggaaaatgattggagctgttgaggatcctcaagttccccaaggcagttgttaataatttgtggccctaaaagagcttgaatttccaaagagacactttagccattaatcgtcttatactataatcttcactcataggaggtgattatgggataactgtgaaccgtggtgagtggtggcacattttgatgcatcaattatgtgggtcagaggttactttaaaaatagtctagaggcccttggtatcttgtccagtgggagatggcatctttttggatctgaagactatgtggatgactctaagttttggcaaggccttggccccaccaccagtactcttcaggagtggtttccatactgtcacactgcaaaataatcttttttttttttgtaatgaaatattatgaggaacctcaatttataaaacaaatggaaatggagttgattttgttaaagggggatgatggcagtggagatcccagagtcttattcatctatctctgccgggacatgcctctaccgtgaagataccatggctctctagggcccaggttttctgtcaagcattcactagctagcttgggggcctggggaatcattcttatctgtctaagaataagtatagtactagtatctaatgcagaaagcaatctaggggattaaattagaaagtgcatattaagcttagcacaaatgctggctcatagtaataaacacacagtaaaactccctttttagtacagtgaaccttggctgtctatcagcaggagctccccagcaacaagatccataataaaggcataaattgcagatggaattcaggaagggctgacaaagccaaggagacatgcttgtgtttggccatgatagccatctgaaaaatgctctaggtgtggggtgagtcaatcgagcacctatatgtgcaaattttcacaggcattggagcaaagagagcaaagtaactctctgctaatgagaaaactgcataaatcagatgatcacatttcatgaccataccagttaactaatttagtattatacagtcagaattaaaatacttcatttaaatgtgccctagaatttgcctgtagatactttaaaacatctagatttaaataagatggaaagatttttaaaaagcattctgggccgggcacggtgcctcatgcctgtaatcccagcactttgggaggccgaggctggcagatcacttgaggtcaggagttcgagacaagcctgaccaacatggtgaaaccccgtctctactaaaaatacaaaaattagctgggtatggtggtgcgtgcctgtaatttcagctactcaggaggctaaggaaggagaatcacttgaacctgggaggtggaggttgcagtgagccgagatggcaccactgcactccagcctgggcaacagagcgagactccatctaaaaaaaaaaaaaagcattctgaaagacatatatgaagacgaaaatttagaataagctagatggcgtaattaccagtagtgtgggggtggaagttatgtcagtgagcagtggttacacttcaagagaacatggaagactgaatagatagctcagattttctaggagaaatgagcaaatgtggtagaattccaataaaaaaagataattaggatgaacagataacataaaatccacacaatctgtagaaagacacctgcaagtagaacgtaatattgtaggaacaacgaaggagaacactgccggtgatataagggagtgtggtgttctgatacttgtgacactttcctccaggatttcacagtaattattcggaaattattaagaaatgggaaatgtatgtatttaatattctaacacttgttggcagactcttttaaccacttgcattatcttccttttttttctgattaaagtgttttagtttttgtttactttttttttccatttcttttttttattattattatactttaagttttagggtacatgtgcacaatgtgcaggtttgttatatatgtatacacatgccatgttggtgtgctgcacccattaactcgtcatttagcattaggtatatctcctaatgctatccctccccattccccccaccccacaacaatagcaaagacttggaaccaacccaaatgtccaacaacaatagactggattaagaaaatgtggcacatatacactatggaatactatgcagccataaaaaatgaagagttcatgtcctttataggtacatggatgaaactggaaaccattgttctcagcaatctatcacaaggacaaaaaaccaaacaccgcatgttctcactcataggtgggaattgaacaatgtttacttttgtattgtggtcacagcttatcaaaacagcatacacatgtacgtagaaaaagttgaaactctcccctccttgcccctcccattctaccccttataatgtaaccattgttaatgttaggatacacttttttttttcccaaagaaaacaaggctgtcctgtatagttattttttaacttgccttttatgtactgtatcttgggtaggttagtggttctcaactgggagtggttttgccccgcctggggcaaagtctggagacatttttcattgtcatgactggtacggggagggacgttgttagcatctagtgggaagaggctggggatgcatctgagtacctacaatatgcaggacaagccccctcaatatgcaggacaagcccttacaataaaaattatctggtccaaaatgtcaagagagctgaaattgagaaactctgccctaggtcaatgcacataaatctaattcattatttttaaaagcttcataacactttgacgtatgggtagaccataatttattcaactagttttctttgatagatcttctcattgagtggcatttatatatttaatatgaagaaaccaaatgctccaatttagttatttacaattcattccgcttctttaaagagcaaaaataagccttatcggaaggactcaaaaaaggaacagttaagaattcataggcttgtgtataaaattagattctgggtcactgtgagtcaagagaatttggtttcagcaaaatcacagactcactccaaatgacatgtcttaaagtaagtcatttgaaaaacatgtcttcattttttgattctttggaattaaaaaaaaatagagaataagcagtaacaactataaggcctttctgtatgactaccaagaacagagaaagctgcatttgaagtaactgcaataagtttcagaaaaagctatttctgatggtttctaccatctttttttacgtatttatgaagaaattcattagtacattaaatcatgatggattgaacaaaagaaaacaaagtaagtttaagtgaaaaaagtgatatccaatccaaaagacattgaatgacttccagatgccgctgacaatgtaattcagaatcggaatgaccgtctggttaaccacagaggatttcacagaaagggtgccctaaagcaaacagatgtttgctctgtgaaactaaagctctatgctttgctggcccatcctctgcgtgccctgtgcatttctgggagaataaaataaagaatggcttcgccttctctcataacagctacatgtttgagaaggatggtaaactaatggatgagcctaaatgggtgcggtctctgcttcagccctttccctgccaccagtttactcaataagaaacaagagatgaaagattatatttagtttttctaatttcctttcttctttttttccttccttccttccttccttccttccttccttccttccttccttccttccttccttccttccttccacatccactgacagttctataatgaaatattctgttctggatatttggattttgtgcttctcaactttcaacttcttggcatgggtccttatatttaataaatgaacggagaccatcatcctgcaataggtcagacctatcaacattgcaacagttcaaacctatctaaggagatgctaacctgataagttcactgatatctggaaaagctgaaatattttccccctttgttgctgcctttctaggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagtaagttagaactgccttagtgtgtaacctgccagagaatatgggattaccccatgctgtttgaatttcattcatggtgttatcttgtttgtcttcatggatttggagtagcatttaaatgtatgatggtttgttgtttttcttcactctttcatttattttctgtagaaagtatattggactggaaattgagagatctggcttctcctactatagctgtaaggcattggacatgttatttaattcttgtaggcccaatttttctaatctgcaaaaggaaggcttggactccctgctacaaatttccagaaattctagacattccagaaattctaaactgctctggttctaagttaatgtccatgtgagcaagtttcatccagtgtgttggtcaagctgctgccacatttgacagccttgcggcttcggtgatgtttatcgctgagttcattctcttcatcttacatttttgcctttgtcatgggaaatgtataatttgaaatgatacaaagtttgaaataaaaactgtgttccagtatgacttttccaaatgcttagaatgatgaaaaagagtactgtaatagtacataattactcattagtcacttattaattatgtgctgtatacctactctgtgcttggcattttgtttggttcttgtgatacaaagatttataagagaattactgctaatgagattcccctttggggatgaatagcaatgtttaaaactagctccatatgtgattagtgatataattgatgtatctggtgtgctgagattctaatcgattctgcttgggagagtgatttgaggaagactttactgagaaagtgatatttgaattaggtctaagaggatgaataaaagtttgtgaggcagaagacagaggccagcattttggttgggggctagtgaggaacagtggaagtacatgctatttatgggtatagtgaagttcgatatgggggaagagagaaatagaagttgaagaacgaaatggcttaaatgtggtggtctttcttctgttggtagctgagagctgattaattatttgcatcgaggaatggcataagtaatttatgctttagagagacaactttggctatatagagaatgccttataaagggagggaccaaagaaaaggaaattaattagaagactcttttgttatgtttcctttcatcaagggagggaatgaacagaaggtaccagattagcaggcattttaggagtgaaaatcataaagattttaaggatttggtgatccactggaatttgaagaagagacaaattgggttttagtttgagagccagaatggctatcagcaaatgagaggagcaacccacaaagagaggagtgttctcccccatggggaacatgagagtttgggatgttagagttgaatttgacgtgcttacattggagtctagaactcagtcatggggaactggaactatagattttgggaccatcagcacgtggatgagaagatgtgaaagtaatcaggacttctcagagagtattaaggagtaagtcaaggacagaaccctgagcatcatctatttctaagtagcaaaaggaagaagaggagctagagaagattaagagtgatgaggaacagagaagggaggttcaagtgatgctgcagaaattgaaggggtttcaagatgaagggtttattctataacatcatgttagcacccccattgggcccaggaatggtaaatacactgacagtcttctcacagtcacagaacttcagtccagaggattgagaagtaatggttaaagactcttgagggatatgatcagatggggttaggtaacagcttagccattacagttgagagggattcctttccctccaatcacacgtccgctgatcttcatacttgccactgtaccatactgaaattgtcatgtcttaaagaggacctcttatgggactcctagcttgctccattttaagcgagggtctaggttttgtgtaaaggcaatacagccaatgtatcttcattgaatcttagctgagaaaggaagattaaaactatcattgattatgtctctttggggtaaatctttttctccagctttctgtctcaacccttttaagtcaatgacacaaaaatttccttaggagaattaattctgaatttttgtttaaaatgtgagactccacatttcttgtttattcttaaaaaataataatgattagggcacatcatggttatccaagaaaggcgtcaaaggtggtcgacatttgaatattgttttacagagaatgaaattgaactcctcttatttggaaaaaaagctactctggaaagtaatagcaacttgccattggtcagggtattgtggcactaacagtgccagattttcttccaggagaagaatatagttgtttgactcaactagaaaaatatgtgtgtctgtatatagtttttcttgtttaaataatgtttttcattgaaggaaaacttggctccaggtgaagctctaactgaaaggcatctgactctcttggaaattcacattcattaagtagaattaaacaagtgtcacttattttgaaaatttagaaaaaagactatgggctctagagaattattgaatcaattgtgtgagttatgaaagatggcattttggaggagaagtgagatatgacttaaaaccatctgaagcttgtaaactactcagataaagtgtggatgctgttatcacttaaatagtgcaaacagtaggctcacctagaggtaggccagtggtttcttaacactttgagtgttcagagctctctaagaaaagttccttatccgtttcctccctaagaattttagtaaatggtaaaaatttagtgaaagttccaaatgaccctcatttagaaagtaaataatactctaggaaaatttgaattagaattcaagtcattaaaagcctatctgttagtaacttgaatctatcttggttgatcttgcccaaggctggctttgaaaacagattttgtcaaacattgcaggattcttgatgaagttaactgcaaaattatcttcgatattgtaatctaggggaataaaacaaggtttacaaatcatttccctgcttctctgataagtatgttaaatgatcagtgaacttagatggtggtagctggtgagtatggagcttagtcatctttaaattgggaaactatacccatatcagtttgtggttctgatctctcagagttcatatggtcaatgtgtgtgagtctctatggagtattcttgtgagcagggttacttgccataaataacaaacatcttctttttagtcttcttagtgatttttaagtatcaactattgctcttttttttacacgtttttaattttacggagagtatcaatttcccttttatctccacttaaagtagttttgacatttttacatttgctgttaatcttcagaaaattatttttagaaaataaagatgaccttttcctaatgctgcaagtatagaaattggagctaacttccatttgaatttctggagagccattagcaaagtaacattctggtaaaattaaaaaatcagcctcaaaaaaaaaaatcaattcagacagatcacacatatggcatgtgactatggctagggacctcatttaaaatatttgaatatgatcaacatcctgaatattatttaggttttacttctaaaacctctgaagatataaaatattttgctgatgtatgtatgtgtagtatagcatatatatagcattgcctggtacagagtgttctgtttttcattactcataattgctatttcgagcatatgttgtgaacgtattgaagatacttctgggtctcattaatcgatgttctaaatgctaatctctgctgtctagttaactccaagcaagtttacccctcccccgcttttggtggtgattcatctgttgatgatgcctaacaaaaccttcaaagaacaattatggatctgagttaagtcttgttgcattctctgcaagtacattctaggcagtgaattttcttcctgctttgcaggccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtgagacaaagacccatcaaggctccatcaataaacctcatgatcatttaaaatattcctcacaccttttccaagtgcatgtgttcacttaatatgattgcttcttttgaaatccttttctaagcaatggaatttaaaaacccagacatataaatctaaacaactctccagttatattgatttctctgtcagcttatgggtgcatgttcagaacccattcagaggaaggttggaagaaatccaggcagtatcctgcaagcataaacttttgatgataatcttttcattttaaataatgtggaattttttcccctttgttcaaaaagggcactacaaagggattaggtccatcctgcttgcctttccattgatcatctttctgaacccttgtgctgtcctggtgggtttccaaactttgaagctgcctctgcgtgtctcattattgtcaccgggcatttgaaattttattccaagttcattttaaagcaaggcagtatgagaggtattcagaaattagccatgcttgtgggagatacttccttaggggcttcgtctcctctccttccccttgcaactcctccacacaaatgaagggaagaatgggttccttgggggtcgatcccccccttactccttgcatgaaactccaattaccattaaaagaagttaacttttacatatccacagaagaatagatcaactcctatgagtgataaaatagaataattgttttcaagaatgaagagtggaaagtccttgattttgtttacaaatcatgaacttatttcaggaactcattcctagaagcttgttttgttgggaaggtgcaacattagaaatttctttttagtttgcactgagtttattactgtagatagcagactgattttctgtcccagaaatataattctgagggactggaaaagtgctgcacctaacttttaaactctggagagaaagatgcatgttgactgaacacccagccatcagaccacttaggaaaaggagaagcccaaatcatgtttaatatgctggaattttatttatgtaactcagtggggtcactaatggaaatctcctagcttggatgatttctgacttttaattttgctccaaaagaaaaccaacattgaaatgctttgctcttttctcttctgtcttcatcattttacctgttgtttttatcctcttgtttggtatagtttagaaaggtatctgagggaaagaagacattgatggagaaactcattattttctctaaagtaagccatttgcagcaaagcttattcttcttgctaccttatttattgccttagcatgaggttttcagctgttctcaagaaaaagtgattctcaagtaatctgtattgcatccagaaatctttttcttatttgcaatagtaaatataaaaattgtgctccagtgagggtggcagggttctgttttgttttaatatccgtgtgtgtgtgtgtgtgtgtgtgtgtgtgtgtgtgcatgcgctaacatttaaaaatcaaagccaaggagaccaacctttttatgtgagttgtgtttatgtgacctaatttgtgcagcagctattttatagctgagaatttatacgctaaaggtggtgctaattgtggtcttttaataggtatataaaaggaaaacagaagctgccaaaaaagaatacctgaaggccctggcggcatacagggccagcctcgtttctaaggtaaacctgggcaggggcggccaggctccaaaatagtcacagcgtggaaaacagccctcaagcattgaaaacatacttgtagctcccctaaaagttgatggaaaggcatcttgaacaacttgtaaacttaggcgtttccattagagattacccaagtgatgatctgaaaatatgagttaatttaagcagctgagtctaagttgtttctgaaagatttccctgatctttatatatgtgtatgtagctatatacataaattttaaataggctcttatgctttcttctggtcagggattgggacctgtgctagtgtcctctgtttaaactgggaggtatgtttgtcaggcatttttggacatcatattataaattctcctgtggttatattactacaattggggggcattgcatttttgaccaaactgttccatatcatataaataaataaacctcatgatcatttaaaatgaaattatactccaagtactaaacaaaacctacatgtattatatagagagtatacagtggaccctggtgtgttataaaatatcccaatatcccaagcaaatgtcactctagcaaatgaatccaaaggaatatgagctaatacatgatattaacatttaattagctttttctcttgcctttctagattttagaggttttggaaaggataatttgatctaatatatttttgctctagacaaattttttctgacaagtagggatacaatttcattgtcactgttgctgtctcaagtacaacctagggtctcaaagccatttaaaaagggttcattcctttttttctcttttcacctgagttgcttcttctttatattatctgtattaagtatttgtatcaagatctaccatttgcagctgctcagaatcagatcaacagaggtcctcctctctttgctgacagctattaggacacttcccacttcattagatagataaaacatttatcaggtcaatagcaaaacctctttctcagactctggaagacacatactggaagatatactgatgttgtactcagacttgcacattggcagaaaacagctgactgtgtgggctgcagatgttaagaattaaagtatagttggttaactagatggagtgaagtgaatagagtaacagtgtgcatgtacttcttaagtgaatcatttattcattcatttatccagagcaggtataggtgattttgtgcattaaagcatgaataattgaccgtatatggatttaaaccaagatccggtatctcaaaaggcattcagggaatattaaccatgattgggctcatgaagcctgtgactgacttagaggggataacttaaaacttacacattgcatactagaatcaggattcagaaatacttccaggtagaattcaatgacaccaaaaaagagaaaaaaaatcaataggatagaatttagaaggaataaatttaaaatactagggtttggtttgtttgttttttaattcagtaaatgcactttgagaggatcctaaatctctattcaaagaactgtgaggcaactaatatagtcctttaggtataagtttagaataatttcagcctgaacccaaactgtgaagtagctgctaatatagtgatcgcacaggaagcagcattgaattgtacagtgattattagaccgcttctaaagaattggttctgttttggatcccacagtttaaagagagatgacaatcaattgatgtctctctagagcattgcctccacgatagtgaggactgaaaatcacatcatgttagaataactgaaagaatcagggaggcaaggacttggaggcatatgatcttagtcctcaaatataagggccgttatataagggaaatgaagtcgatctttgtgcccaagagaggagaactcatccaaggggtgagcttacagggagtgagagttcagccccagcatcagaaatatcaatagggttgcatcatatgcacatttaacttatgcctctgcacgcagagcctcagacctccccccttaagatacgactctgctatcacttttaatctttacaataaccaaagaaattcatggaagcttactattaagccataaaggaacaagaaggcaggcaaggaagaactctgtgcaatcatccacccatctccatttaccgttaaggcagcatcttaaaggcacaatagtgcaactgagctgcccaggtgttgaaatacagactttctttgtgtttttttctttaagacagcttgttaatttttaactactagagtatataagaattatgtacatgtttattgtgtgtattcaactttatgggtgatttaatggttttttgaagacaaatttgaatatttataggctgcttcttaccctaagaccttagaacatgacggttcaggaacatgcagccccactgagttttgtaatgtggagagctgcccactgaaggggagtgccttataatgatgacatgtgttcaaacagaaaacatcagagatggcttttcctacactggatgactctctatatgaggttacatctcagtttgtttccaacagcaggattttataaatcggagtcataaaaatttagaaatataaaattattgaagataatggatggctgtttgatgtctcctaggtgcccctacaacacacccccaaaaacatcctaatcaaatgaaaaatacaaggaaaaaatcgtctctggaatgaatcattccaatcactgttgcattagtggaagaatttctttttgtagaggcagtgaagtgtttttagtacaaaatgtaatagatagtttctctctatgttcagccctagatctgctgtttatcttttaacaggtgatttggtcccatgaagttgaacattttccccttatctatgactcctttgataaattctacaaatcttcaaaaatagttgatgaactaaaacatttctaaaattgtgaaaacttcaatttggtatctctgaggaaaccaataatggttttcttatacttgagtgaaccttgttataaataatcacacaacacagggctttcaagtattccagtggccattttctggtaatagtaactgttaactaataaaaatagctaatatttattgcttcctatggaccaggcgctttcctaaatgcttaacatgtgagttcatttaattctcacaacctctgcacaagaaaaataccatataacctggccaggggtagtggctcacgcctgtaatcacagcactttgggaggccgaggtgggcagatcacgaggtcaggagatcaagaccatcctggctaacatggtaaaaccctgtctctactaaaaaatacaaaaaaattagctgggtgtggtggtgggcacctgtagtgccagctacttgggaggctgaggcaggagaatggcacaaacccaggaggcagaggttgcagtgagctgagatcgcgccgctgcactccagcctgggtgacagagagagactccacctcaaaaaaaaaaaaaaaaaaaaaaaaaagaaagaaagaaaaataccatataacccaatgttacagataaggaaacaggaacagatgagtaaattaacttgcccaatgtcacaaagttgttaagtcagagaactgcatttgaactcaggcagcctgtactctgttgtctttaaacatatggtactcaatggtaaagtcgttagtacagacttaaatgcagaagaattgttgctcttaaatatgtgtatcggttatcttttgccacaatagtgctgtgtaacaaccatccccaaagctcaatgatgtgatgtaagatgagcatttatcctcagagagtgccagttagctgactggttcttcagatctaggccaggattggtagaaccagctagtcttgcttttctgtctggggtcagcttgcatgttggagggggctggactcattcacattgatcacagttggctggctggcagtgaactgactcttgaggggggtaattgggccacatgtctgtcatcatgcacatggcaggggcaggcttgaagcctcgtcttggaactggagcagtatcactgtcatcacattctgttagccaaagcaaaggcacaagagcagcccagactcaaggaggtaggggatttgactccacctcagggaggagtgaaaaagtcacaagacaaagagtacacatacaggagggcatgaataatggtggccgttaaaaaaaatcaatttataatatctaaaaatgcttaaatattttaaatacttatgtgttgtaacagtctggaattttctcccccaaaatgcaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcag

SEQ ID NO: 38044 - DNA, 113405 bp, Homo sapiens; identical to SEQ ID NO: 37588

SEQ ID NO: 38045 - DNA, 2175 bp, Homo sapiens; identical to SEQ ID NO: 37860
